United States Patent 10,233,495 (METHODS AND COMPOSITIONS FOR SCREENING AND TREATING DEVELOPMENTAL DISORDERS) - sequence listing, part 158

SEQ ID NO: 885 - DNA, 1214086 bp, Homo sapiens
ttttacaaaagcaattatccatttttattttgtttacattgcactgaaaatttacatcatacttttacaaagtttcttttcataaaaatatacttctttacaaaagtgtatgcattaatataagaggagtagccagttgcagaagaaacattgtttaaacaagatcttaaatgtattagccttaacattaatgaatgaatcattgttattgcagtcatttgaataaacaagaataaataactgatggcataaaatttaaaactgcatcctgccagtagagtaccatgttgagaaaattgtatgaatttccaaaacaatgtatctcaaagtggtttacaagaaattcattaaatgttgtagagatagagccaagcagcgctcccaggtgcaagggtttctcttaggcactctgtctcatgatacaaaaagtcaagactgttcacagagttatccatatttgaaagggacaacaacaaagagttaacactgggtacatgatcgtattcaatgaagtaaaacagctataaaaggaagacgatgacctattaaataaaaatgctggcattactgtatgatacagtttaaatgagccaccaataacttacaaatacatatcttaatttgacaatgaaagaaacctcttgtatgtgaaacttggtgtttaacaataaaggtacagaaatttaaaaatatataaaaatatgataagtccacaattgtaggcaataaatttatattggtgatttataataataatttttttcagtcattatgtttagtggctagaccaaaatatttttctaatccattgttaaatgaaaattaaaagtgtcaaaataatgctaaatttgaagactcagctggaaggaaatgtagatataaatagagtagattattaggacattttatttggtcgatcaaaaatattgtaaaataaaggatggtaagtttggtgtctcagataactgcaaaataataatttttctagataatttctgccagccaaatggtttttgggtgaggaaacatactgaagctactatcacatttgggattaaaaaataataaaaataaataggaaaaaaccatattgaagcaaggagtgaaacactaccccatagctcactgaataatactggttactccataatgggggaattgggagggtagcacaatgaacttgccctttgcagaaactatgacaaccagtctaaaagaagaagagcaatatgatgctaaagaaatagaaagattcaaattggaatgggaaaccttatgtcttccgaggcataaactagctcataaacatttaaagtcataactcaatcttaaataaagaaaacaatgcctcatttaacaagaatgaatggcagatagagtggtatgaaagacagatttgtgggcgtgatgtagctcaggacagttaaagagaagtcagtgatctattgactcttgtaagtatagctcttatttctaccctatatctttttttttaaacccagtccctctaatatagtttataaagcacagaaatactgatagtggatgctcctccaatatatgcaaataagtttatattttagaataatctcctttttaaaaaaagcaaataaactgtgagtaagcactctcagagtgcagccaaatttctgtaaaactctccatggtaaacatgaagaattatggtccagtttatgaaaaaacactcttctgtatcattcctcaggaaaaggtgacccagcaagtcctgaaaagtgtgctttaatttgtttagcagtgaactaaatgtgcactgttttgtgtgtcgatttccaagcttctgaagaaggcaaaggttgcctcgttataccattgtgcaaaccgtgttcaagttgggatcaaatcgtaccgccttcccttccactgactttgcgttggtgtcatacatgggattttcaaaagctgcttggccattgttattttcatgaactgaacatcctgtatactgtgttttaggtgcagtcctgttgatgagaacattgattagctatgtgttaactttcttccagaaacagcagactacagctcaaacataatgtacatcgttagcagataatgtaacttaaaaatattaattgagacatcataaacacactaagtcaacttgaacaatttccttgttactttaaaaacctgagtgacttttaattttacatatattacatatttatgtacagcatcaatattagtaacataaatataaataaattatatgatggctataataaattttcttacaaaattagaaattattatgacttatcatttatagtataaataataatgatgatggatttaagtctcatcactatttatttgttcaccaaatatttactgaacatctattatgcgccagtcatgattctaggcattgggtatatcatttttttaaaaaaagactagtctttactttcagggagttcacattgtagtgatagaaaacaagaataaattaaaataaataaaaccaaaaatagtaggtaatgagaattgttatgatgaaaaggaaaatggttaatatgaaaagtaactggaagccactttaggagaggtaatagaacaaagcatcttttaggaggtaacatttaatctgaaacctgaattataagtcggttccgcacaaaaagagaaggagattccctgaagagtacacaattaatgctgaggcctaatttggaaaggtactttggagtatcccaaaacatgaatgctcaattttattttttaaatggtatacattaaagcatgcaaattcaaaaattcaaagaagaaatggctactctcatactcaagtcatgaaaataatttctaaaggactactaacaattagttaaccagacacatgaattctgggttggctggtagaggatgctggtcttgaaattctgattcatttgtttatttcttccacctttgactaatgctaatctagtttatctttcccacgaagcatgtataacttgctcacatttgtaatggaaaaaaggcagacttgctgctatctgtttctggggcctaattcctaaaagggatatatcttaaaataaatttgtttctcaactctattgtttatactgaacaatcgaatttcaactattaattttattataatttgtaattgccattatattattttattatcactaatgcatttttctgaatttatctatatttcaaaaatattaggtgatttctacgataataattgtaaaagaaactatcttaggtttattgggagaaagctaataacttgctcttactaagtgtgtctaatactataactctactggatcatattttttttccaaactagatttaaaataaaaaccaaagcaacatcattgccttctaattaggtaataatcatgaagatacaaaataattgccccttcttaatattcaacaacttgaaggaaaatattaccaagttttaaaaattcacaccatgaataaaatttaactcaaaatgaatcatagccctaaacacaagagccaaattcataaaactcttaggaaaaacacatggccttgaatttggcaatggtttcttggatttgacatcaaaagtacaagtaagaggaaaaaaaataaatttaacttcatcaaatggaaacttttgtacatcaaagaacactctcaagacagtgaaaatacaacccacggaaagggagaaaatatttgcaaaacatatatctaataagggcctagtgtctaaaatatatagagaactcttacaaccaaataagacaaacaacctaatttagatatgaacaaagtatttgaataggcatttcaacaaaaatggacaaagggccaacaagcacataaaaggatgcttaacatcacctataattatgaaaatggaaatcaaaaccacagtgagatacagcttcacatgcactaggatggctttaataaaaaacaaaagacaaagccccccaaacctggaaaataacaagtgttggttaggctttggacaaagcagaacctttatccattgccgataggaatggaaaatgctgctgctgctgtacagaacaccttgatggttactcagtaaattaaacatagaattgccacatattccagtaatttcattcctgggtatatactgaaaagaactgaaaatgagtgttcaaacaaaaacttatacacaaatgtgtacagtagcactattcacagtagttaaaaggtagaaacaactcaaatgtccatcaattgatgaatggacacattcatccatacaatggaatattatttagccatataagagaatgaagtactgatgcatgctataacatggataaaatttgaaaacattttgctaagtttaagaagccagatacaaaatgtcacatattgtatgattccatttacgtaaaaaatatgcagaataagcaaacagatttgcagttacctgcagctggatgaggggagtgaggagtgacaacttaataagtacagtttccctttggcatttttggggttccaaaatattttggaaatatacagtagtgatggttgcatggcactctgaatgtactaaatgccactgaatcgtagtctttaaaatggttaaaatgataaggtttatatcatatctattttaccacaatttttaaaaagttgacttaggttgtcctataaataaatttagtgatgattattctttatctattaataaaatctgatattgactagacctaagtagctggtaattcacactcagtacacatttatataatattaaataaatcattcttagatgttgcagattgaccccaaatgaaaatatcaattttgcggtggctcacacctgtaatcccagcactttgggacgccgaggcgggcggatcacgaggtcaggagatcgagaccatcctggctaacacggtgaaaccccgtctctactaaaaatacaaaaaattagccgggcatgatggcgggtacctgtagtcccatctacttgggaggctgaagcaggagagtggcgtgaacctgggaggcagatgttacagtgagccgagattgtgccactgcactccatcctgagcgacagagcaagactccgtctcaaaaaatatatatatatatcaattttggaggaaaggcatttaggttatagtcatttaattatctggctacccacatattttttcttgataagggattgtcccaaatagtgggatatagtaaagcactcaccaggatttgtaatggactgagagaacaggatctactaataatatgtacagctatatattagatctatcacaaatatattaattgcaattcatcaaaaagcaacagaagatgaatgagaagattagaggattttgccatctgtctgcctgggtaaaatcagttagtatttttgtgtgaactaagaggtttggacacaagctccttcttagttttctaaacatatctggcagcagatattacctctccaatttaaactttaacctagattttctatctctaaagtctcattatagataatgtagaaataacttttacaattaggtccatgccaggaaattgacaggcaaaagaaaggttaaactgaatgcttgtgcaatttaacagagcacttttgttatgttgtatgtaatgttgcaggggtggttaggggaaataaatttttcagtgtctatgacaatagttagcacacagacatttcaacaactcagaagaaaatttgaaattaagatttgagctagagcagtagaaataacatgaaaaacagatttgggaaacattttgtagttaaaaatcaatgagcttacctttgtttataaagataaaatccaaatcctgcaaatataagtgcaaaaaaaggcacaagaatagcaatggctacagaactactatttgtaccatgaggttgatttgaagaatttgaaccttctgacatattcagtcctacaaaataaaaaataaattataaatacacaactcttttatcataattaatttctactcccatgaatcaattaatttcttctattctcaagatatctacctggaaatcacatagtaaacaaaaataattcatgaaactccttcaactcatttcacatatgtttgcacagtgcctcttagaagatatttttccaggaaagggtacagacaaaaaaataggcagagccccgaactaaggagtttatacaatagtgggaagacatatggagtatataataagtgtgtatatcaagcatgaataaatggtcaatgtgctttagaaaggaaaggagtaattctggaggatatacaacataggcttggcttgaaaaatcatcatgaggctagaaatgggaaggtaagtggcttaggtagtggatgtgacaagcactgacatgaaataggagtgggaggttaaaagaataaactatggctagactctaaaagggaataaatatcattctgacgaactcaaacttttttttttctttttcttttctttttttcttttttcttgagacagggtctcactttgtcacccaggctgcagtgcagtggagtggtcgtggctgactgcagcctccacctccccggctcaagcgatcttcctgcctcagcctcccaagtagctgggactgcaggcacatgcaaccacacctggctaacttttgtattttttgtggagacagggtttcaccatgttgcccatgctggtcttgaactcctgaactcacgtgatccacatgcctaagcttcccaaaatgctgggattacaggcatgagtgatggcacccagccagagttactatccacctcagtgaggaacaactgaaggtgtttagaaataaaagacccagtgatatgacatgagatttagaacatagcggtagtaggatggacttcagggaatacagactggaatcaggtgtagttagaagattgtagtgacagccgagattaaaaaaaaaaaaaaaggaattaaaatttaaactagagaaataggaagtgcatgggacaatagatttgaggaagatttcataatgaaaattagcagaacttgtttatgtggatgtaagaggcaagaagacacaggattacaagtattctacttgaagctcagtaaatgccgatggcattcgcagagttaggaaataagaaaagccaagcttgtcgacacatttgcacaggaatgagggaaaaagaaataccagttctttcttaaaaggaaatagttccttttttgtgggttctgcttcagacttgtagtgtttgagacactttggagaatattacatgaaaatattcagcactaaattatacaactgtgtaaatgcactatgttaatgagtgtttttacctgtttttaagacaaacacaggtaggatgtgatgtaaatggcatcttattacttttcatgtagagaaagctaatttctctttttgacaaacagttacatttaactaaacctcatctttgtccaggttaaagaaaattagtatcttattttttaccttatttttcctgtgacttagtactgctatgtaaaagttcaaaattttttaaaaagttcatttttggctgggcatggtggctcacacctgtaatcccagcacttggggaggccaaggcgggcggatcacctgaggtcaggagtttgggacccacctggccaacatggtgaagccctgtctctactagaaatacatagccaggcatggtagctaattccagctaccatggtagtgtgcatggtggtctgtaatcccagctactcgggaggctgagacaggagaatcccttgaacctgggaggaggagtttgcagtgagccaagactgtgccattgcactccagcctgggtgacaagagcatgactctgtctcaaaaaagaaaaaaaaaaagttcatttcttaaaagataaatgtcaaataataatttttagagcctgaatttattctttgtgtatccctgtcacagtataataatgggagacagtggatcataggagaattatacaccaaaagctatgtgtataaacacattcttgccagaccattaaaggtttatatacatatagaagagttggaaataaaaatgacaaaattctttgcttcccactgcagaaaatttacatatttgaagagaaccaagtccccaaaaggggcccattcctcaaagttattttctctttccagactctgtgagtttctcagagtgtcactacattttcagaagaatgaaaactgcgacaatattcaaactgaagaaaagtagtacagttctcatgagatacaataaactaatttacagtttaatattttcttttttatctatatcactttttctcctttttatgtgcttaaaggcaagccagtttgtcatatttattagaaataccatgaaaatctaaacactgtacagagttggtacataaagatccagtattttgaagaatgtgattatttaaaagggctatcaaaggtatcaatgcatagttctggcagtacagaatttataatgcagtaagtgtacctaatgtacagaatccacagtcttttttttatgatgtctgggataataacagaagttcgtgaaaatcaaaatgaatacattacccagtctttgtaggccaaattgtccataatctttgccttgaataaatccttgaaatacataagtagctccatcaggctcagcagaaacctaaaaatatttaaacagccaaatatacttgaatactggccatagctatattttcccagccttaataaatacacaattttattctgaaagaaatattatcacaagttcctttcttctatatttttctcctttgcaaaatatagcacattgtgaaaattttccatcattaaaagcaaaagtaaattttctaatttgaaataattatgatatacaaaacagagattggttattaatgtatgatatagacatctgctgtcaataaaaagcaatgacatgaggaaatacagtgatcaattaaaaattaaaacataaaaatactgtacttagtaaattctattactgttccacatccccactctcccaaccttcatgagaagagtttactccctatctcatttagttgggcttggtcctgtgacttgcttgggcctatggagtgtggggattgggattgacaatagttaagttgcaagcctaggccttaagagccatacttcccatcacaccaagtggaagaagccagccacaaaaggccacatactatatgattccattcatatgaaagtcagaacagggaaatctatacagacagaaaataggttagtggttactcagagctgatttgagaatgtaaggcaggggttgatagctaaaggctgtggagtttctttacaacatgaagaaagtattgtagtctaggtgaggtggctcacgcctgtaattccaacactttggaaggccaaggagggcaaatcacttgaggtcaggaatatgagaccagcctagccaacatggtaaaacccccgtctctactaaaattacaaaaattagccaggggtggtggcatgtagctgtaatcccagctattcaggaggctgaggcaggagaatcgcttgaacctgggaggtagaggttgtagtgagctgagatcatgccactgcactccagcctgggcaacagagtgagactctgctcaaaaaaaatgaaagtattttataatcagctatgatgagggttacatatatgtgcacatatattaaaaaccactgaattggacatttttaaatgggtgaattgtaggatacgtgacttgtatctacattgagctgcaagaaaaaggcataggtcaatggatttgagcttatttgagaatcacagcttatttcagaaccacttgcccctctgagagttttggacttctgacaagagaagtacatgctctaggcagcaagtgccctttcagactctgccccaaaatgagatgatgagacatgaagacctggacttaataccacagcctcaagtagtgcctccacagctaacccattacaaatgagaaataactaaatacttattattgtttgacccagaggcttcatggctatgtctaatgttgccaatgctaaatactacatgcaccttacatttgtatacaatattatatttaaaaaatactttatatgcataatgtaatttgatcttataagtaaaataggaaatgttacatttcagcaattcctactactaagtagtaaagtgatatatcctgaagtttgtgttaattaatggcaattagttacctaagtcatgaacattatcataaaagttgtaagaatcttgagtcctcactctaaaaagcaaaggataccaaaccacccatgcaagtctgacatttcacaacaactgatttattctttattatcagacattatactctgggtatggccaccctaaaaaataaagtacttctaagaagaagctcaaactccatcattttaatgaatcaattcactttgtttcctacataaaataatacaattaaacaatctgagtgcattgaagatttgactcagttcccaactccatgaatacagaatgcagaaataggataaacactttttttcctcaggaaccaaacttattgaagcctactagatggtaggcttcttgaacttattgaaggcttattgaaacttatcgaaggctactacatagcagcctatgatccactacagtatcttctttcccattaagttttccttatgaaaaaaaggcttggtacttgagaggatacagtcagatctctcatgctgactcttcagcaaagactcctggcccttgtgttttccactgtcagtcttaacactccactcacataaatcacttaataggagtgactccatggtgaagctacagtaactatctccccataggaagcagctcacataagttccttttcatggactttatatataaaatagtctaaattcatgcttcaatataatgggagtatttaattttctgatgtactttgtaaatatgttgcatattccttaagtagtagtggttccaaagattgaattatattttatccagatttatttatcatagtgctgattgtagatggaatatatttgatgaaatcagtgaaaaactaaatgcagatcagcacacacacacacacatacacacacccacatccacccataccctcccccacacacacgtacaccccaccaccacacacacacacacacgacaaaagtaagcaaaacacatcagaatccagtattcctaggcttgtactttagaatactaaatatttatatttactaatatatatgtatgtgtatgtattcataattagctaaatttagaaaactctcctttcctggacaagctacaaatttatcattaaaatcagcagcagatgttaaaataactatacttacaaagccatccattgcccaattttcttccttcattttcttcacagaagcatgagcaggtactttaataagatatatgcgtaacattaggcgagcttcctggcttttatatacccctgtaaaatgcaaggacattttagtctacttaactttgtaaatagttatacttcattttattatctatcattccttaaatagattatgtaagatatgtaattaaaaaaagaaataaaacaagggcaagtcaaggatggcttaacctataatgctctttgcaaatcctgtaatatacattgatttatctgtcttctgaaatcctcaacttatttcttagttgtggggtttaaattacctatgctatcacaattaagcactagtgttcttaataacatcattccatgatattgaaaacaaaatgatttcttcccacaatcagattctaaaattttcaagcatacaaatccagtgttaaaattcctgatattttccttaataacaaattagttgccaactcagtgaaaaacagtattctaggtgctgcttgagccacaaagatgaatatatattgttcctgtttttaataatttccaacaaagtaggaggtataagtaaggtacacagctaaatcaaacacatgagagaatgtgataaattaaaagccagagagagatcatttcacactagaatgatcaaggaatagttatcaaggaaaagcactggagggccaagcatggtggctcatacctgtaatcccagcactttgggaagccaaggcggacagatggtctgaatccaaaagtatgagtttaggagttccagaccagcctaagcaacatggcaaaaccccatctttacaaaaaatactttaaaaaattagccagccatggtggcacgcacctgtagtcccagctgctcaggaggctgaggtgggaggatggcttgagcccaggagccggaggttgcagtgagccgagatggcaccactgcactccagactgggtgacagagcaagactctgcctcaaaaaaaacaaaaaacaaaaaacaaaaacaaaacaacaacaacaacaacaaaaaacagcatttgaactggttcttaaaaataaagtagaatttttagtttgggaaggtaaatacaagcaatgacataaggaagagaagcaaaaatatatacaatgatttttacatggtaagtgttctaagggtagctgtaagctggagggaaaaaattgtttagggaaataacagaaaataggatctaagaaaaaatctgattaactgttgtttaaaacttgactgtattcattcattctaacttaattgttcacctatgtaatagggcaccataatatgcaggaaatgaaaagataatgagacataggtgctaaggtaaattataatcaataggaggaagatataaaagtaatcgataatattgctgaaaaattgctacaattggtttatatggagacagtaagtgaaagcgaattaatctaattctttgtctttccatatatatagaaaactcttgagtttatctagattagaataagtatacatttattttgggctcttttatagaaaataaagaaaaactttgttaacacatcaaagttaaataaagcattagtcacaatttaaatgtatttgtctcattcatttaaagtttctttcgattaatataaggtaattatatgtatttttaaaattatactacatattaacttctaatatttttactttgtgtttaacggaggatcattcaataataagaatgacactcaaaattcattctaaaatttataaaatcaatgaatataattttattttcaattttttacagcacaaattatttcattattaatatttatatgggttatatctatacagacaagaattttacagtttatatttcatatttgcaatatcaaatatcatagtgtctcattttaaaaaatgagagcaattataattcaaatgcattaatttgaaaatatttattgaggcctattttgtttcagatgttctgctagcctctgggaatacaatattaagttggaaggcaaagagctttcttagaatttattttatattgttagaatatagacacataatgaataataaatataacaaatataatttcaaatattgtaaagaaaaaaacagggtaaggctgcctaaaactaagaatatgtctgacagcatttgtaatacaaagtttcctttaggtcaggtcattgggagtattgcttgaggaggtgacttgtgagagaatatctgagtgttaggaaaaccagtgcaatcaaagataatgagagatgtgtgtactggacacagaaaacagaaacttaagaagattgaccaggttttggttcccttatgcctatttaaacaagtgtagctctatctttatttgtcttaaatattggatgtccatctataaacatggtcatttgaagaaatagctttgtggccacagaatagttgagaaatcaatgatttggtctccgtggttttatgagaatagagaaagatttagttgtattcatacctaaattaaatgttatgatctaatatatgacatctaattctagctaccaaaaattatttaaataacttattttaaaactagttttatatttctgtagtaatattcattcatcaatccaaaaaccagaaaaccttggttctgagtgaatatgaatgtcatcaaaagcaaatgtatcaaaataaacatttcaccatataaaaagcattactaaaaatgatgaaatcataatagaaataaagtcatgaaggtatatttcgctgctgtttttattgcgatacctgaaagtagcagctccatgttgctattgctcagtgttgcgttaactctcccagtggaagcattgaaactagtaactgttaaggtcatgggttgtttccttcctttgaaattgtaagagcctttccatatataattttgggcaaatacatcatcaggaactgtgaatagattaaatataccacacattaattttacaatgccatataaatataagcattaaatagagtattagtttattgaataatgatgtattgctaatacacaataatgttgaatgtgtgttacaaaattaattcttcatataaaaatgtttccattttttagaataaatccacattgtaataatctagatttgttcatatgttatcgagaagagagaaatagaaaacaccagttaaagatattaggtttatttttagaacccaggtaaatataaacttcacttatctttggtcttttatgcaatatatttctttctgaaggaaaataaaatgatttcacagcaccatggcagtaaaactatacccaagtcccaagaggcctgctttttttccagcagtgggaatagatttttaagaggaatagcaaagagaaaggtcctgcaaaattatcatgagacagtgcttctgtgttcccccttacagaatactgagtttagttcttctaataacaggtgctcctgaagaagaacagggctgcaccatattgatagctttgaggtatacaggtatttttagaaattgtcactagtattgttggactctcaaggatgagagatgaattgtggtagaatcaaagaacattctaaagcttataaaattttcatctaaagaaaaaacactattttagatactagccaaaaagacttattgtatttatataaattatttatgtaatttaaagttatataaattggttatgtcaaagtctacacagctcctgggcagcagctgagagaagctgaggtataggattaatcctatacctcacagcacagcacatccctagaaatcagctattcaaggtacccaaccctctttggatgaatgactgaatgaagtggatttaggaaaaagtccttttttttaatttgtctaacaagttattgatgatttttcatctgatatatgcatgtatcacacttcttaccagtcagatcacagggattgccatgacaagctgtgtattccctgaattctattaaaccaagaaagcaaaaccactgtggcagatcagcataaaaataccctaagagttgagtttttactgaatatttcagtaacaactaaaatttctatttccatgataatttataagcaatatagctccttactttgataccactgccaacttccattcttatcactttggagtaatgtaatcactgtgtctcattcatgattttaaatgaaatactgctgaatgttttctcatataacatgctatttgccatataatttttataaataattttactaaaatttagagtttgttaagaatttttaaaaattataaatttttaaatttataatttaaaaattataagtgttgaatttgatcaaatactttctttgcaaatattgcaattatcataattttttgcactttaatctcttaatgtgatacattacttttaaggattatttaaaactaaaacatccctgcatagctatgaagaatccagattggttctgatgggtgttaaagcaaactaaatatggcctgagaaggactccatagttctatatttgagtccttgtaatgaacttcaatctaacttaataggtagacaagattgaaaacctaattcaggagtatgcacctgtaacaatagctgagccttggccaatcccagcagctgtacttctactactcgtacactgctgagtgttcaaaatgtgttcaaataaggcaaacacagaactgtaaccaatctagttgtttctgtctctcccttctgatttctgtacgtcacttccctttctttgtgtataaatttgttctgaccatgaggcatccctggagtctctctgaatctgctgtgattctggggtctgcttgattcacaaattgttcattgttcaattaaactcctttaaatttaattcagctaaacttttccttttcgcatgggttatctttactacaatgttgaatttgatttgctaagattttatgtaagattttctcatttataatcctgagtcaaatgggcctgaaatttttctccctttataatatctttatccgagttattagagctatgttgagcctagagaatgaattttattgtccagaagagtttttataaaacttgaaagatccattctgttcctttaaaatgtggtggaacttaccagtagggccacatagacctcattttctttgtggaaataattttaaccagttctttatttgctataaaattattcacattttcttttattagttctagtaagatgtagtgttctagtaatttgtctgctctgtgtaaatgtttttaaatgttgataattattgatagttttcccttaacatattttgaatttcattaatctactctctatgtagttatgctcacattttctttgttatcttatttttaccagaaatttttctactttgtttctgaaaagaacgacatttggttctgttgagattcttctactgttttgggcggttgcctgtttttattattacattgatttctgccctgctactctgttacagtcttaatattctcttaatagggacacaactaattaattctgaggcttttcttttcaataatgtaaggatttaaggctacaaatttccctcttaactttccttttcttatagccctcaagctttgatatttcaatttttcaaaataactacattctaatatatttctgtgttgatgtcttctttaattcatgagttatttattattactaattttgctctgaatttccaaacatacaggaatgttttaaattacatatttcctcattgaactttaatcacatcctagtcagatatgagctatgaagactaactttgcgttttaaaatttgtttaatttaatttattatttaatatatgagcaatttttttacagatttgatgtgctggagctattattcagagtttccacctggtcccaaatcaagcatttcccttggaaaatttggggcattgatggacaattatggttttctgactccattgcaaacaaactctgccttacttttatgtattctttgattgcctcaatggcattcagcatgttttcgacaagtgttgaatgtatcagtataagtcacagagcttggtggtccctccacttttatagcatgtacatggagcacttctaaacctcactaaaattagatcctaatgtagttcttggcccaatacaactgagagaaatctgtttccaaggtgaagatcagatattatgctcttattggcagcttttaaatagtatcacataaacaaaatactaatactgaataagcatgatatggtttggctctgtgtccccacccaaatctcaacttgaattgtactcccataattcccacatgttgtaggaggaatctggtgggagataattgaatcatggatactgttctcttggtagtaaataagtctcacaagatctggtggttttatcaggggcttctgcttttgcatcttcctcattatctctttgcccgctcgcatccatgtaagacaggacttgctcctacttgtcttcctccatgatagtgaggcttccccagccatgtggaactgtaagtccacttaaacctctttctttttaaattgcctagtcttgggtatatctttatcaggagtgtgaaaacgaactaatacaaagcaattcatatattgagcccttactatgggctacgcactctgcacttcatttgcatgaagcttattatataattatttaattattatttcttttggatagaaaaagatatggagattcagatatataaaataatttttccaaggtcacaagtcagagagtatataaaatgagatacatcaaggttgtagggctttaaagtttatgtttttattgattgtgctaggttttctaatttgctttttaaatcaaataactgaaaataaactagtcaatttctagaagttaccgatctttattctcataccaagtgtatttggatccttttaaaaacatatacatttaaaaatgttaaataagacctcatttttattttaatattttaaatgacagtattgccattatgctatagtcatttacagatactcttcaagggaaattttaatatttttagcagacggaactatgaacaatacttttggaatactaacatgtcactgtattacattgctttaaattcaacatcttgtgaattatcaaattcaagacagtcatagttttttatacttaaatatattttttaaatacacagttactatgccaagaaaatagtagaccatttttagaaataatgaactctagaaaaacaaatgacattactaaccacttagctttgggctgggtgttcccagtgcaggtctaggatctttcaccaatattttagaaccagctatgaaaagaaataaaggtgtttacaaaagttgatgcaattaattacatacacatgcgcacacacacacacgcacacacacacacagtgtgatgcactgtccattttattctctgacatttcacatagatagttttctctaaaatgttccgttcatcacaacatctcagtcccctactcagcactcgttatgcaactaatgatttcaataattattcccattacagtctattggcacaaggggcagatttgtgttgctttatcatcttgggatgtcatttcttattttagaggcataagccaaagtggagacagttgcctccaacatggaagctgagagctgagagttgtttttgttgacagaaagcaaaaactatttgggtagggtttacatttaaaaatcaaagtttgttgagataattaaagatgtcaccagaaattggatagacttaaaggtgaaatcttccaggttttaaaccaaaaccaaaggtagtccaaaaccaaataaatcatgtaggatgtagaagtgactggaatattataggagctatgacatgaatgccttgtaaactatgtatcctaagaacaatgtaatgtcttaaaagactgtaaagggatgtgatttcggcaaatgttgctctggctgcaaaaccaagaaaactttggaaagcagcaagtacggatatggctagagaagttgagagacactgcagtagtcccagtagagataatactgagttagagtatgatagcagtgacaataaaccaaaaaggggaacagacgaaaaagctattgaaattgtggtgacttggagggataggaaaatatctaaggagattactagatctcatgtgtaactataggatggtaatatcactgagatagggaataccaaagggaaactatatagataaaagaaatgtatgagtttagttttgcatgtattgagtactgaaatgccactgaagaatttcactagagatatcaagcaaacaattgaatatgtaagtgtgaagctaaaataagataaataagccagaaatattagtttgtaagtaatctacataaggacagctgttgaagccactggtttgaatgacatcacctaaaagtgaatacgagatgaaaacaagagatggctaagtactgcatctttagaaaatcataagtagaaaacaatcagtgtataaaggaaatggagaatggatacttagaattaggagggagtaaaacatttactcattcaacaaatatttattgaatgcttttcacatgtaaggtactgatttgtgttaaaattacagttgtaaacactttgagtgaagtctctcatgagattatattctagttgaagaggggtagataggaggacaggagagtggaagcagataattacaagcaaacaaaccaaagaataagatcttctcatactacagcgatttcaatcataaaaaaaaaatagaaagaaaaatagcagaggaatgttctgataaagaaaatgaaaacatttcaagtaaaagaaagtaattgtcatttatgacagctgcattagataaaacattaggtcttacaaataggttttttggatataaggaaatggattttgttgatgaccttaccaaaaacactagaaaaagttcctttactccttcttctggcattataacccttttccaaatggaaattgtcctgaccgagcagcaatcggtggacacttcacccagatctggtccaaatattaataccatatcaccctggctgagtaatggatttggagatgggatccattcaaaattgtggcaaatagaatcccagatagtgctttcctgaccaaaactttgggaaggactctttctactagggttactctggcagagtaatctaggcattagggtagcaattctccgtactctaatgaatagtgtacccacataatttatgttcacctggtacctctatgaccttatttggaaagaaggtctttgcaaatgtaattaactagagatcttgggataaaacaatcctgattttaggctgaaccccaaatacaaggactggtatcctcataagaagaggagaggccacacaaagatacacagaaaagaaggccatattgaaatggggtagaaattggagtaaggctaggagccaatgaatacccagggttgtcagaagctatgagaagataggaagaggcaaagaatggtttctgcttagagcttacagagggcacaaggtcctgctgacaccttaattttggacttctggacttcagaattgtgaaggaataaattcctattatgttaagccgcccagcctatggtactttgttataaaagccctagaaaaataatatacctacctgaagagagaatttgaagatagaattaaggcaagaagtaacattctcatgggaaaaaagctatgaatagactcataaaatttatatgcctctggatccagaagtgtttacattactcctagacttggagttagccaacaaatttcccttgttcctatgctaatttgagttgagtttttgtctggagcaaaggaaagcaatagtgcaatctcttgtgttaaaaagattctatagagaaaacttaccttcacaaatgggaacttttccagtccaggtgttatcggatctacacactctatgttctgttccacctgctaagaagaagccaggctgacaggtataaatcagtgtatacccatgagatggaaggtccatccctacgacatttgcatgagcaggagtttctggctgtttacagctgtgggctatattaagaaaagagaacaatgtaaattttctatagatatgttaagaaaaatttgagacaggagtcacaatatatttcagatatacttcaatgcctttatatacatatatcttagaataattattctaataaatcacaaaaatgtttcaatgcaaatatacttattgatttcatactttagcatttcctaatccaccatttgtggaacactagtagatgttaatagatgttaaataaattgagaaaaaaaaagacattgtcaacaactaagctcagaaatgtatgctttaccattttagagagtcacacattccagagagtcacaaaaaccagcattttaaaggatctgtgaagttctgtggtaagataccttttaatgtttgtcaagctcaggttttctatatgagtttagaaaatattattttataaattttaaatgtattatatttattttaaattaaaaatctattttctattgttaaataaaaccacagctaattatattgctctggtattaatacttcccaataaaagtacattttaataatttttttacatatggaattttcaggccatatttggatccatatgctagaagtatcattttgttcacctaactctctctccttttctccatgtttccttccactcctaattctctaccttgattacaccatatcttccccttatttcatcggttttatgtcttataaagaccattcctttctccgtcagagataaatgctacaagaaatttttcccctgaaacagatagcattttttaattatttgttcatagatatacatccataaaagtgatctctgaaaaaagtgttctgtggataaataaaaaaaaacaatatttttcatttgtttcttaatggaggtccataacagtataaataatagctaacatttttttactccgtgtgctaaacattgtgttaaatggttttttgtttttgattttgttgtttttgagataagagtttcactccgctgcccaggctggagcacagtgtcataatctcagttcactgcagcctccacctccggggttcaagcgattctcctgcctcagactcctgaggagctgggactacaggcacctgccaccacacccagctaattttttatatttttaatagagatgggtttcgccatggtgaccaggctggtctcgaactcctgacctcaagtgatctgcccacctcggcctcccaaagtgctaggattataggcgtgagccaccgtgcctggcctaaatggtttatatttaatatattgcagttagtgaaatgtaatcctcatgcagtaagtattgataaggaaaactacagtctgtctctactgccatcttaagccctatgttatggacacattagaaactttgagatgcttcacagtgacagacgctgtttaactttatttaaactatcatatcccaactagaggacatcaaagaacaatggtttactgtgaaatacctagttacagcccgcacagctgttttaaagtacacattctgaggaattctcctttaaggaattttccatatttaaatataagccaacaaggcacataacatggcatctctgtggagtgttctcctgctttaaagtaagctgctggtccctaggtgcccccacaatcatttggatggttctgaacagggatagagtaaattcacagggcttgtgtatgcttcagcaaatcctaaaagctagataccatcctaataagtgtttccactccagcttacttttttccatttttcaccaagaaacacaattgaaaagataagggaagagatttttttaaaaggcaactggagagaaagaaaagccaaatagctgaccagctagaattcatttctaattgtatgtcagaaaaagttatttagtggccccaggctttgttcttatttaatctgtatagcaagtgctctccactgaggatcagagaacatataaaggaaattctaaaattgttctcaaatttttggccaagtgcccatgaatatttcctttcatagatgttgttagtttccccagattctcagataatattttcacaagcgatttttaaaaattagaagctgttagattggttcctcgggtattttagattacttcagactgatagatgcagatctataaactaaaacctaatcattacctaaaattaccaggtggcaaaactaaacataaggtctttacaaaaagaacaaaattgtgccttgtgctttctgacttacttagagagtgcttcccaatggccatgggtttatgatacagtaataaaattatatgcatataatatgttttataatctaaaagtcaatttgatacacatatagatgtaaatgtatttgaatacttgggagaaaaaatgcatataaattcttacccatgatagcattatttcttatccataatacttacgtatgcattcaggctgaatcccactccacgtaagatcagggaggcaggtgcgtgttgtagacccttggagaaggtgtccttttttgcaatggaactgtacaacacttcctacctatagcaaattaaagagaggaaaaaaatattcccctacaacttcaaatatggcaacaaacagagcttgagtgagaaaatgttatcaagtgaaattccgtatggtaaagttggaagaaaaaaataattgaaatctgatttaaaataaaatgggaaaaattcaaaactaaaaaataaaatcctggctttatttgtttacatatcatcatcaaatagttgggtccttagtacatacatagaaaccaagcttttttgccatgggaatttgaagaaaatatttaagacaccaaaaaatccaacaagctacatatgaatacaagatagagagatagatagttagataaagataaataaatgaagcttgataaaaatatatatggaaataaatatagctaaccacataagaaacaaataaatattgaaggtgaaaaatgcaatatgagattagagacaaaggtggttactgaaggtggtggtgataacggaaatatacaatggaagatatactgtttgtactagcttttaagggtatagtaattaggagaatatctaggacaatggctttcaaagtgtagtctctaggccagtaatatcaatgtctcctaggaatttgttaaaaatgtcagttctgaggccttaccccagacacactgaatcagaaactgttaggttagaaaaaccaataatctgttttaacaagccctttgggtggtggtaataaacactaaagtttgcaaaagacttacagaaaaatggaaaagataataacatgatgagaaatgtatgttggttacaatatatatcatttgctttaggggaaaacagtatattagattgattggcatttattgtttacaaagtgagcagggtaggtagaggtttgggataagtgggaagcaggggtatatagtaaacaagaaaacaaatcaccagagtaatgtacatgtagttttaattctggatctcactttacttgaataagtcatatctcctatctcctctttgagacctaatttatcatttataaataatgatgataatattatttgtattgaaatctgttttaaggattaaatgaaatagaatttatactccactccaccccaggatgacactcaagttttaaataaattataggcatgatgactaaattggagacataagtaagaattagtttccgaagggtctcaaatggcaggatatggtatttagaagaatagtagtaattctaattatgaggctggcactgccattttacatttgagtggataaaaactgtactaacttgtggcagtaagcctggggaaaaaagtcatttcctcaaaacaatcacaagaaaaaaatcaacaagatttattggatgattagaggtggaggatgagataagggatatttagggtctgccactttgtacttctccagcaattgcagtctgagaaggctcaatcacagttttaggacttatcactcagatccttttttctgccttccccttaattcctaccccctcttgagcggacaataagaagctaagcttaagatgatataatttgataccaagattccatttgaaacttcagactctgaattccaccatttttcatattgttattattacccagaactatactaggccagaaatactaaattccaaaattctttatctgacaacaaccttttttctttatgttatctcatgctgtgtcttccatgaaccctcacctttgcctctagaagatctcttatccctggatgccccattttctctaggctgttacatggattgattccaagaagcaccatttgcattttattccttaaaaccagagtcccctgacttgtgctccagagcacgcctttcacattctttctgaagttgtgcaaaatggtggtacaggttttgatttttcagtatgggctagattatgttatatacagtttgcagttctattcttcagtcaaaccagttctacaaaatccatcatctctatcaatccagcaatccttcttaaggttagaacccagttaatagtgtcacttgtcactaataaattttcccttcattcacttcaccaccaaaactggcaattttaccttctaaatccttttcaaagtatcgtcttccttttttctccagtttacatccagttttactccccaatatcttttccataggctttggttctcactttagcagacatcacaatcaccaaaaggactttatgaaaacagtgatagctgagtacccccctccagagtttcgtactcagtggatctggggtaggtccatgaatctatatttccaacaagttcccaggtgaaactgctgctgccggttaggcgctacactttgagaactacacaatagacaattataataatcttctaatttgtctccatttctcacttcatgatccactatatttattttctgccttaaagtcagagtgatctatgcaacacgaaagtttgaccttattattcacccattaggataaagttacattgagctaacatgacaaaggcctccataactgagaatctatctagcatcatcattaacagcttactttactcaaattctgttcaattaacattgaacttttgtatcctgaaatgcatgcatattttcatgctattcctactgcatggaatgcctctcccaactttcctttcctagctcttacactaaaagaattagctcagccatcatctgtagaaacccttccctgcagcaagaaattagaaaaaccatctctgttagaaatgttagcctttctaggccggagactgtgtgtactcatccttgtgcaccttgagcttaaaaatgtgatttgaaaatgttggagcaatggaaggaatggggacaaaataatataaaattacttgattacttaactttagaatatttaacgtctatcagttcttaaaatgcagtgatatcatctctatactttagataatgtaaggttagatcattctgtttttttctttgaagggtatatttgggttatttcatcaaacctttatattggtcaggtataagaaatatgttggactacatacactttgtttttacttgtaagacatttttcttcaatcctgtaagcttttcaaaatcattataacaactgctttaaatattaaccaaatattatagaattaaaataaaatctgttttaatatttttctgtgtatcaccaacacatctaataagatttttgtcaaattcacaaatacttatacctaatatctaataaatatttatagatttaataattggttaaattgtttatccagaacttgttatagtcaaatcaacaaaattttctctaaatatcagtgcattaataaataattttgtcagtgatgaacccacttaatagtgtattttaaatagttctttatcctttcccaatttgatatatccttctgactgaacaacttccaacatgcatagtataatttgcttatttgtagaaaaataggcaacaacattctaaaaatttatattatcaaattcaaaaaattcttggaaaaataacttatgtacaattttttcaccaatatttacgaataaaaagtattatttgtatatcaaacattgcaataattaatattgaaagtttttataacaagaattaaaaacaatccatatcaaattttaattgcaaccaatgtttaaataaaaatcactttaaattgatttaaagtaccatgttgtgtataaatgcattatagaattttaagacatgtttaatcagtaaacatcacttatgttctttaacaccttattctcctattttaaatgttatatcttagttcctaaatcataaaatttatatagcaaataatataatagacattttgtatacattttgaacattctcagtaagctctattttcccttccatgagatttcatggcaaataacacttggcatgctagaattttcatcaatgcatttatttgaatctgacttctaatatcacatgtttgtttaactggagtatccagcatgggtcttaagaactttcaaaatttatttattattaaggtctcaaaaacgtatatgcttcttttgcaatatatatttttaaaaataaatttacgtttttcattatgtatttatacaaaacattttactcaagaaaaattgaggtagcttctaataaaagatatatgtaaattaaaataaataaaattgacacagaaaggcaagatcataaaaaatgaaggtataacagatgtgcttcagatgcaagtaatttatgctgactgagcattaactttggtcctaggcttcctggttcaagaaaagtttaattattattatttatattcaaaacaagaagattttaattgaaagtaatttttttttactttcagaattcatgccactgtatttatcatttaaggtaataaaacactatgaaacatatatttacctcattcaatatactaagatactaatttcaattacaaactgaaaatcatatataatcactatggttagtttggtagggttaaatattttatggttaaatatcttgaggctaaatatctaaagagccggattaaaaacttttcatatttataataactttatgtaacaagccctaaatccaaataatgtactttccattgcccagagctcagtttaacaagtgatacagcagtgtgtatgtgtgcttgtcatttactccatggttaatcctgatgttgcatcaattattttgacagctattctcttcactatcaatttttagtaaaattattccaatttacaatattttaatacaaagacaaattatgttgaatacttttttcaatgatagagttttcatcatctctagcaatgagtaatatattttgtatgttaataattattgatgtcccaaaatctactatataaatctataaagaaaaagagagtgaacaaatgaacacattaaagagaaaattaagaaaatgatctgagtgcctctgtagttcataactttctcttgctcttcccaaaaatgggcttcctaacagctgtgattttgcgtcataactcactaccggccacctaatgaaaccaacataaatacgaaagttgggacattctgattctccttggaaatctggaattgagattgagatgatcactttctgtatgtagctgagatgtaaatagaaatgattcactcttggccatatggccaatctgcggagagaaaatatgaagtagataaacagaaagtagtataaaaaactgagtacttgaagccagtacctacactctgggtttgatgagtctcacatggattctttctttgggagtctggacatacctgcacagtaatgcctttaggctttaagtagctccaaacagtttttttgttacttgcaagcaatcgtttttctcaatggctcaagatgccttttgcatataaaaccatattcatttggaattcatcaataaattagtattaattagaattatataactatttattgtgttagatctatacagatttagttaacagatttagtatgtgtgtgtgtatatatatatatatatatatatatatatacacattcatacctgccatatgcatgtaagaaagccaatctccctaatgtaagacacaaaatacatttaattttaatagatagttatataattgtatataagtagactttaccatatttggaatctagtctatttatatttattcatatagaatataatgatttaatacctgtttattaccccaaataacataaattcagggttaggttaactttgttacagcatttttcaatgattataatagaatccttagaaagcagagttagtgattctcttcattttgttggatgactgttttaaactccacgttaatcattctcatttccaatatctcaaataatatttactaaaaaaactcatattctttagaaaatcagcctgatttagtacaccgacactaacatcacaattttgtattctgttagaatatgtcaccaacttgatctgcgaacaaagcaagtcacattctgtttcagtttctttgtacatatgatgaggactagtgctgtgcagctagttgcccatttttcaggatttagatcaattgataaaaccttttatggagatattaatctaaagttctctaaaaacaccaatataatggagacagactcatttttacacttttgtattatctggaacaggactgaaggaaatcagaagaattggaaatgctatcaaatcaatgttcatactgtgcctgaactgtagataaatggaaactatttttaataacaaaatatggccctttagatgagcccttcctttagaaatggatggtcttcaggttcacgctgaatttcacacagaatagcacaatttacaaaacccggcaacacagggcaattgggtaatgtgtaaattggctacttctgtttggaatcagtatgcactttggctccccttggatcttttgtaactgaaaagttgctgaatctctacctaaaatctaaattggaaaaagagagaacaagaaagtcagccacacatgactgggcatgccaaagaattctaatgtaacaattcaactatgtgttgtatagcaacaggttctggttatttttcagcaatttcccaccattttaaacactgacagcaaggtcatatatacaattagtgctttattgaataacccgcatttttatatatttgctgtttgtctcagaagtctctcctttaaactcttttatctttacttttcttcactgtccccatatcttcctgtagagtttactcatttactccctcactcttactgtcttatatataactctctaatgcttatggatttttcctatgctcactgctattttttgctttttgttttaatttatttttatgttccagttaggaaattttattaaaaaaatttttttttctaatttcctttacttccactcttttgctgtctgttaccctttttatgtgtttataaatgcagatagaacatgactttttgttatgtcaacaagattatatgcatatgaaccaaagacgcattctgacctagtatgatgctaaatggacatagctaaagtacccacttgaaatccgaatgtattgttctgagatccatgccgaggcacacctgggttttcacaagaggtttgggtaggctctaaaatgaagattaaaaagatattagtcctttaaaatttacaatagatatagttctctcacagaaaacaattttaaataatctggggtttggtacaaaggatctaggaaataataaataatgtaaatgtaataacatctctccatggacagaagcctgttaatcttgaagcaagaaagtcaggtagactccatttgatatgaattatgaaattcttgaactttgaacccttccgatataaaagcacttgacattcaactagctctgtggatgtaaaattaaggaaagataaaggatatgaaagcagtgtacatgcatataacatttgtccaaagaccttgctaaactatgatttggggtagggtaatatttctttgaagaaataacagttttttcccagaaacaggacttgataatttggattttactgacacccataggatattcaggcataataatggtaggtagatgtgtcggtttatttgaatgacagattatttggttagtttaccaaatatggcattaattttaggattacagaaatatagttacaatcattttgaaatcaatataacttttagatatttttggagcaaatctaatttcatatgaagattctttattaactataaaaatctaagtaaaatgttagtacttaataatgtcactacctgaaagtatttttatttttcattttactgatatacaacaaaattctttcaagtgtttcttctggaagtttaaagtgctaaaattaatgttgtattttctaccaatattcatttccagtgccttctaattgcttctatattttacacttgtttttatattaagccaactataggttataggataaagaaaaccattaaatgtcacccctattaattacacagttactgtgcataatcagcctttaattaatattacctatgcagtgaggtgatgaaccactccaagtgccatctgcttgacatattctggtgcttgatcccactaatatgaaaggaaaattgcagctgaatgaaacctctgactggtatataaagcttttgccttctctttttccttgggcaggtataccagggtcaccacaaaactttgctggaaatgaaaagaaagacgcttatatcaaagatttagtatacagcagagtacacagtttggaaaaatggtgacaatcaatttgaatattgtactaaagagatatattattcatgataaagctatcccaatgaaaaaatttattttttagcttatgtgcagataaatactgaattgaaaactcagtataatatttaaaaattagctcgatttcgatgttttccacttagtaagctaccttaataaagaaagaatttttgtacttttgtcgttttgtattgaccaaaatcaaaccacatatttggacttgttggctgccaaggtggagtatagccttgaaaaagtaggtgactcataggtgtccctgtcaaaaagaagcaacccataatgttccaggctgcacgctacagattgcagtgcccttttacatgtatataaaaagctctggttatttgttttattgtaccctgtatactttgaatactcgaagcacatatcccagaaacttattgccttcctctccaaaatactgtcggtatttttaaagcattttttaaaagaaaagaaggccatcagaatctaaatctacgcaaaactatggaatgtcaatgttctacaacaagcactggaaagatcaacgtgacaggctttctaaaaattttgattagattattccattcaacttacatttattaattactaaagaaaaacattattctaggtggtttggggcacttgaacatgtcagtaaacaaatactgtaggaaatctgcttttatagggtttatgcatttgtgagggaagtgaacaaacaataaacataattagcaagtttaagaaaaggtagtatgtgaaaaagtggtaagtcccgtgggaaaaaaaaaatcattcagacaaaagagatcaagcctgtatgtatgtgtggtggtgtgtgttaggaggtgggagaagatcttaaataaggtggcaaaggtgtctctcactgagaaaagattcagggaaacaaaatacttagccatgatgaagtcctaaggaagggcattctaggtagagtaaacagcactgccaaagccttctgctggggcatggctagctttctagaggaagattaggaggcctgtgtggctggagcagagtgagcatgaagaagtgtaatggggaatgaaagcaaatgatttcaaatatatcagacaacacaggcaaatgcacctttatcaaatgctttcaatgtttttattgtggcaaagaaaatacataacatataatttataaatttaacgattttcaaatgtactcgattttcaaatgttcagattaagcacctgaaagcttacttccctctgaagcaaacaaacagcaacaacaaaatggttttaagtataaatgttgccttaggaggattataggttgggtgtccataaaatgcatcatccaaactgagaaacttttgagagtgaaaggggatcctaaatgtacaagagatcgaccacaacaatgggaataaacttggcatgcccgagccatctggaacgcatgtataccttaattatagactaccataatcttggccttaatgtccaaataaaaccttccctgaaattcaagactacacgataaacttggatttttaaacctccttttagtagcatttaaaacttttaaaaaataattaaaatgaaaagtaatcattaacagctatttataacaaacccacagccaatatcatactgaatgggcaaaaactggaagcattccctttgaaaactggcacaagacaaggatgctctctctcaccactcccattcaaccaaatgctggctaaatataaaaacaagtattggaagttctgtccagagtgatcaggcaagataaataaataagggtattcaaataggaagacaggaagtcaaattgtctctgtttgcagatgatgtgattgtatatttagaaaaccccaccatctcagcccaaaatctccttaagctgataagcaacttcagcaaagtctcaggatacaaaatcaatgtgtaagaatcacaaggattcctatacaccaatgatagacaaacagagagtcaaataatgagtgaactcccattcacaattgctacaaagacaacataatacctaggaatagaacttacaagggatgtgaaggacctcttcaagaagaactacaaaccactgctcaaggaaatcagagaggacacaaataaatggaaaaacatttcatgctcatggataggaagaattaatattgtaaaaatggccatacttcccaaagtaatttacagattcaatgctatccccatcaagctaccactgactttcttcacagaattggaaaaactactttaaacttcaaatgaaattagaaaagagcctgcatagccaagataatcctaagcaagaagaacaaaactggaggcatcacgctacctgacttcaaactatactacaaggctacagtaaccaaaacagcatgttactgctaccaaaacagatatatagaccaatggaacagaacagaggcctcagaaataacaccacacatctacaaccatccaatctttgacaaacctgacaaaaacaagcaatagggaaaggattcgctatttaataaacggtgttgggaaaactggtgagccatacgcagaaaactgaaactgtaccccttccttataccttatacaaaaattaacttgagatacattaaagatttaaatgtaagacctaaaacataaaaatcctacaagaaaacctagacaataccaatcaggacataggcatcggcaaagacttcatgtctaaaacaccaaaagcaatggcaacaaaagccaaatttgacaaatgggatctaattaaactgaaaagcttctgcacagtaaaataaactatcatcagagtgaacagacaacctagagaatgggagaaaatttttgcaatctattcatatgacaaagggctaatatccagaatctacaaataacttaaacaaatttacaagaaaaaaccaaccccatcaaaaagtggacaaaggatatgaacatatacttttccaaagaagacatttatgcagccaacaaacacacggagaaaagctcatcatcactggtcattagagaaatgcaactcaaaaccacaatgagataccatctcatgccagttagaatggtgatcattaaaaagtcaggaaacaatagatgccggagaggatgtggagaaataggaacgcttttacactgttggtgggaatgtaaattagttcaaccactgtggaagacagtgtggcgattcctcaagcatctagaactagaaataccatttgatggcctggcacagtggctcacgcctgtaatcccagcactttgggaggccaaggcgggcggatcacaacgtcaggagatcgagaccatcctggctgacacggtgaaaccccatctctactaaaaatacaaaaacttagctgggtgtggtggcgggtgcctgtagtcccagctactcagaaggccgaggcaggagaatggcgagaacccgggaggcggagcttgcagtgagccgagatcgtgccactgcactccagcctgggctacagagcgagaatctatctcccaaaaaaaaaagaaaaaaagaaatatcatttgacccagcaatcccattactgggtatatacccaaaggattataaatcattctactataaagacacaggcagacggatgtgaatagcactattcacaacagtaaagacttggaaccaacccaaatgtctatcaatgatagactggattaagaaaatgtggcatatatacaccatggaatactatgcagccataaaaaaggatgagttattgtcctttgcagggacatggatgaagttggaaaccaccattctcagcaaactaacacaagaacagaaaaccaaacacagcatattctcactcataagtgggagtagaacaatgagaacacagggacacagggaggggaacatcacacactggggcctgtcagggggtgagggtctaggggaggcacagcattaggaaaaatacctaacgtaggtgacaggttgatgagtgcagcaaaccaccatggcatgtgtatacctatgtaacaaaactgcacgttcttcacctgtaccccagaacttaaagtataataataaataaataaatattaaaatgaaatcggaaaccagagtaaagtaacacaagtataataatagcacaaaaaacattggtttactgtgtttaaattttcactatctcttggatattgtaaaactttgggctagttgacattcaagtccttctggcaatgctgtataatatcaaacccaaaagccagggacactgtcttattaatctttgtatattcagtacattttgaattaatacatgcttcccagtgaacatcatcaatgggcacttcagctgaagcaattgtttctataactaacttattgcctaacctacttctgaagtgttcctcttatgcatattcaaataaaggagggagacttaaccacctaaactcctcaatcccccagtaccctctctgtgtgtcattccatctatttctatccgtgaattttcatgtataaaccaaacaacctattgatatcaggtttagagacttaagacacagaatttcttgtcaaatggctttaattcataaagacataaacttttaagatgagaaaacatactttaagcaaaattaaagagaaaaaagcattcctctttataaagtccctaacattaatggatttgcatacccaatggataaggccatcatttcttaagtataccttctctgaacttcaatccatactctgccattttctagcggtatgaccttaggccttatgacaatgtagctgcttccctaaatgatggcagagtaacactgtgcccttgcaatttgattttcccttctgagtttaagtgtcattgtctattaaaatgtcatgactaatcctacgtacccaggagctctattatgtgtagtagaaatgatatacgtaaagcaactgagacaaagatagcgttattacatttgaaatgtaaatacatattttattactatttgtatttcaatagaaccaaaaacaaaacaccatatcaagataacttcttgattgtaatttttttttcagttatatcaaacaaacaagcaaacctgccatatactcatctttgtaaaacctacttgaccctatctgtcctggagaagacctggagtatctagtactattcagaacatagtgatgtttgctaagatgacctcctccatgagtcagaattttaagggcgaattacgtgacaaaaacattgaggcactggaacagacttcctccaaaattagagactcaggtagaagggtgggaggagtagtgagggatgagaaattacttaatgagaacagtatatactatttgggtgatagttacactaaaagcctggacttctccactactcaatatatctatggaataaaactacacttgtaccccttaaatttataaagttatttttaaaaatcatattacagtacctagaaggagctcctttggatgttatatgaactgcagtctagaccactactgtaataataagttagttttatctctcatgctcaatctaacttgttaatatctctctgaagcaaatgtactattagtgacctgatgagcaagcaaaatagccatatgcatgcccagtatttgccatcacttaataggaagcttctcaagtaaataatgccaaagtgcacctaatagtttgtcttcagttagtcatcataattctatgtctataaaatatatatttattttatactaacatatatctgtttcatttttaaaataggtctataaaatacataacttgcattaaattataaaatgactatccatgaacctaacactcaactttaacaattgataattgccaatactgttgcaaatctttgtaggcatcacccagaaagcatcccttttcttaggcccagggtagcatactttgtgtcatcctaaattctgggtttctcatttctatacatttattggtaatttacattcacgtgtatgcatgtgtgtgtgtgtgtgcatatggcatatatgtatgtgtgtgtgtgtaaatataggcactattattttactgctaaaaagaatgctgacaacaatattcttgaacatgtctcctcgtgcacatatatgaaaattccagtagggcatatacttaaaaataaaatttcttggcaatagactctgcaagtctttaactttactaaataataccaactagttttgcaagtggctgtgtcaatttacccacccatcatgagtctatagaagtttatggtactccatatcctcactaatacttgatattgtgtaatatttttttcaatctcctgagaggaaatagctgtccaggtattttgaccatttttcttgtattgccttttttattttagaaaaaaaaatacatatatatattctaaatattgtcattgttttcacacatattgattacattgtacaagtctgtgattggtctctgataatgagaaattttcatattttaacatagctgatattttttcactttttcatttgtgggttataccatttgaatcttgcttaagaaattccttctaaacctgaggtcatttagatagattctaaatgtttaaaacttttatatttaaatctctgataaatctagcactgatttatttgttgtgggtgtgtgtatgtgtgtgaactaattgccttgcagacttaattaaaatgtccattctttccctactgacttgttctataatatatcacatatgtataaatggttctgtgttctccataacattgttttactttctatacctacatcaataccatactgttttaattactatagcaatatagtttttatatctgccaaggactatgctatattccagggacagagcagtgaataaaacaaaaaaaattctctgctttcagggagtatacatttgagtagaggacatagttcaaataaacaagataagtaaaatgtatagtatgtcttaggaaaaaatcagaagtgaaagggaagtgttaaggagaataaataaagcctggaagggaagtgttatatgtcagtgatgaaattcaaataaggtgaccagagaaggcaatactgaaaaaagaaattttttgtaaaaagctgaaggaataaaaggaaatttccaggtaaagtgaatagtgaacataaaagccctcttgcaaaagcacagctgagtgctcaaagaaaagtaagaaggcctgtgtttctggagcagagtggatgaaggggtgagtagtaagatatgatgaaatcagaggaatacaagaaaaaaagtcctatgagcatgtaggggatttagtttccactttgaatgaggtgagaaaaccctggagggtcctaagcaactgagacagttagctctgcataatgtcaaggtcatgagacaggtagagtcctcctctatcccatgctgggaaaggaaaaagaactaggaacaggataatgctagacaactctctgaatgactatactgtccagataatgttctagaatcatttatgtaaaactgcaagaggagtttgttttgttttgtgttcttccaaattaatcttgaagtaacacttgctaggtatatagtatacagcaacctctgtaaaaaaaaaaaaaaaaaggcaaaacaaacaaacaagaaacccttttatctctatgcttaccctggtaattttagatgtaaaatcccaatcattatcatgacaaatgccatcataagaactttatttgaataaacatgtagaagtgacatggatttattgccgaaaaagatttgggaacaaatttcagagtattcggctaagacaaaaaggacataaataaaaataattttccagcagtagaataaatttaaggctgtctctaatttgagaaataattttgaaaaattagaaaagtttataaactaaaaccgtttagtgtaaaattttgaatcagagaaggagaaacataatgacttaattacatgaaaagtagctacattggtaaatactgatttttctttgaaccctaattaggcattgaaggaagcttaacaatctcatatttggtctagaaaaatttgaaaattttaagtaacagttgttagtagaaatcatacttacgtaagcactgcggtacttcaccactccaggtaccattccctacacaggtcaaaacagcagggaaggatagctcatagcctggagaacagatgtagctaatactaaagccccagtcgaaatttgttccttccagccttccattagagatctggggaggagttgggcaggtaacagctgcaattacattaaaagtgattagacacagctgttgaaatatcctgagccttaaagatataaataaatatcattagaagaagcacatgtgctaatttaaccttttcgaggacaatatgttgtgacatatcttattctcctggtagtgttcctgagtcattcctggaattaatccctgcaggatgcaactttttcttggcaacataatggctactggttgtcagagattctcttacaaaatagcaagctgcctgacatctcagagaaggcaaacagagggtgaccttcaatctagtatactgtaagtgataaattattggttttatataaaattattttccaatgacctttagacagacaagacttgggttgtttaactatatatagtatcagcatcttaatcatggaatttgaaagtagttctgtgacatttttgaaaacacaggtcatatgtctgagtataatatccaagttagttcccttaaccacttagattcatatgttaaaccttattattatagggtttataaatgcatttttaatttttttaaaaaatgtattttgtttaaattgttttcagttatctttaagcaaagacaggttggataagatagagatgaaaggatgaggaagggtatcaacttcaaaatctaaacatgaggaatgactgtattatgagaactaaaaacatatctgaatagctttttacagttgagtaatatctaattcatatcagtatgaattaataagtgtatagaataacatctaaaacataaaatgtctgctcatgtattttcatttactaactgtatatttatagtgatctgatacagaagcttaataatcaagaaggaaagacaaacacattgaaattattaattttgttagattataagtcagtaagatattaaactattaattcacatttaaatagaaacgtaaacgaaaaatcttaaatattaaaaatctaattattataaaacaatttgtctgacattgcatgtacagtattctacaagtaatcataaaaattggccaaaaaatttataaaaatatttccagtggaaaaacaaacagcataaagtagcaaatttatggctgtattgactaacaggttaattctagattgtattatatgaaaaacaagtttttcccattatttaagaaaaattacggttctataattcaggccggctcttcccaaattatagaaagaatttttccccacccttgaattacttgacccaagtggatcagcaaattacagttataattcatcaaggttatattcttttgaaaatattcatcaatttatataaataacaatggtgaatatggacataatattttacttatttttgttacattaaagcttattgtcattactcacaataagatataatgtttttgtcaaaatattattttaaattctatatattaaaataaaatttttaagaaacagccatttttagtactagaaaaataaatgcaacctggaactaaaaaattttatttaagtatactttaaatttgtatataaaaataagaaaatatgtactggttaccatttttaaatgttgaagaaatcattatcatacctctacaagttggcattactccactccatgtgccattaattgtacaagtcctgattctggagccattcaattccatcgtgtagcctggctggcacatgtaagaaacattttgtccaaccacataatcatctccatatctcagtccattggctggtatacctgggtctccacaactgattactgtcagtattggattagaagagcagatggttaatgaggcatgtatttaatggagaggagtagtaagcatatggcatacttaatatataagcaggaaaattagttatcgtgttcatttttaatcataaaacataaacatatttaaaccacatactggcaattcctgattatgatcaggtatgcttattacagattctacacatatggctcagaaactgtcacttagcccctgaaaaggctaggttaatatgccattatgttgtagtgaatttgatgcagtaacctcttctaaccttcactataagaccacagagaaaacaatctgcagaatcagatttctaacataatatttgaaattcatattcctatatatggctactgaagtatctaatttatcaggcatgctggatggagagcatattttctgcagtgtcactcagaaagacaacccccaagaaattgcaaccttcactctggaatgtgcttgttataagaaatgcagatgtatgaggggccatcccatccaagtccttgaccaatacatgatgatgtttccagcccaaaatagggactgtcactgctctgttctgccccaagactccattaatatatccaactctgacgatcctcacgtttgcatccaacccctaaaaggaggtaggacaatagtgcaatgtgaacctctctttactgatgacacaatggatgagctgggtggagggtgtcacgttttgcagagcagggatggaaatggggaggccatgcagggccaggggcaacaggttgtcaggagcaaaaggtctagacccatcccaaggacacaagaaagaaggcaacaaggcagactgcacatgagcagaagctccaagccctcagaatatgctgcactgttccagtggacttcaattacaaaatgttaatttgaagataaaattattaagaattttgagatggctatcacagagcattaaactctaagcacaagactcttctgagcatgagatcctatgagttgcactgatctcatgcccatgagtgtaagtgcacacataatattatcgtttctttataatgccagccaaaatgtttcagaaagacttgagacagcttagaaacacaaataacaatttcattaaaaatgtattttgattaaatacaaacataagattcaaacactacaaagattatatatgtcacacaagtgataactgttttgaggcacaggatttaagcttaatttgggcagcgaattggctaaaaaactttctaccagctaagaaaacgaaaactacaagttacactttattttctggagataaaaaacatgtagtatacttaacatgccttttagtctgctaaatcttttggttcataaaagggtaatttctccaggtaaatctgggttattttttttctctctctctctgtctactcctctttctgtcttttttaaattcacttttcccaatattttggagattcaggattaaagattaagaatgaattaaggcatggaagaccttaagaacaccttagttacattgtatttattatgttatcattaagaatgattaatgtcaagattcctttcatattctattctgttgattctaagaagttttaggattatgaataatggcatttaaattaaacaacatcattcagagcattcaacctcataacttttggagcccttaaaacagttcgatgaaattaaactgtttgagtgtttctttctcaataataatagagttttatattcaggactgctttccttcctatgattattggggagtaaaaagattttttttaatgatacaactgagttggatagaaaatcaaataattctactcatgtaccgacaatacgtcatctctttttatagtttaaaaatttacaagaatgtaaaaatgagtataagccttcaatttattattttattttattttatatttataaccaagatttttaattaggaagaggaaattaaagagaacacctataaagtgttgttgttttctgggcagtgctttccagactgcattagaatcttggcaaggagaaatagccagcctggtcacagggcacatgagctgagatgcggccaccaaaagagaggacagagcgtttattttacagatgcacgaagaaagagttctgcacatcatggcaccaccatgaatgaaatgcgtgacaacaaaagctttagaagggtttgtttggtgacttcctaatgaagcaaaggctagtcaaagaggcagtttccaagagcaacagtctttgtaaacagcacctgctctgcaagtcaattcattcactaccagcttgttttcagagacaaccaaaaaaaaaaaggcttttggttttttcaggaaaaaaaccttagaatagtagctctttagtgcttcaccctaaaattcagcgatatcattgtatgacaacaaattcagaaataccattgcataataagaagatcattgaccttcttaaatacccatctctctcacacaaacacaccaataaactccataaaggcagatactttgactcttgtatgctattttcttaagagtctcatctagtgtatgactcatcataagagattaaatatttgtttgaaggataaataaatgaatgagtacataaaggaatcattaagttgtcagctcaaattctcaaaaacacataaattatttgaaaggtctgaatttgttttgtgggaggcttctcaatatgtaattgatgcccatctggcatcatttatgataaatctaagtaaataacctctatgctacaaataaaacataattgtggtaattctagtcaatctatgccgctttaaaactactttctcttttaacttcttatacaagcattgtaaatgtgcattttaaaataaaataaagtcacattacttttttcacaggattcacttttttattcaatatctaatggatatttttgcatgtaactattaatatacatagacatgcataacatttttaatggcatattaatcccatgcaatataatttatgcaaccaaagacctatggactggtgtttgagttattccactgcttttctgttacagacaatgcagcaacgaaaatgcttgcttgagcatcattacatatgtatgtgctctgccatacttctagcttcaagcccagaacagagttctactgtagcaaaatgaagttccagaaagaatggctaaaccattcctctcataatgcttctgattttacacaatctccacattcaaaaagttggtttcttctttagatctcaaaaggcagggtttctctaccttaagcttgaccctattgacattttcagtcaaacaattcttcgttgtgaggggctgctctgtgcattgtagaatgttctgcaatatatctctggcatctgcctgctagatccaaaagcaccccctgcccctgcactgtgacaatcaaaaagtatcttcaaacatttccaaatgtcccctgggaagcaaaatcctctctagttgagaaccactgtgctgaggaatagctctcactccttgaggagatttagattattttttatctgcgctcagttttatgctgggatatccccagccctctcttttgtaagactaaccccatcttcctgatctgtcctctgttagaaaaacatctttgagaattttcagatttgtgacaaaaattcagtcaggggcatttcgataggtggctatttggaaaaggaagccttagattcatttatcacctggacctgattaaagatggtgtccttagcccaaaggaacaagacttcccagatgcaggatgttgggggttggtccttttggacgcagaagtccagtcagttttctaaaaatatcatccaagaaaatgaataagcacatgtcttttcagaccagaaagctaattcttactctacttggcaagccctgtctcagcactgtttgtgtcttcttcccaaaacaccatatgcactctgtgtatgatgggctctaggtaacagaggtggtactgcctgttagacattgaaagctaaggatccccttataattaatatcccaaaacattttgtactgacaaaaaaatgtaattttgaaagagtaattacatgtacttattatatcttctctctctgtctgaacatcatagaaaataacttcactacattttaaatcaaggaattgatttgagcgatctggtattatgccaaatatctttttcttctagtttggttagctctgtgcatgtttcttcacacttataatccctctgtcaaagtgtgcataacattttaatgcatgatcttgatttcaagatacaatattttacccacccaggaggcaactagttattctgaggaaacttctccttccaccactggtagtgggcttaatgaggacatgtctggagttagaaacaatgagtgttgggaaaagggaaaagattttgcttatgaggcatacttttagagatagattaattagacttgcaattttccaactcacgtatagtctgaagccggttgaataacagcaggtagaatttagatgagtaaaagtttatgcttttaccaacatctctactatggccaagcataggggattggagaccttaccattattattaaatcacatttattccaaagatgtttctaaaatcattgaaatgaacaaggcaaatcacagctgacacatttccacatataattgaactagaatttctaaaaaacagaggggtgagtgtgtgtgtgtgtgtgtgtgtgtgtgtgtgtgtgtgtgtgtgtgtgtgtgtgttactgctggacaatagagcaaatgaaaaggtatagttgcaaataactccagtgggaaattctcaaaggtaaaattctcaaaggaaattctcaaaggtcaaaaatgcttggaattccaaagttacttcactgatctgtgaaatattagggagcagataccttaccgactgaactctgtcttctcagttcctagcaaagtgcccaatgatagtaggttttgtttaaatgattttttattaactgaatctataaaaaatccagttccattgtatactcacagttatgtttctactttgtttttaaaggtttttgtaagaaaacatgctctaatataagttaaagatttttgaaaagctaaaaattggattattcctctgatttgtcattactcaggaggaactaagtgcccaaagataactagccaaggtaaaaaacaaaaacctcttaaagtgaccaaaatcttataattaaaaagtaaaaagaaatccaaataaaattgaagtctttatattttgtctttaccacatagtttaactatattttaagggtattattaattttctcaagggcctctattcattctttcattctcaaatcaccctacattgaaatatctatcatataatcaatcttgctgattttctttctttgaactgacattgtcataaatctactagatcctctttgtcaatgattatgtacaagattcaacgagcactcttgttcacttgctttgactcatcacattaaaatatctcatctcttgtgaaacctgcagacttatttattgacttacattatatttgctttgtacatctgacaaaaatatcattgataacaaataaataggaaattgtaatgttaaactggaagtattgtttagcaaaaacaaattttacaaatggtcgtttcattaagaaatgatataattttgcagaattcaaattggtaaatgcagagaaaacagaaattaaaaattttttagagaaataggtcataaattaatgagacattttcatatgccttatcaccaatgttctacttattatagtatgtcatatacatttgaccattgtagtgaagacagagaataaagcaagaaaactaaatggagaaaagtacagaagaagagataaaagtatactaaagaacatggattcttgagtgaaatagactagggtttaaatcttacattctacagttactagctatgttaccatggaaaagaaagttgtttcctctctaagaaaccatttatttgaatgtgaaataaaaaggataacagtatatatctcatagatttgttgtaataattgagataattatgtaaatcagcacaaatccgaacaaatggtaaacactcaataacagatactattatttatgagaagaaatagtaataattagcatgaaaagaataaaggctttgtttctttagtgctatggttttaatatctcttcaaaattcatgtgctaatttaatccccaattccatagtattaaaaggtaggggctttgggaagttattaagtcatgagggccctctccccatgaatgaggttagtgccttctaaaagtgtgggagggaactattaatagctaggcccctttttgctctttcaccttctgccagtcagggcgtaacatgcaccccttttgtcatgtgaggacacagaagcaaggtgccatcttagaagcaacaagtagccctcaccagacacaggatctgctagcaccttgatcttggacttctcagcctccagaattttgagaaataaatgtttgttctttagtatttaaccctgtctcaggaattttattatagcagcacaaatagactaagacattcgggttttctaaaaattgatatcaggatgttggtttggaaagttcagctacttcaaattttttgcatacctcattaatttaattcaaattcatatagtaactggcatacatcaaataatttatttcaaattcatatagtaactggcctatagtaaccataaaatttatatagtctgggcatatagtaaccataaaaattgtgtctacagaggcaattataacacatcaaaatttattaaaaacatatttacacttgaaattagccttctagtgggtatagagaataacatgaatggaaaatttcatctatatatgtgaaatatagatgaaattattgtttagtgttgagctctgcccgtagtcaggaagccctctaaatacgtgatgcctgagtttcttgatctagacaatgtgagtctaggacaattcccaaaataatatgattctaccaatcatatatttaaatttatgttcattgcaaatgaatgagaaggaatctgaagcactgattctaatttaatttgattaccacatataaacactatcactatgctagattctttaattacagaagtttaggctgttttaatttccactgaaacctctctctttgtttctttttgggggtttttatttacgcttttggtttggattgttaatggggtgttagtaactttttgcctatgaagtacataaacttacaaattatcagcttttagtttaatagcaattcattgttgaaaagctaacacttaaattattttatgcaatacgatatttctctttgaagaactgacagaaacaaactttccttatacttttcctatgttattcataatcaatctgtcttgaatcaaatgacttataatttaacattcctgaggaaaaatgaagacaattcaataaaaatgtcaatgtaattttcaatcacaaaaataggaatgtttatttatttttatttcactaaaattggaagacagctgtaaataaaagattgagttatttatccataaataaacaaaattgttattcattgtaaaaaaaaaatgaaagtgttcctcagcatatttctgttactctgaactattttcattatttcaatctcttcaatgactattattgaaaacttactatatgccagaacctatgtgctatgttagccatacagttgtaggccctatctgcaagtagtttaaaattgagttggacggtggctcacacctgtaatcccagcactttgggaggccgaggcgggtggatcacaaggtcaggagatcgagaccatcctggataacacggtgaaaccccgtctctactaaaaatacaaaaaaaatagccaggcttggtggcaggcgcctgtagtcccagctacttgggaggctgaggcaggagaatggcgtgaacccggtaggtggagtttgcagtgagccgagatcatgccactgcactccagcctgggtgacagagtgagactctgtctcaaaaaaaaaaaaaaaaaattgagttggaatggtaaatcatgtatactgataactaaaataaaatttgtctattgaagtctgtcaccaacaatttactgagttgctcttattcatcaggtgctatgctccaccataaagggccagtgagataaacagacccagtcattactgctctataaagtttacagtttagtggtataggtaacatacaaaaaaaaaaaaaaagctatacagtatggagagattacttttagctaaaaaggatatgaggagaaaatgtcttgaggtgttttgccaaatgtttcacatgaactgatacttaaaaggtggataagagttttaaaggctacggtgggatagtgttaagttgttcactattgcaaaaatgagatattttctaagtaagtaagaggaattcagctttccttcaacgtggagtaacaaggaagaatttaccttccatctgaaagaaccaaaagaaaaaaaaaaaggaaagagtatatttaaaaaaaagaaatatttcaaaacaatggacattaggcaacaaagcacagtgattcttgagtgacaggaaacaaattagttgaatcccctgattgcctcatcttactacattaagagagtttcaagtctgtggcacagggaagaggaagctatgcatagcccagcagactccttgagttgagaagatggatctgagagtcaagagaaaactatgcaggtagagtttatgggacatggtaccagagtcgacattgacagagaaatgtctctagagatataggaaggaaactccttaaacagtcagcagatttctgatcagctcctgaggaaactgcccatggtttgagaaaaaactaccccaaaagatgagatgtaacaatatctggagctgacatggggccaggaatgccacttgtcatacagaattctatacccagcaaaaatatgtattttaaaaggtgaaatgaaacatatgcacacaaagaaaagctgaaaacattatcataagtagaaatggaccacaagacaaatttaaagaagtccttccagtggaagaaaaataatacctcatgcaagtatgtatctacacaaaaatattacaacacttgaagtagtaatgacgtacataaataagatttgtcttactatttaaatctcttgaagaaatagttgactaattaaagttgtttaactacgctgcgtggtgttttggtgtttgtaacattgactaagtaaaatgtttgactacaagagcatttgcataaagaaccttttgatgcttcaagttctacctccccattccccttctactccacatctgggcaagccaacaagaaagtcggcttgcttcctcatttggcatcagcagggaagttcaaaccatgcaaaccctggcacactcactagaacttttcccaagttcccaaccactaaccacaataaaaaaaaaagcaaaactatatgtataagtacatttttcacactgctgataaagacgtacctgagactggataatttataaagaaaaagaggtttaggctgggcacggtggctctcgcctgtaaccccagcactttgggaggccgaggcagacggatcacctgatgtcaggagttcaagaccagcctgatcaacatggcgaaaccctgtctctactaaaaatacaaaattagccaggcatggtggtgggtgtctgtaatcccaactactcaggaagctgaggcaggagaatcacttgaacccaggaggcagaggttgcagtgagccaaaattgcaccattgcactccagcctgggcaacaagagcgaaactccatctcaaaaagaataaaaaaaagaaaaagaggtttaatggactcacagttccaagtggctagggaggtctcacaatcatggcagaaggtggaaggcacatcttacatggtggcaggcaagaaagaatgagaaccaagcaaaagtggaaacctcttataaaatcatcagatcttgtgagacttattcactacatgagacaagtatgggagaaaccacctccatgattcaattatctctcactgggtccctcccacaaaatgtcgaaattatgggagttacaattaaagatgagatttggttggggctacagccaaaccatattattccaagcgtggcccctcacaaatctcatatcctcacacttcaaaacaaatcatgccttcccaatagttcccaaaagtcttaactcatttcagtattaactcaaaagtccatagtcccaaacctcatctgacacaagacaagtacttccacctatgaacctataaaatcagaaggaagttagttacttcctagatacaatgggggtacaggcattggataatagctgttccaaatgggagaaattggccaaaatgaaggggctacaggccccacacaagtccaaaatccagcaaggcagtcaaaccttaaagctccaaaataatcttctgtgactacatgtctcacatccaggtcactgatgcaagagatgggttcccatcatcttgggcagctccacccctgtggctttgcaggtacagcctccctctcacctgctttcacaggctggcattgagtaactgtgacttttccaggcacatgttacaagttgtcgatgtatctccctttctggagtatgaaggacagtgaccctcttctcacagctccactaggcagtgcctcagtgcagactctgtgtaggggctccaaccccatgtttctcttcaccaagataatggggaaaatgtccccagggcataacagaactctgtgacagctcctcccatcacaggcctggaagtctaggaggaaaaaacggtttcatgggtcagacccagggccttcctactgtgtgcagtctaggaatttggtgccctgcatccaagccactctagccatggctaaaggggtcaaggtacagctcaggccatgacttcagagtgtacaagtccttgaagaccccactcctgcagcaaacttctgcctggacgtacaggcatgtccatacatcatttgaaatctaggtagatgttccaaaacctcaattcttgacttctgtgcacctgcagcctcaacaccacatggaagctgccaaggcttggggcttgcacactccaaagccacagcctgagccataccttggtccctttagccatgggtgggatgcagggcaccaagttcctagactgcacacagcaggaaggccctgggtttgactcacaaaaccattttttcctcctagacctccaggcctgtgatgggaggagctgccacagacttctctcttgtgctctggagacatttttcctattgttttggcaattaacatttggctcctcattactttcacaaatttctacagccagcttgtatttcttctcagaaaatgggtttttctttactattgcattgccaggctgcaaattttctgaacttttatattctatttcccttttaaaactgaatgctttttaacagcacctgaatcacctcctgaatgctttgctgcttagacatttcttccaccagataccgtaaatcatctccctcaagttcaaagttccacaaatctctagggcaagggcaaaatgctgccagtctctttactaaaacgtagcaagagtcacctttactccagtttccaacaagttcctcatctccatctgaaactatctcagcctggatttcattgtccatatcattatcagcattttgctcaaagccattcaacaagtctctaggaagttccaaactttcccacatttttctgtcttctcctgagccctccaaactgttccaacctctgcctattactcagttccaaagccacttctacattttggggtatctttacagcagcacccaactgccagtaccaatttactgtattagtctgctttcacactgctgaaaaagacatacccaagactgggtaatttataaagaaaaagagatttaatggactcacagttccaagtggctggggaggcctcacaattatagcagaaggagaaaggcacatcttacatggtgacagtcaagagagaatgagaaccaagtgaaaggggacaccccttataaaatcatcagatcttatgagacttagcactaccacgagaacagtatgggggaaactgccccatgattaaattatctcccactgggtccctcccacaacacatgggaattatgggagctacaatctaagatgagatttgggtggggacacagccaacccatatcactattcatccatcccttctctcaaaccatttctgaccaaagagagtcttaccatgtgggtaatctttcataccttcttgggacatcttcagccttgtggcataatcagtcaatatggaaccaattctggggagggggcagttgatcatgctctttcttaggcaaccacagagcaactggcagtgagtagggtggcccaagggatgactatcattacctgagggacttttttgttgttgtttgtgacttgataactggctctgctgccacctggctagagagtgcttggtgctgtgctagtgtacttacactttgagatgtgctgattttgatgcattttctgagcttttctggcctctgccaagatttaaatgatagatctaagtcagaagtattgaaaattgacattcagagacaggagtattggcttgtggtccttcccaaagtgattctgagttctgtgcctctcagcttagacttatctgtgtgtcttagatttaatcatatgtctcaaatttagtgcaagccatgaatgatgctaggctcagatgaatgtcttactctatgactattggttatgtgtctcaagcaggtgttgactcccattctatagagtgctcaggggaaaggctggcacactgtgcaataagtatgcttatccaatgcttgcctatctgacaaggagtggtcaccatgtggtgtcctccagtccatacctaaactcagatggctttaggtatctaaaacaaccttcgttgttgttgctactgtctatgtgtctgtcatcaaaaagattctggttctcagggaagaacacccatatcatctcatagcacagctgtgggcttaattcaaacctgacttaagcctggagtccctaaacccaataacaactgccctgtgggagacccccaacatttaaaataatgatttggaactctctggaggaagatacatataaataaggacagagtagagaagattgcccttcttcctgaagcgtatcctgtaactccacccccaaaaaacaacaacaacaacaacaacaacaacaacaacaacaacaacaaaacactaggatacagggagaagaaacaaaaattgaaataaagatccacaactggactcaattgaaaatacaaatttttctaaaatagttattcaacagaaagataaaataacagaattggatttcacatctccacaatatgggttttaaatgaacagattctgatatgtagtacttgaaaaatctttgtggtcttcatagatactgggcctcaaattacagttatatgaggagataccactgaatgtacaaggtatatcctgtactttagaggagttaccaaacacaaaacagaaggcaaacatgtatgtctcaccttaaacattgaaactgttgctttgcctaaattccttgtggtcagagtgcccattgacctatagcacctgatacggacattttgaaccaattagtaataaattaatattaattatctggcatttacaatcagcttggtaaaatggagccccttggacctgtccttctaattacaatagttaatacagcccaacttagattaaaacaaggtctacagtaattaagaaccatcatataacacctactgaaggaaacaactattgttcctactgccttccctttaaatagtccaatttgttcagtgtttaaacctgataaaaaataattggcatgggaaagttgattaccacagcctaaataccctgatgcccctgattaagacctccatatcaatattactgaagttgttggttcctatcaataactggaaaatattttgctattataggtttagtgaatatgttctattcagtacttatttcaacagcttcccaagcatagtttgttttcacttttgaagagacaaaatatacgtgggtatctcaacagcccttgtgtgacattgcacacaaactttgcatgcaatatattaactacaactgattttctccaggaatgcatgtatgccattattttgagggcaacaaattcatttgacccattcatccagaaaatgcaaacaaaaaggagcccagaaataaaaggggattatctcacccacacaatacaaggccatgccttctcagttaattttctgataattatttggtcagcaaaagtatatatactctgtccaaactgcaatacaaaaggccctcccactagtatccccaagtctcctttgctacagaggcttcagcaacatcctctcatgatacttagaatccatgaacacacagtctaaacaattttcttttgagacagggtctcactctgtcacccaagctgtagtgcagtgttacattcggagttcactacatccttgacctcctgggctcaggtgatcctctcatctcagcctcctgagtacctgggactccaggcatgcaccaccacacttgactaagttttgtattttttgtagagacagggtttttgccatgtttcccagggtgatctcaaactcctgggctcaagcgatctacacatctcagcctccaaaagtgctaattcttcttaatgaaaataaccataatttccaatggttgtgtattattgttggttaaatactatttattttataaataagcaataatgtgtataattttaagacttttaaacacatttttcaaaaatttcttcaagggagtaattttattataatgcagaatctccaaagtgccatctatttttaacataacaagagagcaaatcagttatcgagactcactacgacagtgcaagaacccataaagaatcagtatgccttttaaaaatcaattttgttattaatatgtgttatattgacaaaataaaattgcatccattctatttttaattttaattgcagctataaatcatcattgttcttaaaattctgttaaattacatttattagtgctgacttcctctgacctctctttctgctgccagttaatgtagtaccttgataagccaacttatcctaaagtcattagtatacactcagccatggtaactactataatcctttaatctgaaaggcagtacaaacagttaaaaccttacatggttttattaattacaaaacacacaaaaatacttatatactcatcaatactttcatataattactgatttttaaatattgagaatatacttacttgtacagttaggtaaagttccagaccatgttccattggctgtgcactgtctaactgaaggtccagaaaggatgtatccctccatgcaggaataaatgactgaactagaaaatgttgtgccatcaattcggaagactttcccattggctgtggttcctgggttaccacactgcacagctataaaacaaagtgtttaagagtatatataaaaaatgcaatcagaaattcttcccaaaaaagttaatgactaaacgattctttcaaattattcaaagaagcaataaaaacttctaaaataagtagtaaagtatctaggtagttgaaattcaagatgaatgtatgttgattttattcgcttaattactgggatgcaaattataacattttcttaagactttttttagcagcttcagtaaaaactctacagagtaaaataattattcaaagagtactgtattggcttcaggtaccacaaaatcttttagagaaggattataagaatctctgtctaaaaagcaactcatgtaaaattggaagacatgtaacaatgagtgatgagatgcaacagagatttattacatttatatttcagaaaagacagatacacaattttaatattgtaagcatctatgtatatttttgtttgtataagtacataactgttttgcattaaaatgtataaattctatttctagaccagagtaccaaaactaaaccgagtaaaaacaaagtaattaaatattagtaatcgttttcattaagtttcaatatattctaaataaaagttacaaacacgaatgtctttttatgattaactattttatatatgtgtttaactatttgtcaacaatatgttaatttttaaactatctgacttaaaagctataatatatcaaacgtaatacttaattttcttgtaatatcagaaggcattttagtaccttacagaagtgaaggcttttatggatatgaaatatgattataatttcagaaaataccatctgcatctcttgctgcatcttaaatatttctttttgcctatcatttgtataactgccgtgtgtgtgtgtgtgtgtgcatgcgcgtatgtgtgtgtatgcatgtgtaggcaagaaccttatccattttacatatatacataaaaatcaaactctagataatattttaagcagaacctatgataaaacagacatttttactttgttgttaagcatgattactttcttctaaatgcattagtgcctgcctgaaataaaattttggccatgtttacttgttatatatcatgatccatagcttgacgtaatgcaagaaggatttgagataatgtcatcttttaaaatgtcatgtaatttttattttgaaatagagacctaggcagagtcaaatttctgcacaataaaaatcaagaatttctttagtcagggtggtttcaagatatggccaaatcgtactgttgtttctgttctcttgactttaattcctccacacctaatacacaaatttctcctatccagacattttatttgaactaagcacaagtaaaattaacttaaaatgaaacaaggtaagtgcgtcatctatcatgagtgaaggcttaaagcttgctggatacaatgaaaggaaacagcaactactttgcctctgcaatattgacatttaggagaaaaatgatttattgttgcctgtgaataaacctgcatttacatttagtactagtcaaccaaaccatctcttctcacaagagtcatttcccagcagtcaacagacataatctaataaaaatgagagttactatttttttagattcattaagcacttaatatgtcacagccacaacttttccaaaattatttacttctcacaaaaatgttctgagttagtattaacatcaccaccatttcttaataggaaagtgaggcacagaaagattaagtaacttgcccaatctcacaaagctagttaatagcagattgttcatctagtacaaattcctaggaatgatgctgatagcatacaataaaagcattgaatcatattcagggtaggaaataagctgaaacataatacatgtttgtaaattgaatttttttttgtgatgcatctttataggaagtatattttatatgtttgcctttcttttgttgctagagagaactcttattttaaaaatcatggtaccatttgtttccttgtatcaaagtaataagtagtcatttctaaaatgacaaaaagaagtataaggaagaaagtaaagattgcttaaaattccaccactgaaaaatagaaattgatatttatatatgcatatgtgtatatgattatgtattaatatgaatataattatttcaatattctatgctttgtgttaggtatagagtatacaacagtgaaatattaatttactcttttttatttctatttttcttacataaaattacaattaaggtatctttctatcataaagtttagtaactgtatggttttccatacagttaataatttacctaaccaattccctgttgaaaaacatttagttaggcttggttttatttttctatgatttttagatataacatactagaacttatatttacaactctgtacattagttctatgtttaagataaatatctaaaataatttctggatcatattttagtagggtgactgtaattaacaacagtgtattgtacatttcaaaatagctagaagtgaggacctgaaatattatcaacacatagaaataataaatgcttgtggtgatggatatcataaatattctgactggatcattacacatttatgcatgtaacaaaatatcacatgtgccccattaatatgtaaaattatgtatcaataaaaaatacctaaaacattaaaaatttaacttgtttgaaatatattgccacagaaccactaaagatattataacaatacacacttgtattgatagcataaaactttgcttgtgttcacacctcctatgtaacaccatttgccatcatttaaaagaatctcagtttgtcaaaaatgttacattcttcaaatttgcatttctctattgattaaatgaagtcacttaaacacattatttaatatttttatttttacatgtgctttatccttcacattctgaaaatacctttcatgttttattataaattattaaagtaatatgacagcaatagaaaacatttggaataaagagtaaaaataccaataatttcacaactctgtcctagtattatttttttgtgtatttcctttcatactttcacttaaatgaatatcatttctcatggttctaatatagcacataattttaaatcttatttctaagttttatataatgtacattttctcatattgcttcatggcctatatcgtaatattttattgactatactctattagatcatgtaaacataaaattgcttaagcaatacttttcctagtgtaagattgttccaaattattgctagttataaacagaaataaaaattacattttcataattgtgtgttctctttaatatttctattttccttggaaaacattccacaaaagtggagtaataaactgaagcaatagatatatcccatgaatatttatcattctattcattatcagtttgagagcaatttttgtcaaattgctctcaaaatataacaataaaaatcatcttgaaatattttaaagttctagttttgctgctcccgcacacaataattttatattaccgtgtttaaaataggtgaaaatgataccttaatatttaatcataattttttattagtagttctgttgaattttttctataggttacagtttttttttatttctgctttctgttcatatcctttatccattcgtctactaaaatctgtttgtgtaagtgattggtatcagcttcatttatgagaaaaatattaattctattgtatttgctacaactaatagttctccttttatccataatatgcatgctaacaaagcaatatcagcacaagtctgcatttcatctataaaatattttgtaggtcagctgaacaaaggactgacttagatgtcacctacacaatgttgcatgtataatgatgcccacagcatcattaaaaagaccttgactttggaaaataagtttgagaaataaagagtttagtctctcttactgtattttactcagcactatgttttccaagtcttttccctatatcaactaagttgcaactccttcttaagattattaaaactgacccagttacaaaaagataactatcttttctagaatataaatattaaacataatcaaatatttctataacatagtcaatcaaaaaaccctcaggaaagtttgattgggaattatcttctatttacaaaaccaatatgtttggtacaacgtcaagtaagtttaaaaatattttgcaagtttagtttttccaataaaataatcacaaaaagaacaattaaggtcaatacaataattttctagcaacattttatttactagtcaattttgtaaaatatttttctttttcctttttatctttctttttttttaaacagagtctcgctctgtcacctaggctagagtgcagtggcataatcatggttcactgcagcctctgcctcctggactcagtgatcctcctgccttagcatccggagtcgctaggactacaggcatatgccaccacacctggctaatttttaagatttttgtagagatgtggtctcaggctgggtcctactcaggctggttcaaactcctggcctcaagtgatcctcctgcctcagtgtcccaaattgtggggtttacaggcttcagccacaactggcactcttgtaaagatttaattatgttaactctgagtcagaacaattaaaattttactcaaacaccctagatgttgtgaattctagtaactaacagttgtactctacaattaaaaatcttaataatacttctgtatgtttctatatttttccatttctacaaactagaagctaagacagacattgaggttatgttagggtaagaataacctatcattttctcttgtctctacaatataggtacactagtctccccttatctactattctttccacagtttcacttagccatggtcaatcatggtctaaaaataatatatggaaaattccagaaatagccaatccatatattttaagttctgagtagcatgatgaaatatcatgtcgtcccacatggaaagtgaatcatcccttgtccagggtacctaccctgtatatgatatccactcgtcagtcacctaatatctgccttagttatcagatcaaaagatcacaagaagaagggtgagtacagtcaacaagatattttgagtgagagaccatattcacataacttttattctagtatattgctataattgttctattttactattatagttttaatctcctactgtgcataatttataaataaaactttattacaggtatgtgtgaaaaaatcatagaaataaagggttaggtagtatctgcgttttcaggctcccactaaaagtcttggaatgtattctccatggataaaggagggactactgtaaagaggaaagaataaatatttttaacaaatatatattactttttaaatctaaacatttgctatgttgtgaacaatgtttgcatatatatgaccaatgagggttttttaaaaaaattatcggttatagttatcttaggagatggttacagtataatgggaatacgactgttttatttcatagttgcaggcagaataaactagtaagagtaattttcctagtagtactcatctggatttagatacacactaaaatccagtagttgcaatatatttaatttctgcttgagattacctttgcactctggctgccttccggtccaactgccattagctaaacatgttctttcttctgagccatgaaggatgtaaccagtatcacaagcataacgtacagtacttttagttctgaaattgctttcctgtctagagccatggccgggagtacctggatcgccacatgtcccagtagcatcacctgcaatgcagtacagttcaagttaaccaattcccataaacatttattaagtttaccagttagtccaagggcctggtaggcatttgtttttgtgcatgcggtgttttagcacagatggagtaaaattgtaattcatatttcttatctgactccagtcattaaaaaaaagtgtaaatgaaaaagaaaatagttgcagagtacagtgttacttttttatcagtgaatttggagacgttaaataggttaaggatatttcataagtttttccaaacctagttaataaccaagctaatggaaaatgtgtaactgacagtactatgaactcaaatgacaacagactcataaaaccaaaatttaaaaaaaactgaattctgcaatttgcatgtttccttttctgaatttcctgattactgataatatttttattgtttttgttaaagtagaactgtggtgtgctaggacatgtaaatattataatacagttctgatagcctaggtttctctctcttattttctctaccaatgaccaatgatcaaagatgaatgaactgcatattcctcgtatatgaaaacataaaaataaaatgtaaaagaccaaaatttagaaactctgacttaagtttctgataagaatattgctcataactaggcgttcatcttttgattttagtgttaaagatttactcagtctttacctagtcgttttatcatttcttaaataatcctaatcaaaattgccatagtgttaatatacattgagagagagagtgagcgagctagagagaaagagagagagagagagagaagggttgaaaatataagcattgaaaatgttctttccatttgtcctttttatatgccttgtgtatttggaatacttcattatatgtccttattttcatgtgatgtaaaattaataaccacacaaaattttaagattagtatttcacttttaaatatctgtgtaccattttattactcaatttagtagcagtttcctaatttcctaatacattgtggggtgggggcggggggtgagtctgtgtgttcgcatgtataagcagttatctgagagttaatttactatgagtcactccaagataagactttaattctcataaaatcaattttatagttacattaaaaatgatagtttttctaaatctgtagattacattcaaagtcccaggcagtcacttcatagggattaatcactagttaaaagatttggggttaatttaccatttcactgcttttaactctaaagtgaaaataatgtaaaacaactcctagtaagtcatcagaatggtatccacagagataaagtagtgtaaagacaatggacaatatataaatataaagaaaaagcagaaaaataagcacaatatctggttgatgggtaaaaataaatagtatcaactagggagccatcatagatctaaaacgtaaatggtgtttttgaaaaaaagtggtaacttaaacgtttatctcagaaaagatttaccaaatacttactctgtgaacaaattattaattaaaatatctttaatactgatttatgcaaagataactctaagcaatatgtcacttattaatattaggatagataaatatctttaataaaatgaattagattagttcaatttacaacattttggactttattttaaaattataccattaaagtaatcaattgcttagaaagttaaacagaactgaactctgacagaaaaccactgatacaatattgccttctggggaaaattatatgtggtatctgctaaaatgggatagatactttagcttgaatagtttcaccattttaacgaacaaaagcacttcatacagtgtagcatcctaaaaccataaattctttaaattagcaacacagttcaaaacacaaacttgtaatttatcatctacaacatcagtaccctgcatttctatagccttacacatattccagtaatgtgtaagcagtgtttcagcttttcttatgagatttttcagagagaaatatattttaagtctttagattgttttgtgtatacgttgctactactactactaacaataatgtaatttccaacacatattgtccaattttccaagtggtacctgaacaatgaggttgtgatccactccaatggccattcaattggcaggttcttgatgactggcctaaaagggaacgctttcctgtgcaggaatagtgaacagtagacccaaaagtatacttctcgccagacaggactgcattaggaggaacgccagggtgtccacagtcaatcactacaatacataattattaaatataaaatttttttatatctcctatcgaacaacctataccagcatgtttatagaacataccagaagtaaatgttctgctgaaacatctaaagcctccagaaatcaaacatctatgttgaaggtgtctttttaaaaacaaagtggagtttgcagctatagcagctgttctgttaacttactcattccgaggatgagtttaacagcaacattgtaagctaagtaagcattaaaaataattaagtgattatgataaatctgtacgtgtgagagtgatgagtgtgtgtccacatatatatgtgtatgagttcgaactgtatctgttcctggtaaaatctgtgaaagttaaggagaagattaatgtggatttgctaagtaaggacataggacaccatgtggatttaaagtgaagcaatacagaaattacatgaaaagaacttgagggttcaagagattcaatgaagattgatctgtgattcacaatttaatatatagtctagaatcattacatttcaagtcagtaatgaataaattatgctgtaaaaagacaatactcagtggcttataaactaaaactgctactcatagcagaatcaaaagtcaatacattgtagaatattctttatgagtgataggtagtttcagaatttaacatgtgtcccctgttagttgtactcagagaaatactgagtgtcacatatctctagagtatcatacagcacatgaggacacaaaaacttaataaaacctttcagtatataatactctaccagggagagctataggaaatgataagtcaaaaaacatatgagagctcagaacacctgaagaacttcaggtttacaagtcctatgaagagatttttaactttaatgtggtagctacataagaataagtaagtaaattattcaaataattagaccagtcaacacaaataagtcaaatgaattttaatcagcaggccaaattactgaactatatgcatagaatcaaattttacagacacagcaaaaagtgttgtttcttcattagtacatgaatgttgtcacaaaatgttcataaaagtacacctcatgaacataaaaaaatcctctaaatgaagcataatcataaaataattttatttagcaatttaataaaaccaaaaattatttgccaaaaatgaacgatttcttcacacgctattcattcagtctatgaaattgttcttctcttccctgtcaagtccaagactcaccaactgtttgagatctagttcaatttgaggcctatcaattgactgaattgctagaatttatgttcactcctctatgccttcacagaagtttgatttataactgctaaattatttttctcactacgtgtgttactttaagcatcttggctgtaatctattttatgtacattctacaactcctatcataacatataacaaaatgcacttattagatattcactgactagaaagatgatgtatattaacatttattgcattaacaagtatatgtgtctctatatgacaaatatttaaggtcaataagttttaagtcacacctttgtgtaaatcttcatgtattctgaatccatgatggatgtttaagactaattttgccttaaatgaaatattaaatattagtacagaataaaagtgtagttgcctcttacagacgataatattgtaaagtaggaaatatgactacttttcatattttatatgctccaaagtgcaaaatcaaagaatgatagataaatatttatcacattaattttaagaaaattacatttggacattgaatttgcaaaatatagaaaagtataatttcaaaacagtaaaacaataaaatcaatatgcttctctgtgatatatatctttaggtcattttataaagatgataaacattcctatggtttccatgacatgttctcaagaaacaattcacattatctacttactgatacattctggtaaaggtttgtcccattgtccatttggttgacatatcaaaactgaagatccaaataaaaaatatccaggattgcagtcatagaataccacagtgccgtaagtaaaatttccatgttctattttactttctcttttagaattggctggaattccaggatcagaacagttgaccactaaacaaatgacaaattttgaaacatatgtttggaataatatacatatacctatatagatttatattagaaatgtacatacttagtttcaaaagtaaatttattcaaacaaccagattccaataataaaattaatcccatggattatctagaaaatggactgacatctatgtggtagaaaatacagaagaaagaaaaaaatttggcaacaattaggaaaatagcaactttgtaagtattgcgctaagtacgaattttaaaaatgacatattttaagctatagctgaactgtaagaaaacaacatgcaggagaatgataattaggttgtattttgtcatacaatatgaaatatacttctttgcaaactggaaaaacatcgaagagttctccttaatctgtttctatagattaaaaaaatgaataaagcctcaatacaggtgtactggcaagccaggcccacatatagttttcagaaaaataaaaagaaaataaatgccaaagcaaattgcaagtaaaaataatctcaattactttttatatgcagtcacaaaacagatacaaataagagagttagaaattaactctaccacttttaacttttaaaaatataagttacaaaagaaagttagaaattaactctaccacttttaacttttaaaaatatgttacaaatttagaaaaaggaaagcattgttaatgagatgacatcagtattaaagctttttgttttattagataaaaactttttactattctgctcaagctgttttaagtgtgtcactgatgtttatgtgaatattattatcatgccaccaaatgggaatatacttagacatttacctttgcacataggtggaggatggctccactgtctgttggcctggcactgtgcctttgttggcccttgcataagatacccaatattgcatgagaatgttaccacatcattaaagttgaacccatttccacttgttcttccataaattggactaccagggtgaccacagctaacagctaataagatgtggcaggaggacagggaaggaaacacagaaaaaaaatatttagttatcagttattgcattattgattatacttaatcatttcaaacaaagtagaaagaagactactttttatctggaaatatacggaaagtacatttactaatgtagatgaacaaagtagaatgtcaaaatagtctaacagcatgattatattagtaaatagaaaattatttaaaattgtgataattttatgcaagtggtacatagatatttaaagtttcacggtacctatttcatcctttctctctactttattggggaggcaaagagcagagtattgaaatgcaaagaaatctggggaataattaaagttcatgtccatacctaatagcagaaaagaacaaaactagccaggtgtggtgactcatgcctataatctcagtgctttgggaggccggggtgggaggattgcttgaggagaagagttaaggctgtagtgagcatgatcatagctatgcatatatatcatagtgagctatgatcttgccactgcactccagactagatgacagaatgagatcttgtgctttaaaaaacaaagttaaaaagtagaaaagaacaaaactgcaccagttttccttgtctagttaataattgaggatatttaaaggcagttttttgcatttaattttgaaatagtgctttcaatattatttgaacaaccaatttttatgaataatagattgataagcaaatgtgtgcttgtgaagtaaattaatgtgactacataatgtagaaaatagaaaatgatacacaaaggctgcattaggatattcattaatattttgagatagtctcaaaatattctctaaatcaatcttactggtttcttcatcactgatatttgataatataatttttcttggaaataatattcttaattaggttcttttaatgctgtgtcccactataaattttacatagtgctggctttccccaaacactatttctatgaactgttttattgcattatctcactctattaatcagagcaacttcagtaatagtgcttcctaattgggcacaggaaacgaccacagtcactttcagtacttaggaaatgacccaagagcaattatttttcagctgtattgttaatgtcaacctacccatttgggaatttaactgcatcttattctggtttaaaattatcaataaagaaaccagttttaccctaagggccaattctcatttatagtctcaattattcaacaagaaaaacagtggtattaattggctatgcttgaatataaatgaaaaagaacatatccagggcagacacaagcaggatattgttgtctttaaatcatcagacaatcaatttgcttggggggggtgtaggggtggaaagtgattttcattgtcagctagatattctattatcctattatcataaccatgaaactagatgttctattatcctattatcattaccatgaaactagaatttctatacgtttctgtggattggatcaaaacagtattatgaccgaatttataagtatacatgcaattggtcacagattaaatgaaatatttcctgtgaacgcatactaaaagtcccatgtattgtttatctgacacttccaaaatctttatcctatgatcctattataattacaacatatttacagtacttatttactaataataattttaatataaatgtccgttatctggagatggatattattaggtgaaaaatataagaaaaatgtagttgactttaagatccaaagtaggatagattgtgatctgaaacactaaatacttacggggattctgagatgtactagagtttatcattattcagctctatttttattttcataatatagcagtcataataagtgcacaatggccaaatccacaacatacatataggaagagatccattaaaaccacaaagcacagcaggtatatttaagaaataatgaaaagatatttcaaaatacactttattcttcatctgtgaattcatatctaatcaacctaaaagatcacatggatatatgtcgaactggtgagatctttttaaaatatttctaaaattacatatattcatatgttttgtatgaattttaaaatagtgtaaacagtgctttaaaataaacttttatttattttctttttatctgctttttaaaaaattatttcaatagtttttgaggaacgggtggtgtttagttgcatggataagttctttagtggtgatttctgagattttggtgtacccatcacctgaggagtatacactgtacccaatgtgtaatctctcatctatcactcctctgctactctttctccctagtccccagagttcatgatatcattcatatgccttcgcaacctcataaataatttttaatttttttcagacaaaatatagctacgttacatatgtgtaatcttgatatatttaaaaatgcaatgcattttgaggttaaaagatgacataatgataaacatcttcaaccacacactctctatataagggaattacggcccagagagattaaacactgcattagctcacataatcatcagaggacctgaaatgagagcaaaggttcttcatgtcatgcctaatgataatatattccccactgtgcttcatcagtatataatcttgatgtcatgacagtagtatcataattgttagataatatttatccaaaatattttccactataaaaagctctgtaatatcacatagtaacaaaccttgatacagctacacagtggtctctagaaatttaaacccttataattacaaatgtgttgataatgtgtcttccatataagaatattaatttatcaatattatatatttatattaaatatgagaagagctaaatttaatttattatcttcatgataaaatataactgaaattctcttgaacatattccactttaaagacttttgcatagcagtatcaaattggattgtggaaatttactttatattgatatatataacaacataatatatatattcatcttgcctaacaaaaactagaattattccaaagatcagaggtctctaattgcttttgccatgcttacttacgcacacaggatgggagctgaccagaccaattgtgatcctgttgacatatcctcactgaagaaccaatcaatcgaaaaccaggattacattgatatacaactgtgtctctatatccataattttctccaatgacttgaccattcacaatcagttctggaattccacaatgacccgctgaaatacgttataaagtaatatttttaatactgtgatttgttttatttgtatatttatatacatgtggaacatgagcaaacctttaaagttgtcttaaaagcaagcaacaaataattcaattataactatatgacataaaggtaactatgaaatatttagcaaaacaacaaatatatggaaattaaaagaagacacgtgtctagtgacacttgggtcttgaagaaattataaaatatctcaatgtgtaaaaatgaaaatataggctgggcacggtggttcacgcctgtaatcccagcactttgggaggccgaggtggcagatcacgaggtcaggagattgagaccatcctggctaacacgatgaaaccccgtctctactaaaaatacaaaaaattagccaggcatggtggcaggcgcctgtagtcccagcttctcgggaggctgaggcaggttaatggcgtgaaccggaaggtggagcttgcagtgagcgcagatcgcgccaccgcactccagcctgggcaacagagcaagactccacctcaaaaaaaaaataaataaataaataaaagaaagaaaatatatcaaaatttagaggtacagataaagcattacttattaaagaaattaataagtttcagtgcttttagtagaagaaatagagatataaaagcaatgacctaaaactccatgttaagaagaagcaaggagcaaaatgatgtaaaaataaagccaaagtaagtagacagaaggaaatatttaagattacgaataatagagaacattaagttaaaaattctttctctaaaaatagcaacaaaattattaaactcttagctaaccctattaacaccaaaaaggagagaataaaattgtcaataacaggaatgaagtgatatcactataaagccttaagaaattaaaagaataagggaatgctaaaaacagctttatgccaatacattttaacacttcagaagaaaagaaaaaaaattctgtgaaaattataactcgccccaaaactaacacaaggtaaaaatataaaaatattaatagtttttatctattaaaatatgtgaattcttaaacaaaaaccttcccacggatttttttttttggctgggaaattcaagcttttaatggggaaaataattcttatgcaaactcttttagaaaatagaaaagaaaaaatcacctttgaaattattttatgaagtaatcattaaccccaatagtaaagcctcaaaaaaaaaaaaaaaaattaaaaagtaccaaagtccttaaatgattataaaggaccaaagtacttcataaacagagatacaaacctccttaataaaattttagaaaatcagtctagtgacatataaatgataatacatcatgattatctgggatttatccagaaatgaagtttggctaaatatgaaaaattactgtaattttgacataataaaagagaaaaaattctatgtaattatttcaatctatgcagaaaaagtatgtagcaaaatgcagtgcctattcacgattaaaaactgacaacaaattaggaatatagggaacattctcaacccaacaaagacattgttaaaaaaacctccagtgcaatacattaatacaaagaagaaaaacagcacaatgttgggaaacaaaatagtgaaactgttctatactcaggtaatacgtacgtagaaaattatatttttaaaacatcttaaactagtaagtgaatttagaaaggttgtagaatattaggtaaatattttgaataattgtattttatatactgacagcaaacaattggagaatgtaatttagataaacaactttagttgggcacagtggcttatgcctataattccagcactttgggaagctaaagcaggaggatcttttgaggccacaatttcaagaccagcctgggcaacatagcaagaccctatctaaaaaataaaaaaagaacaattttactttttacttacaatagtaaaacattctggggaataaatttagcaatagcacattctatgctaaaaatacaaaatgttgccattgcacaaaaaaaaaaaaaaaaaaaaaaaataagtaaagacccaaacaaatgtactctgttcatggatcacaagactcaatgtttttagaagccaattttccccaaactgatgaaaggattcaatcccaccagaatctctttgtagagtttcataaactaatataagatttatatgaaaccgcaaagtgttatggtatccaaagtgattttgaaaattatgaacaaatttagaggatttacatacatgatttcaataattattatgaagttttttcaataaatagtgcaagatacaaagtgcaagtaaaaaagctcctcaatgctactatgtaacacataggaattaaaaataacattggagatataaaagttaaagctaaaactataaagcttctagtagaaagtaaaacaaacaaaaatgatagactttaccaaacttgaaaattcctcgttgtcaaaagatgttattaaaaaatgagtaggcaagtcatagaataagagaaaatacttataaaacacataatgatgaaggccttgtaacaagaatatgtaaagaactcctacaattcataacaaaaaggcaagtcaatatactttaccacttcacaaaggaaaatttacaaatagccaataagcctatgaaaaactgtgcttaacattagtattcattaagacaaaaaatattaaaatatcataggatacctttatgcatccaacagaatggagagaaaaagaaagttggctataccacatgctggagagaatgggagacaactagaactctcccacatgtattctgttgtgagtattcaagagaaatgaatgcgtatgtccacaaaaagacttttacatgagcatgcatagcagctttattcataatagcctaaaactggacatagcccatgtatccatcaaaaagagaatggctgaaatgtggcatatttgtacaatagaatcctattgagcaataaaaggaacaaattacagatatgcacaacagcatagataaaagagaataaaagaagccttatacaaaagagtgcacaattttcaattccatttaatgaatttctagaacaggggaaatgaatatatggtgaaaatatcgaaatagttactgcctcaggttatggaggaggagagttgcacagtgaccgtgaaggggcataagaaaactttctgaggtaatggcaatattctatgtctttatagtggtttagttacactgatgtatacatttgtcaaaactgatctaactgaacttatgatctatgtacttcactacatacaaattttgccgagtttaaaaaaaactttgaacaaatactgaactctagctaatggtatgcatgcttaatatttggcaacaaagtatactgatgtttacaacttatttcaaaatgcatcaaaaaaataaattaatggattgatggaggcctggaaacatggatagatatgtgataagcaaatatgaaaaaaatgctaattgtagaattaggtggtaggcatatgggtgttcactgtcaattcctttaattgaaaaattcataataaaatactaggaaggcaggaataaatgcaccatacttagagaaacaattataagcacattctcatggccgttctaagctaaaagtgtctgaggttacacaaactagttgagaagaatgaaaccttaaggtcaattcacagtgtaatattctgggatttgcttgtttggtaactgtactttcctcctaccaacatccttttgcatttcattgtatataaacactgtattctctacaatggatgatcttgtctccttagactaagaggcaatattttcttataaatattcctgttatgccctgtctttccagagaacagaatcaagattctaagtaggtgaataaaaccacatactatatacaatattaaataatatataatacacaataacaattcatgagagcacatggccataaaatatagtattttcaaatttatatgtatatttaaaatgcttttaaaatttagttttattttaactatattttaaatatggttcattttaaatataatattttaatatatatttaaatattttaaatattgtatttaaattatatatcatttaaatatagtattttaaatatatatttatttataaatgtatacatatttaaagatacatgtaatatataatttaaatacttgagtatgtataaatatatatttctatataattatatataaatttaaaaatttatatgtaaactaagtttacttaaaaatgcataagtaaactaagtaatctgtaattgaaattagtacaaccaaaatcagtttacaaactattaagattttttatttttttgagtttttatttgattatataatcacatattaatacataatcatttaactcattaactattttctgttttcttcaataatcattgaagtggcctcatccatatgcccaaccttatccaatgggagacatcatgactcctatcctcaccactctgctctgtctaggtgagacttaaagaggaagaggaaagacactagtctgagaggaactccatccctagccagagcctggtccattaatgaccccagagactcaggagttccctgtgtatattcaaatatgtgtgctcttataaagaaattgttgctgggcttccaagcataactattaacaaatgtgcctgagaaggagaaaaaagacattttaaccaaaacttctaactataccatttgaaatttcaaataatgattgtatttctatgaatattttcaagcttattagccacacaatatataagtataaacttttctgccatgtgtcatattcttaaacagtaatattttaaagacaaaaacactgtacaaattttgccgtactctattcatgataatcagcaatttttaaattcgtaaacaaaaagatcttgccttacttccaacagataagtgaataatcattagaaaaattttcattattacctaactcaatacttgctgtcagatcttgaaatcattttagagaaaacaaagcataaatagcataaatcatactattttcttaatattaaataaattattgaaatctttgaaaaaggagataaagcataaaatataatattttcataataaaagaggcagggtaagaagaacgaactagttcagtttctttaactgaagattttttataataaatactctaaggggaaaacatcctaattgcctaaaatcaggttcaaaaaatttttttttaattttaatagaaattagttttatgcatgttgaaatcttatgaaataaaacggaagaaaggtacttaaatacacacattacattgtttatcttcttcagtcattaccttaagcaaataggtgaaaagagaattgactatggtttagaatgacttaatagctacagcgattaatccagctgagtaagcaggcatacagttttcagcaattagttttcaccattatattttcaccatgcctggaagaaaatgtgtctctccttagatttcactaggaatgctatttgattattccgtttagtagcttttctatcatgagccatttttaaagataagtattttctggtttttaacatacttactgaatgaatataaattagtatctcatattagggaaaaagagatgcctcttttcaagggtgaggggcagggggaagtttgacaaaaacaaattaaaaatctgtacctaggcatctggtttcagattcactccaaagacctgaggaaaggcattcccttacagcagagcccacaagcatgaatcccaagtcgcaggtaaagatagctgttgagccatatgaagtttgagttccaatcttatttccatttggaggtgtaggtagttctccacaggaaataactttaaaatgataaataaataaaaatccttaaagatatagtcaagctgcacttgtaacaaaactgtgctttgaacattttgagcttcctatgatttgatgtatttacaaaggaaattggcatttgtaaaacatgtttgaatgagtgtgaaagtagggagaaaagagatgacataacgtaaaatgtaccctctttaagtccccatagaaccttctaagtaacagagacataaagttctttttttttcattttttttttttttgcatttttcgcttagtcaacctggctatagtggatgaaaaacatcacaagtttaaagagatgataattcattaatccaaaatctttctctgctttatcaagtaactttgggcaagccctttgacttacctgagccaaagtttcttcatatctaaaccaacattaaaataataattacaatataatttttgtcaagaactctatcgtttgagttttacatgtaaaatatttgattttcatgagatccattagatataattcatctgttttttctaagttttaaaaaattgaagaaaataaatttaactggcttgctgggtcatatagcatctcttatgacttcttcatatttgaagaccacaaatgaactgtcattctagcataaaaacaataacagatcatgttcattgggcttgtattatgtactaggtgctatagtgttttcatttatgtaatgctcaaaacaactctctaggttttcagtcttaagttttagatagctgtcaggtagagaaatagaaaactttcaaacttgcaagagttgcatatcaaatttaaaatgtactgatgattttgagctcatccccccaaaaaaaatcatttgaggtcgctattaatattattgatatactaatattattattaattctaatatttatattattttcatttaaaagatgattaaatggaggaccagaaaaaaaatactatttttttctttttctcaattaattgcaattcctaaattccttgccattccctcattcttacctgtaggcagtaacccaaccttattcatcctttaaacaattctacatagtaaagaatctaacacaatggaatcaaacatttgttgaaaacctgattaaatgagtgtttctgttgtagataataattacctagctctttgaaatattcctatccatgtgccctttaaaaacaaattattctttttaaacaataatttggaaaaaacaaggagtctgcagtcagagaaaaatcctgggaaaaaaacttggaggactagtacaaaaatttagaaatacaggctgtgcgcagtggctcatgcctataatctcaccactttgggaggttgaggagggcagatcacttaaggtcaggagttccagaccagcctggccaacatggtgaaaccccaactctacctaaaatacagaaaaaaattagccaggcgtggtggcaggcacctgcaatcacagctactgcagagactgacagaattgtttgaacctgggaggcagaggttgcagtgagctgagatcgcgccactgcactccagcctggcagacagagcaagactctttctcaaaaaacaaacaaacaaacaaacaaaaacaacaaaaaaaaatacagatgatggcacatttttacaatattaaatataatttagaaatatatttttaatactttaattcattaatgtgattatcttggaacacagggcaaccgaaaaattctatactgatatagagattcaaaaaataaatttcaaatcagtgaatattcataaataaaataatatcagatacttgtgtacttattacacataagatagttgtctgctacgttaaacttcttaatcataataaccctaggtagacctttgatctctttattagtttgtctataaatcatgggtctctatgcaatatataccatagagttgtgttggacgctaattaaaagactgaattttcgcctagcatatttcctgaaacaaaacagacaataaatgaatgtaagaaagggagttcaagatatttcacctgaatatcctatgttctgttagcttatgtatattagatactggccatttatattataaaaatgtatggaaataaaacgccttaactgctcaatttggttcaataatatttattgaggatgtggttatagctggtatttcaattgtgtcataccattaaatgtttgcagtaactctacatgacaggtgttataattttctagttttaagattttctagttttagaatttggaatcagagagaataaacatgatataacatgataaaaagtcaagggttttagtcaggctacttggtcaaatatcatttctctatcatttataggctctctgactttaatagaatgattacatctggggcaaaggtttttttttttttttaaccaaatgagtataaaacatataaaggactaaaagcagtgtctgtcaagtagtaagtaatcattacttcattgttaaagtaggtaatagatcaacaattcaaacactagatttcttaatccaaagcccatgtttttctatttgctagaaaagcatttactaatacatagaaacatagttagaaaatttaaaaacgtaacgagaataaatgaccatattagtaatgtcatccaattattgatctaatgtgtttatgaaaggaactgattcaaacaattcgataaccaaacatagcttatgaaataagtttagcagagtgtatacttactttggcaatatggtctttcatttctccaactccaagtaccattaggaagacattcgatggaggcaggacctagtccatgataaccagggtcacagctgaaaactactttggttttgtattcataatgggagccattcacaattcgccatcttccatgttccaagataaaggaattgatgcttggacatgtaacaactatacaaaaaccaaagggtgtaattgctaacaaatcactatatctcaacgtctattccattctttacatctccactgacctaattcacttactcttgcactatacaaggtcctttagcatttgttctttatttcttttgcatgttgatattttccattcccctagctatatggtattgctggcagtctggaacacactcaatggtttcacaattcaatcttgtacttattattctacctacttagaatcccagttgttggcttacctctactcccttatttctttataagtttagaaaagactatattttgaggaaatttttttgatgtgaatggcctttttgtgcaggagtagtgatatcaactttagctaattcaaaactttttcaaggtaagtagaagccttattagaaacctatgctgagagtgcgaacaacttaacaatcttcattttaaatgaaatcacaactaagtggaaatgctagtactaaatgggaaaaaataatcgaaatatagagaaaattcaagagtttattcacatcaatattttctattttttgctaccaaatctttaccagaattaatgtcttatcattatgtaaacttatttacctagtgaagtaatagtgacagcaataggaactcttctaagtgtaagtaaacagaagaatatcaacaaaagtttaaagttatggataatttttgcaacattatttatccttataaaatcagagtgaaatatgtcaaaatataattttattaacacagtctttaaaaattttctcaaggggccatgtactgaaaacacatgttgactaaaggatgactttttacaaaataaaacatcattgtataaaataaaagtgccttttttgacataaatattctgaggttttcaaaaatgatggaaaagaccttgtactgtcttctagtacttcattgtacaagatagcttacttaacttttatttctgacttagacatcacatttcagtttagggattggtttttataattctaaaatacataaaatttcaggtatataaaataccaagagaaaaacaagtgatgaaattcccttgacacacataccaacacagcgaggggtcttgttatgattgctccatgttccatctgattggcatacagctgtagtgagttctttggatgacaatcgatatccatcattacaaaaataggtaactcgcgttcctaccaaatagtctgttgttagtattcctccatttgttggagctttaggaatcccacaggaaattgctagaaaaacatacacacaagcaaaatcgtataaacagaaaaatgtttaatttattaggtaactctgctgaactgtaaaacatgcaaaactaacggggatttttatcaattcctctgaaacaatctcagaatcacagaaatactttccgaaccataaattttgaataatttattccaaacccttatttagcaatgtttataaattgatgaatctatacattgttaatgctttatttcttggtttcttacttaatttctggtgatcatgtgcatggttatcagcatttgtatggattatatgagaatgcaagttaggtaaagagtatctctaatgcaagcccatgactggaccatcatatagcaagtttgattaattcaatttgacagataaatattaaatattttaaagagagtggcaaccaatatgaatcataattttggtcaggaataaatcaaatagatttattttacctgaaagctggctatttctgtcttagcagaagccacaatgtatgagctggggcaccatccacaaagtattgtgtatattggatatgtttaataaatacaaggccaggacttactgtcttaaaaacctagttaggatcttcctgaatttcactgatgtgtcttagatgtcttgatttttatctacaatacatttgatttaggtgaaaattagttttactatgatgtgataataatgtaaaatgttatatttgcctagtttgttgtatatattttatactttacaattttaaaaggctacagaaaaatcccctaaaattgattttttaccatttttgccctattaagtacacaattggcacttagaaacagaaaaaaaaaaacacataatctttcaaataacatgtacataatctttcaaagtatatatttggtagcaatactcaattaaagtcaggttttttgttttttgtttttttttgagacaggagtctcaatctgccgcctggctggagtgcggtggcactatctgggatcactgcaacctctaccttctaggctcaagtgatcctcacacctcagcaccctagtagctgggactacaggtgcgtaccaccatacttggccaattgtttgtttgagacacagtactactctttttcccaggctggagtcagtggcaggatcttggctcactgcagcctctacctcctgggctcaagcagtcctcctaccttcagcctcctgagtatctgggactacaggcacgcatcaccaggtccggctaatatttgtatttttttgtagacacgggttttcgtcatgttggccaggctggtctcaaactcctaggctcaagcagtccagtggcctctaccttccaaagtactgggattacaggcgtgaaccactgcatctggccctatgtgtatctttatatatcactctcagagtaaatatttatacatatctccacataaggactaacgtatttgaatatgagtgtcattccagaaccaactggagttatgtaataactgatagatatatgtagtgcattattgttataaaatgagaaagcttctgtattatgaaagatatctagcttacacgtttcatacaaagaattacagatttatattttctctcataacagaagaaataaactacagaaagatgagtttagtttaaatattataaatgctatgtactattcacccatcttccatttcgaccaaaaattgtttccacttctcttataaaatctaccatttgctgcttaattttcattaacccacgtaaattaaatataaaatgaaaaaccttagtgaaatctttacaaaactgtcaaaactgaatggcagaatccctactgctgaataattgatcttctgtaatttggtaacctgtaaattatgaacagaaaagctgtaacactgacttaaaatacatatgcaatctcacataattatgttattatccctgctttctaattacagaacctctaaaatagtgttgaaaagtaaatggttccctgatgtctgataaagcaatgtttatattttcacttagaacttttgggaatttcaagttgttatatgccatctccctcccaaagatcatgtatttactgatttttaaaaattaactattcattgttggtgtagtatagattgaatctaggtcaaagtaaaaagagatgtagttaaatagtatagattccacatatatgtttagtaaaatgtggttctattttagaactaaaaagagacaacgtaccagaataatgggacaattcctgtgcctatggatagttaacaatttaacttctccgctaatttttttaaaaagaagaaaagaaagaaaataaatccagttcagaagaaaagtcatcataattgagtggttgtaaaagaggcttgtctatacaactctcaggaaatcacaaattaaaagtgagacggaatacaaagtgagtttccacgtaacactacataatatttaattatattcatgaggattgttcaatttttgagggggggatcaatagttatgtgatgagaacaaaaataaataaaacacctgaccaaacccaaatagatatagctgactaattttctatgtttatcctcatgttgtgtaactttatagctcaagtaaatgtatgtcaggatgtataagaagacctaagaggtaagagaaagaaaaatgactgaaaaatgcaaaacaagttgaaataaaaggtgcattatgcaaatagctcttccaaatgacatacaaacatttcatttcaattagtaatgtccaaatagaggtcatatcctgtaagcattttttcttaatcttttttaacaattagaaaagatcaatttttggaaatggctacatgatttacatatattttatcattttacttcaccaaatatctcatttttaaactatatttcaactttcttatttgaatttaaaacaattttaaattaaggacattgaaaaaatgactccatatgtaaattacatggaatatattcaatgaaattgtagcactaattctacaaagcaatttcaaaatttcagaaagcatgcggtatttttattttacatgatagtcaattattctcacaaaatgtttcttaaggattatatatgtataccatataggagtgtgtatgtgtatgtgtgtatataaatataaataaaagcaatcattatgtaactaaaatacaaaagtttaaaattaaaaacaattaaaattcagagcatgttaatggttatttaaaatatatatattataagcttattttatatcttttaattctattatgaaatttgacatcaaagattctttcccaaattaattctgggaaatcagttaatactaagaactgtaaatactcctgctattcattggtcgaaggaaagcagctgttttaatactttattaaaatgtatctattctgcatgaagtaaatgccttcagtgttgataacccattaaggtaatggtgcttcccagaatcctaataagtgattaatgtttccttgcatcaatacaacaagaaacaataattctttcattttgcatttgtttacatatgcctttgaaagctatccttttatgaattataaattgcactctaataggtaaaagaagccatttcaagtgcctggtaatacctattctttagctaattttaacttattattggttgattttaaattttaattacctatcttacattttgttttttataaatgcccaccaaaaaataggtaataagtaagacttcttgtttattaacctagagtatcctgcattttttcatgtgagaattcaaagttgctatctgcatctttacatgctgagtagagttaaacaaaatacaaaattaattttcatcttgataaaataatataatgaattaagtattttaaaattttcaaagtccaatgacattagcttttctgcgtagctgatgttgagcttgtctttatgactatgactacacttacgtaagagactcaactactatttaaaacaagtctttttgttttgttttgttttgttttgttttttgagatggagtttcgttattgttgcccaagctggagtgcagtgttgcaatctcagctcactgcaacctccgcctcccgggttcaagtcattctccggcctcagcctcccataaaaacaagtcttaatcaaaaactctaaaacatgcaattttttgattaacaagcttgttattctttttgcagcatgatataatgctcagtgcctcgacttttgacaaaatacaaagaaaaataaaaaacatatctttgatatctctgttgtgttatctgtaccactgaagaaaaaaaatatccaggtggtgggttacatttttctcttaaatttgttgctgtgagtgcaaattttggatgctaagagtgaaactcagtcttcagtgtacttgcccattcttattctctattacctctctgcagacttcatactaactcagtcttcctctctttcaataattgtcttaaaacaaagtaactggaatggaggatgtatgaataaagtatgtatacaaggggaaaaagtcaaggcatataagttgcataacaataatgaataattataaaacagtatgtttctttcccctggaatttatcattctgcaatgttatgccttgtttttatgaaaagagttcacaatatgcttccgaatatttccattctcagaaaagttagtgatccaaataaaaacgttaaatggtgctaatctcacattcatgtttttgttcattttggcataatatacttcaccttgacaggcagggactggcgcatcccatgcatgatacccataggaagactttctgcacacagcactgctttttccaacaagtcggaatcctcgatcacaggcccaacggaccacactgttaagctgcccacctgtctgactgataatatatccatgaggtggggattctggtgtactacagtagaaagcttttcaaaagaaaaaaaaaatgctgtttaattaatgaatcagaagttattacccaaagtgataaacacctatacagcgactagtgcttaaaagtaggtcagtggtcatctatgtaaattttacttcatatgaacaacatattgtgctctttcctcttttgaaaatgatctactgacacaacttttgggagacataactaactctgagctttcttccaatttatattgtcaccgaaaatgtcttctgaattgaaatgtattttcttaacaccctggaggttcagaagcccaacaaatatctaactgaattttggaaaccgcatttcctgtcatttgagggacctatatgccacagccttggtagcaatattttagagcatgtcgtttacatgtcactttgaagttatatccagacacctctaccatgttaggtcatacatttcattttggttgatgtctaaaataagcccccacattccataatcctctttcccagtctattaaagtgtgcccattctgtcaagagcgtttacatattatgatacaaattgccaataaaataaaaaagttttttcatctcctgatgtttgaaatgccaacagatactgtcaaatagctttttcatatgtacttttgagaatattcagcatggcaggtcccatttaccttctgaaactttaatgaattcatctgagaaaaatggggctttgggggtaaatagtaagaaacaaattggacttaggatatatatgtcataacctgtcatttctaaaggcaaaaatacatatttaatatgtcaagctgttcttgagggctaaaagtggtattttcattatattaatatccaactttgtcataaataataagaacaaggattggtctataatacagtcaatctaatacttacaattgtttaatttgaatagtttccttttatgttatcatgtatcatgaatttaatgtgctgacttttaaatgccctatttgggcaacactttaataaaaagatatttacattgtttatattatagaaacataagctcaagtatgaaaattcttcaagatgactgggtgtatcatatagttcagttttttggttttttttgagaagaagtttcgctcttgttgcccaggctggagtccaatggcgctaccttggctcattgcaacgcccacctcccgggttcaagtgattctcctgccccagcctcccgagtaggtaggattacaggtgcccaccaccatgcccagctaagtttttgtatttttagtagagagggggtgtcactatgttggctaggctggtctcgaactcctgacctcaggcaatccactcgcctcagcctcccaaagtgctgggattacaggtgtgagccaccgcgcctggccatgtttcagttttttaaaacacgtctactttgattgcataataaattatttttgatttaatagaaacattgtaggatacaattatgtacatagtagtaatatgctgtcagtcacaagttattctaatatgtaaaatacaaattattaattagttaaaatcaaactatcatctcagagttttaaaatcaagggaattaaacagaattattctattcatacattttatatgtagttgtaaatttgtataaatgagtaaaattcaagagtatactttttagaactgaaattcaaaatgtatctgtctatgcccggaatcatagtgtcagagtttataaaacatttataaaaggaattttcggttgaattgattaccaatgacacatgatttgggaagcatggtgtgaacactgtatagaaagagacagctggctgattctgagggattctgctattgagcacatatccatggcctctgacatgatttagaatggtctctgacgtgatttagaatggtctctgacatgatttagaagggcagtaaagaaaaggaacataaccttcacataatagaggactatttatgtacatttactcaacaagaaaattattggttcagtatcagtagaccctataaacaggaagacataatagaaaaatctatgtcatcttgctattaacaagaatttccagcctacatctttctaagcatcacgcaaggaaaagcagtagcgacaaaacgcttccgtttttaaaaacggaaggtttgtaaatgatgtgttactctctctttcgacatttaagatattttagcaagtatcacaaatagatggataaaaattaaaacaaagattttgacctctgtatgtttatcctttgttttaacttgtcatttaaaggagttcttaaataggtcagataacacacagctgagcaacactattaatattttttgtcagttcaaagaaaacaaatctattttttaaagtattaaaaatcacagtttaatttataactgacatataagtcataaatatcctaaatgcttttttaggattttttagtcataaatatcctaaaatgcttttaggacatataggataatttataactgacatataagtcataaatatcctaaatgcttttttaggatattttacaaaatcatatgagggatgtagaattattatcattacaataggaaatagagaggttacataaattgtccaggaaccatcaatggaggagctgtgatttgaattcatgtctaactgaatagtgtctctgctccttaatcataatcataccgaagatgatagtgagatctgtcctgaagttataagttttacatacctatatatcttatccggaagccttttttgttattgccatgatctgctgaccactgaagaaatacttcatgaccattgcttgttatattaaaagcagatgaataatccccactgagggaaataagcactggactttgaatatttggtcctttgggaagaaaataaaacaatttagataaagctaattatattctcatttgtctttagtattttatatctttagaatagtattaaatatggttaaattgcttcaccaccaatctacctcattaacaataattgaaaacataaaatgtttgttttaagcattttaattctatagctaaatgatgtataatttgtaaaataatagtggagctaactataattttcatatggtataggagtgaatttaatgttggtacttctaaaaatatctgtaagataaactcacataagcagctgtttatactcaaagtttacatgtataattagaacatttgtacttaattgatgaatatccaataaatataacccttggttaccatcatacacctgaagaacatcaaattccttttctgtctggaagaattctacaaacatggtgatattataacccttttccactgaaatgctccatgcacacatttgaagatttgggtaactgtcaggatatccagggctcaatatgactccagtagaatctagccgtaattcattggcaggacagagcactgtcaaagaaaaatgtcattaaataatgccagtcttttagagcctcagtgaaaactgtattttagatactgagtattctgctttcatgttcaatagctataaggatgatacgttgaattatttgttagaagagacaagttgtattaaacttatgattcaaaagctggaggaatgacctaaaaatttatagtattgatttattttttattacatggaagatgcaccactttctggacataaataaatacataaataaaatataagccatttaatgcctcctctttcttcacatttttcccaacctctcctaatcttttgttctcccacctctgcctgtcttatctatgtccttgctttacctctttctttccttactttttaactcactctcttctctcttaaaccttctactcactcaggtgtgtggggtcagatagaaaactgtcctctctcaaagtattcatttcaagtaaaatcatttctgatatcaggtatatgtttaccatgaggatttaacacagttctgagtcaccagttgcctttcagctctacactatctccagcccataaatgtagcccaaagcacaaactctttttatttaataatatacctctgctttaatataatatatgtatatatatcaacacactataaaaacacataaaatgtgttatacattgacaaaaaacataattatggtctaacagcctgcaacatatagcaaattttagttgttggcatcaattgcattctgtatcagaccaaaattatgaacatctacttaaatttggatttagaatgaagaatatgactaagttgatcaatccctttttactcaaattatgccattttaatctcttacaaaatttttttgaagttctgtgatgtggaaagagtattggaattatttagtatggtccattgtgcagaagtaaaccaatatgcaccaaacaggatttgcttcaatataaggaagaactttctatttgtcagaatagtataatggccatagtaaaatgtcttacgaacataattgctaaccagttttaaacttagactggactatcttttgggtgttcttactgagaacatttaggcaactgaatgaatgggtgaactagataattttgatgatttggttaattagaaatatatcccatgcaatttcctaattcatctactataccttagctttcattttggagttaaatagcattgtttctcaaaataattagagcagcactttaagaagaattcctgtttttcaatgtttatttgaatgagttgggattgaaaactactaatgtagttgctggaatataataaatagatgaagaacttatatattcatagtgttcagggtacaaagacaattaaatatttttgagttataaagtctccaacaagtataggagtagaaaagagtaactaacatagtggattatggcagcatatgatttctctataaacatgttaataacttgaaaagacttcttgaaaacttgaaaaccggccagaactaacacatggctttttgaaaactgactatataatagagtttaaaatatagtatagctaaagctaagagctgttttctactttttttggatattatttcagtttcttctacttcaacctgggattttccttcatggatataattttgagattaaaaatattgcataaatggtatcaggtcattctttctccacctaaaaagagaactctgacattgattttcaaaaaatttaaaaatacataaaaaagaaatagataaacctgaagattggaaatgatatggaatatatgagtcaaaggccaaaaaaaagtaagtatgtggctacgacatattgaaatgactggtatgatccaatatactttactacaatacacaaattaatctattctcacattatctaacatatagcaagaagcctgacagccaccaagaataacagtaaatatttgttgattgtaactttatgttaggcactgttaaacaccattggtacattatctccgttatcacaactttaaaaactgtgtatactttttatccccattgtacatatgagaaaactgatggccagaaagtttaaagtgctcaaaatctcctagattcagttgcagccaatgtttttaaaccagaaaatgtaagcatccattaaatttcatttacaacaaactctttacagaaaaccatatctggaattattttccacattttaagtgagacacatagagctacagagcatctagagaagaagagagaagaaaaatgatactactacttttttaggaaaagtcaaaaaattttttaaatggactaaaaacgatgtaggttaattctagccgattccaaacaaatgactgtcttagcaagcttgtgtaataaactcaattaaacaaaaatgtaaagttagttttttggcttaaatgcctggtgaaataattaatatagaaactctacataaactcattctaaaggatgatttattaactttattagctagtatctgaagtgttatcaggagacaaaaattttctatgttttctgtattctccacagcagacagaataagttcaattactaatctacaggaaattctgatttggggaataagacattgaaagtctgagagacaaaaaactgtaaaatatctagcttatctgaatgttatatttactttaattcgtaaaaaattttttgaattgggattcagatataaaaacaagaagcttgctctccaagagctcacaatatagtttttattggagtcaagacagaaatgctgttatgtaattggctcattgacatatcctgtgtctgctcaactttttttcccatgtataacccctcaaaggttgagcctctgtcttctctatttgcatatctaaatatctgaacatgaaaccgacataatcctaaaggtctagagagtagccttacatgaaggaaaaagctgaatgaatgacatctaaatgtctggaatatgtaagtgatagacttcagaattctcaaccaacttcaagatgtcctaatagcagtaagaccatgagaaattctcacattggctccaatttatacccccacacccactttcctgcttttctttttgctaccatcaaagcctcctgcaatctttttatcttcttgaaaggctttcaattttatagtatgcttaaaaccccataataatcagaagttactttagacttgttatagcagctaagatactgcacaagaaacagatttccaaacgaaacctaaagaaggaattaatccaaaaaagctagaaagaataataaaatacaactcaattgtattcaacttaatcaacatttatgataattgtgtgttaggcactgttctgggcctaggggctacacaaatgaacaataaatgttttttgaacatcacagcttagcacatcattcaaggtctatctttgccttgctcttgtaacatagcgaatccttgaagtccatgccctgttgtttttcacttctctatctttgcatatatatctgccacttagaccaccctctctctagctctgttctaccagaataagactcattgtcatttggaattgtgtttcatgactcaggaaacaatgcttccatcaagctttccctaccccacaaccggttaaaaattatatgaatctacagcttcctggtctctttccctaaacactgtacagctatcccctgtatgactgccatatcccttttccatgatgcttccacagcgagggccacttaaaatttattttttgttactctgcttgtttgttttttccttagatcctcattgtgtaacaggtactcaacaaagtttaatgagtctagtggttagataagaagctctatctaagtaaaagcaattaacattgaaacctttatttaaagtgatttccctttctctccacctccattcccatccctaagagcaaaataattgaagtaagttgaacggacttcatgctaaaccagaaaaatttacccttgaaagaatcaaagatgtttaaagttaaatctgataaacagtggactatttctaaatgaaatagcacatatgagttataaaatgtatagcattgtttccagttaaacatttcatatttatatagatttttctcaatcatacctatattaagttaaacataaagcaaatatttaagaaataaataatcataggaaccattgaataccttgacaaactggaggtgctccatccatctgcagtcgttctcctaatctgcacgtcagaattgcattaccaactaaagtaaatcctggaagacactgatacctaataatatcacctattaaacaaaagaggggaggtttcatataagcaacaaggtgatgataaaaataaacaaatatttcaattgtaggagaatattttctcctttagttattttcaatcagtataaaaatgttattaggtataagtaggagttatattcaaaatattgaaaaaccagtatataatactcattgacccatcaggactgaaggcaaaagtgaactgccattccctctgtactggtgcatgctggctggatataagcaatagtcataaggaaataatttagttgatataggtgagatattcaataaaaatacaacaagtagttagaaggctttctatttattgaagttacatcggtcactgatagtttctttgtgtgtctcaaccaaaatcaatataataataataatgaataataaaagtttattacagcaacattaagatgtcttcgtatataattttttttcaaactgtgtggcattatttgggttgaatttccaactcagttttaaagcaactttatgattaaattgagtagaatcaactaagcattttccaagatatggaaatgaaatatgtcttctaatatggcctacaaaccattcattctgccaagtcaggcataggcctgaattcaaagaacaaaggttagaactatagtgtcagaaggcagcaaaataatagtttggaaagaaccatcagaatacagttaacggcttcaaattttaacacgttttcttattgtacattccagaaaaacaaaattaatttttcttctctaataatccctttcctcttttcactccttctcccttcttaaaaattctaaataatctctatcaacacagggaatgagggtctcaagacaggctattactattctgtattttggcttatttttaagcaaatagttctgccagcagtatgttttccttgaaaataatttaacagctttacctatttcaaattcatcatcttccgtcaaaatttcagcattgggcacaggtggtggaggttggcacacccttagttgataggctacaaaaataaacaaagtgtttattccttttctgtgcagctacatgtattcacatatgcaaaaaaacaagaaaattatggaaagttgtttaaaaaaataaaaataaattacataatttatcaagtgtcaattacatctttatttttaaaaatatactacaacattacaaaatattttcccatggtaacaatgcttactttttattctttatttcttacccttattctagtccttcttgttatgtggttcaaaacaccttgtttttttcctcctttgcatgatcacaatttggaattacgtattcatgtttgcttacttgctctgtgcctatctttcccaatactcatcactgaatgccctgcacttagcaaagtgcatggcatacagcaataattgcaaacaaatgctcagtgtttactttattccagacagtattataaatacttaactcaatcctcacaaaaaaaattttcttatttaatttatgttactatttctataattgcccccattctttttttttatactttaagttacagggtacatgtgcacaacgtgcaggtttgttacatatgtatacatgtgccatgttggtgtgctgcacccattaactcgtcatttacattaggtatatctccgaatgctatccctcccccctcccctccaccccacgacaggccccggtgggtgtgtgatgttccccttcgtgtgttcaagtgttctcattgttcaattcccacctatgagtgaattgcccccattctttaaaaaagaaaactgttaaagagagttaaaaatttgcccaaatcaagaagctataacgtgacagagctgagatttgaacctagatagcctggctccagagccttgtcttgccatgctactttaatataattatgagatatctgtttatcaaatgtcatgtttctaattatgatatcacttgaacagttcatctcattggattagattggcatttggcataattgaaaggccaccacgacaaagtctctatgaatccaagcttcatgcctactatcctcacatgacatctaaaatctacaacaaaatcatttgcttgattgaagtctttttttttcccttaaagtcttctaaaaatgtactatactcatattcattcaggaaacatgttttatactattataacatctgaggcaaattgttttatatgcctatttttactacttaaacttagaagttctttatgtactcaacgtgctgataaagagaatgagactcaaaatacacagtagcttatacaagagcacacaattagtacaggacatagccaaaaactgaagtgtatatcctctaatttcaaagcccattcaacactgcttctattgcaaaaaagtattatgggagtattgaaaagcatcaactagaccagctcaggaagactcctatagtaggaaaagaatgagatatacttgaaagaaggagtaaaatttttccagttctgaagagtgatcctggggagaagagcatttcaggtggaggagaaaacttgaacaaaaacttgtgcaaagcataaaatcattgattcatcatcatctaacaaaaagctatttataagagattaattggctaataaacattcaggttactaaggacaaagaaaagaaagacttttcaaaatgtagatctacagtgatgaaacaaccaaaaaaatcgtgttttaattttcttctgcaaattgttttctgtcccttcaaacatcttccttccagtagtttaacctgtttataaaagcacttgctgtgcgtggatgttaacttgcaagtaaaacaccactgtacagaagggttactgctagagaagaaagacttgctgggaaagaaccccatggcagaaagtataatccagatttttgataaaatgtttggtggatagtaattaggaattttgacaattgttttcctgaacttatactttaaagggggtacagtgataaagaaaaaaggtaattgtaagaaatgcctaaaatgtaagagaaaatggagaagatagggggagcctaaacagagaaatctttctgagactatgctttagagaaggctttgtctgatcttaccagagaatagagatcaactcagaaattacagaaatgtagagatgctcatacctgtattattttacttgtgtttttctgtgaagttattttaatcttcatgctaatcctaaattgtttgattattgtaaacaagaaacacttttttatgtggaatccatgactattatcatctgtggaatattctgagaatgacctagataactcagtcacaggatttaaaagatcaaaggttgtaattttttactaaagaagactatgatgctcagagttattatgttatttttccaagacaacatgggtgctgtgagctaatgtcttattctctgttctttcctatcactgtcagttttataaaatgtgtccctagaagctaagagatcactgtgagcccatggagggtctgaggtgtaatgtccttaacttccaactctacttcaataagaacaactctattcttatcaattgtataaatttgaattctgaacaaactttcctttgaataaacattctacattcttacctaagtgattcccttgattcttttggctacaattctgactctgtgtctcaattcccaattctatattgccaggctaaacatctcttctgacctcttcatgcctccctttcccactcctcactgttattttctaatcacagaaccccttttgtggcacatgtaaacacgacttgttcaaagtgtgttattttccatttatttgcatgcttgttcattgggtccctatgtagactttaagttacatgacagaggctatttgtttatctacctttttcactatccaggaattagttcttgtcactatacttataattcaactaatatttgctaataactgacagaatgtaggtttcttcaagagggaagcagtctctcaacagtcttccctaagatgactcccaactttaaaattgccagtggggatgaaatagaaacaattgagtgtcagacaatgctaaacattgaaatataggcaagatctggttaaaatgcttttcagggttgaactatgtaattttgaataaaaaagtaaaggggaaaggagtaatgaaaaacaaacaaacaaacaaacaaacaaacctcttttcatctgtttctcttttgacttttgaagaccaagcactacaaaaggcttaatcataagtagcttgcaacaattttgttttcaatcttcatcaatctctactagtatgttctttaacataactctatgatttgtccaatgtctctccaatcttgctgccaatatctcagtctagattcctgccatttaattcccgctgtactgggttgaatagtttcacctaaaattcatgcctttcctggaacctaaaaatgttatttgaaatagggttgttgcagacgtaattggttaacttaaggttgtataaaattatgggggtacccttaattcaatatgactagtgtccctataaaataaaaagagacacagagatgatcacacaggtaagatggtcatgtgatgatgaaggttcaaactgtagtgattcatctataagctaaggaatgccaaagattgcttttaagccaccagtttgtggtactttgtttcagcagccctagtaaactaatacacctgtgttattaaattggcctatagtgtgttccttaccttcagtgtctccctgatactacccttcttacatacagtgaagtgatagaagagaatcaaggaagtatttacctggaatccactttgtacaaaggactctgaaaagtcctttacatgcctctttcattaatcactaaaatgccacatcaaaatatgtgtaaatatactcatgttaccaaaagggacactaaatttcatagtggttgaattatttgccctactcacacagccagaatttgaaccaagttccaatataaaattaagacacattgtctccccgatttatagataaataaacctcattttgaatatcattttgttgctgccatttccctattttcaatttacagtgtttttttatggcctacagattgaatttatcatcttagataaagcaagatcattaccctaattctcatcagtctctcacacaagatgtctgctatatacagctgaactttcctgggtgctttgtatttgccatgttcatttcctatcccacatcttcatttctggcaagcttgccagcctagaaattggcaccataatatttagcatttagtgtttcattgtgttgaattgttttatgtattggttcacgttccgcgtatagcttatgtattttgtattgtatttgcatttcctacaatacctaacacatttaatttagttgtttattaaataagttattattgagctcctatgatctgccagatgccagaaaccataataggtgctggaaatgcaaaggtaagcaaagcagacagaagcctgctctgtatatgctaatagttggtgagaaagatattaattagtagaatttaactagttgaagcaaggggtgtgtgtgtgggtgtgtgtgtgtgtgtgtgttttctggagatgaatgatagccctagtgagagagaggagggatcgaaaagagcaaaaatcaggggctaaatcagacaggattgtacaagttatactcaggatttcatttattttaagctgagaccaatgggaggcctttaaagagatttaagttggaggggaatgtggtcagatttatcctttaaaagatcactctggctgtagtcagaaatttttaaaaagcacacacacaattggaagagaacaagagtggatagcaagagactactagagtctatattgcagtgggtgttaaataaacaattgctgatagagtctacataacttcttagtgtccccaaatgacttacgcattaaattaaaagtcttgattatgacctccaagggtttctaactttgtctgattaacttcatccccacctattaaccagcttatatttttagctataaataatcaaaaaatagtttatctcctctacttaaaattcaagtaccactgataggcatgtggcctatcattcttacttcttaaaaaaatgttaaaccacatctcttcatttttaatactaaatttcaaaaaatcaaacctgtctacaacctcttactgtagtctttttaattactgcatcaacagagctcttaaatggttgagagcttaacatttgataacatagctaaaattttatgttctgtataattttcttttgtctttcattttcttgaaatctatcttcctagctcttttataactttgaacatgaccaaaacagagatgtcttcactgataatgctacctaaagttgatcctttgcagttaactttgtttcacagtctggcaattttcacaatctgtaagaattatgcatttgtttactatctattttcttatactagaatgtaaattccatgaaagcaggcatttttgcttttcttattaactactaactctttagggcataatccagtgttcagcacgtagcagcatccaataaatatttgctgaatgactgactgctagagaaatgaaagaatggatgccgaattagtgtatatacatatatattacatataagtatatatatgaatgagtatatacgtatgatatataacacattcttatggtattgagtaaggacatagtctagactctttggctctttgggttcgaatcttattttgaacactgaaaaactggcaaaacttgggcaagttatttatctttctgctttgctttcctcatttataaaataataatgataatagtaataattttatgccatcccaaagggcagttatgagaatcaaatgggtttacacatgcaaagcatttggaatactgtctggcacattttaagcttatctttcaataagaataaaccactatgacatcaaattgggtttctatttcttcaagatatttgacattcacaaataaataacataaatattaatattttctgcttttcttaactttcacttcttatgtataaaggacattttgatttggcaattatttacagaattatgaataaaattgaggcatgttgtctttgttggtcaaagaaaagggtgtaatgattgtgaggtgtgatgcagcagatgttttgtaattgaaggcaacaaaggggaattaaacattgtgcagctctgcttctctttctgaagatgtttctatcaaaccaatcaacatcataaaaaaatacataatccagtttgtattgataactacatttgtgcacaaagcaggctgatcaaatatttactctgtaaccagactgatggttcaaatctcggtctgctgttggctatttccatcaccttaggcaaactgctaagaatctgcttcagctatctcatctgtaaaatagacataaagccaagattgagttaaaatattataaagtgcttagaataaggcctgaacatattaccagttaagagggagggtacattccgcttgacaaatattggcatcagcatttctgctgtgatgatgtttgtgccccatactcatgtaacttcaatctgacgtgaccttcctcacaatgggtcattcaaagcacccacgtgacttcccagaacgtatctaaccatttgtttgtttcttttctgatttaaattggatattcttggccaggcacagtagctcatgcctgcaatcccagcactatgggatgtgaggagagcagaccacttgaggtcaggagtttgaaaccagctagccacctgcagagacaggtgaaaccctgcctctactaaaaatacaaaaattagacaggtgtggcggtgcatgcctgtaatcccagctacttgggaggctgaggcagaagaatcacttgaactcaggagacagaggttgcagtcagctgagcttgtgccgctgcactccagcctgggcgacagagtgagaccctgtctcaaaaataaataaataagtaaataaataaataaattggatatccttgttttacattgatgtaccttatactgtagtataaaatccatgagtttagcaacacactgtatcatcctatataatatgtaagtgtctgtggtctcaaaactattagcacagtgctctggaaatcacttaagaaatactaattaataacaaatcaaagttagaaaatacctcattctgtataaaatatatgctttggttactcaggaagaaaataaacaggtctggtacaaatatatccaatattgtacaggttaggatcatagacaaactggaaataatcttagaaatcatttctcctagactctttaaggggtagtaggaagatgacctaaataagtgaaatgaggtggacaaggtcacacattcagccactggtggaactgaaatgattaaatcatataaattatgtcatctaaactttaaatcatatgtacatatatgttagtccatgcttttcatggattgttctatttagaaacagtttgcagccatgaccattaacagaaaagctgcacaaaatagatattcacactttaaaaatacacattggaactaagtatgtgttctttttagaagaatcatgttatctgacatgccccaccaacttttaaacaccatttgctatctaacaactactaacaactacatgagagcatcgtattccacatgtctgtatcttctgaggatggctattatttaaatagttctctgtttttgtccaaatgtgcatagatatctggttcctcgtccaacaaatatgctttttgaaattggtttaagatttgattctggcaatagtttttcgttatttttaattttctattttcttttcaatgaaacatccaacccaattccagaaaataatgctgcatgtatctacttctattcaatgcgctattaaagccttcttcaaaaaagacaaaacagaacactggcaaattgccattccttctccaaaccaaaaaaagcacaagcacataacctttctgccaagtaaggacacagtattccttacagaggacagaaataacgttgcatattcccttataaactctaagctctatataagccccagtgtacttcagtgctcatccagattagttcaagtatgataatctcatgatttgggggagaacaaccattgataaattttatgttctgttatgcagtttgggcagtgttatttttaaacttatctgaaataagcttaagctatttcacttgaaagcagaactaagtgtattgaaattaatgctaccttagttttaattgaagagaagaaaacaataaatttgttttccattttgcagaaaatctgccagtgagttgacatgaagatagaagtgtgttccagcagggtttaaattactttacaaatatcccttttacatcactaatattttatattcagtttgtttctctgcctctataagggagaatattagaaatcaagagtgaatgcttatttggatttagagatgcgagaaagaaagtttctatcatgaggaatgaaaatgaatcaatgatctgatttggttctgtgtcctgacccaaatcttatctcaaatcataatccccataagccccatgtgttgagagagggatctagtgagaggggattggatcatgggggtggtttccccgatactgttctcatgagagtgagtgagtgctcatgaaatctgatggtgtttgacagttcctcctttacacactcactgtctctcctgccaacatttaaaacgtgcctgcttccccttctgccatgactgtaagtttcctgaggccttcccagtcatatggaactgtgcgtcaattaaacttctttcctttataaattaccaagtcttgggcagttctttatagcagtgtgagaatggactaatacagtcaacaagaagtcactcttactatttacctagaaaagaaataacagaaactattgtgaaacaaaactactgggatatctgctgcattattgtaagaacatttcaatatctgttgcatgaattgtcttctccgcatgcagacagctaatttaaggtatgctgccttagtgctgagcccattaaaatctgaaaaataatgtgccaaagacctcttctctacattgttgagttccctggcatatagacctggctctaattgataggcattgtctcctgttaaacataaacagtttcccagaagacaaggtaattctttgaccttgttgaaacaagcgagaaataagacctttccataggcataatcagaaaacaagaacactgttcaaataatcaaaatgacagtcttccacctcagccaacattagtgaatagtatttccacactaattatataggtatattccattcccccccaccttctagaaaaaatactaagatatccaatcataaaactgctcaaattttctaacagcacccaatccagaagaaaattatgtttccttgaacccttctcaaaaccatctcatacagtcaaattcctttatcaagcctctcctgacacacttttgctgagatcacagagtccctcatcatatgttgtctcactcattatcatgagctaataaatctaactttgtttaacagaagttgtgttcctgatagtctttggctggaggcaacagaaagtaagatatttaagaaaataaataccataccttatcaactgggcatatacatacagtgaagtgtcaaaagatagtaattttgacatgacttttagttttgagtaataattaagtagtcatttaagtcatttaactaacagtaaatggtattttcctttcctcctaacagttctagcagtttgggttttagctccattgtttcattttatacacacatatacacacaaacacacacacacatacatacacacacatacattattacacgatgtccatacccccgttctctctggacatcaaataataaaacactttacgggttctgtgctctagctattacaatacaaaaggaggtcaggtctttaggttatgtgaggcaaaggggtcacacagttaaaggcaatcgtgacttatggtttatataaagcatgtccttacatctgcagcaatctcttttaggatgagactttgtgaagttaaatatacttgtttccaaacacagcatttattgtaaaagtagcataaccgtaaaagatgacctgaaacacattacaggccttttaaatacatttctttacaataatgagtcattatgtaatcaactcattcttcaatagaaaatgtgccaataacagaaaataataacataattattaaatcatattatgctaagaaaatcttccacttacaaagtgaatttccctagtacattgatattagaaaatcaagtgacctggataattggcttaaacaccataaaataatttcggtattaaattagtaaatacatattttggctatactctagtcgcctggttattttgagtgacataagccagatctcaataaaattttttctcttggcacagtgcccacaggcacattttagaaactataaagaatacattgagctgtgataaatctataatgtactgtcactactttgtagatcttgggtaaatgaagcaataagaagcttaaagcttcaagttataattaggaggcgtatttgagaaaatgagatgacccatcacattgctaaaaatgaaaatcactttgactaaatttttaaagaacaattaggtttatataccattaaatataatctattcatgagataataccagcttagaacattgtctggcacttaataagaatacaatgaattttagctgttgttattgttgttttgatttttcaaaaagggatcattctttgaagtcaggcagacctattttgaactccagccagcccttctacttattagttctctggctttatgtaggttatccggttttttactcagtttgttcattattaaaatgaagataataatacttaccttatagggttactatgaaaattagcaataatacatggaaagcacctagcacaaggctcagcatattaaattttcaataaatggttgttaccactaatatagtgatggctatacaaagtcactgcaaaaagaacactcagttaaaatttattttgagtaatttatctttcagggggtcattaattaggactgaatattattattaattataaaccaacctcatcttgactctacagcagatatgaagaaaatgcggttcttattttaggaaatcataattatagcaacacaaagagatacaaaaacatttcctcaaatgagaaaaaaatatgatatctgaggtaaactgcctcaacatttacgcttgtcctattttttcattgcagagagctttcattttgcaaagcttttttataaatgttatttttgatcataaaaggctttacgaaggtgatgttttataaaagacagatggctgcctggatcttataaaggaagttaggttagagaaaaaaacatacatttttttccctctcttttccagcacattcaaaatatatcaacaaataaaacttcaatgatcaatgtgaccttaagaaaatacacaaaaatattgaactgtcaaccttataaaataaatatacaagtcttgagaaaatcacttctgaattataaagcaaggtatatcagaagtaactatcaagtctaagaggatataaagaaaactgggtggggtagtaaaccattcaaagattaggcatactcagccagcttaaaataagtgttaagcttataatgaattatatacttggtttatttatcaaaaattccaaataatttgaccaattttttactattatgagatttccttatgacattgagcttatagctcaaattagtattaacaggcatatcttcttgttcttgttaaggaggatgtaatttagaaattacacatttagtaattctaaaatgatctttgtaaaagttgttactaacactgctcaaataaatgcaaacaactttttaaagagtctgaatgcacacttcccactgtaacactaaaatacaatcagtcaataacaaaaatataaagaggataagaacaagaaatttgtatcctcaaaaaacagtcaataaactcctaaggcttataaaataatacaccatattgtaattaagttttcaaaagtttggtaaaaagagtaagtgtaatcatagaagtgatggcagtgatcaccatgagttcaaattatcaagaagtggaggaaatgggacttaacataaaaagacttaaataactgaagatgagttaagaaaccaagagtatttatgatggagatgaagatgagatttaagaatggaagttcaggaggcagtgagaaaaccaacctgactgaagttgtgtagggactgcagagtaacaatcagtgaactggattatagggtagctttaaattagatttaatgtaggcctcatgcattcttgaaaaggcaggtaggaatgaaagcagtgctttagaaaaattatcctattaggctagagaaatttaaagtatcagtcaatttttaacatgaactctggctatgctcccaaacttcaagtttattttaaaatttgggtagaatctccatagctgttgattcaaacagtaggcttcattaggctctggcaatttttttgcaccttattataaaatctaatgaataaatgtcctatttgaaaaatctaaaatgtgaggtaagatatggtatggaaacagatatttactgaacatctgctctgccaggcattatgctacctgtatattatcaattatctccaattctcaaaacgtctcctcagcttaaagctgataatagtaacaattacaatatttctacagttgagctatgtaaaattgcccataggattttttgaccaatgattttatatggttcaacctaatatatgccagtaattggaataaattatacatatataatatgacatttaatcctctcagcaattctatcacattgctttacagctgaggaaagtagagatcaaagtgtaacttgtccaaggtcaaatagaaaatcaagggttaaatgaatatctgatctgttttatttttattgattgattgattgattgattttgagacagagcttcactcttgttgcccacgctggagtgcaatggcgccatctcggctcactgcaacctctgcctccggggttcaagtgattctcctgcctcagccacctgagtagctgggattacaggcatgaaccaccacgcctggctaattttgtatttttagtagagacggggtttcgccatgtgggtcaggctagtctcgaactcccgacctcaggtaatccacctgccttggcctcccatagtgctgggattataggcatgagccactgcgcctggccttgatctgctttattcttaagcaattctatttctatcacacatgtctcaaagcccacttgcaaaagtcaagtgaaacattttgaaatgaggatatatgtttatatattcatatatgtgtatatttaaatccacactaagattttgtgtttatgtatatctattatccacatatttttatatgaatgttcaaattctgtctcatacacacacacacacacacacacacaacactgacatcctttcctttgataatatttttcccttgaaatgtctcctaaatttataaaaattttatacttcctatagggttatcttgtggatatttatagttcatcaatgaatagtcctttctttatgatttcaagcagtacataaaatgataaaaaatattgaggcagaaatccatgtggagataaaatgtacataatatagtttggcaactaattcatttttttatcttaatgattatgtattagttcccgaattatgattttctatcaaagtaataattctattgtttcagccttaggctatatctgcaaactgccagcattaatgatcaactcagtaggaaaggcaaataaattatttttttaaaaaaaacagccggaataaaagttgtctgactgaatatccaactttccagaagagatcagcgtgttcatggtggtatggccatagactgaacccctgacttttcaactggttatgttggattgcgtatcagttctggatggcagtggatcactatggagaaactaattagataccatctaattggctgataagtgctcaaattaagcaactcaaacattttatgataaatttctgactagatcccatgtgctttaaatgtctttgaacacaatcacagttgatttactatatactatatttttcatggaatataagctttaagtatcaaatatttagctacttgtatattaaaaaggtgaaatgctaagtcatacattatgtaatgggcaaagcacatgtccagcctcacattttcatataatttttgcaaacttaatttagtagattattggtcttgtgaaatactcatggaattagtctgacaaagttatatgaggcagaatgtgttataatgagactgtagtcatagcagataaaaggatgtaatcattatagataaatagccattttcttattaataatggaatacaaccaattgaggattaaaacaaaaataaagaagagaaacacctctgtgaaaccttctgaatgtcctttcaaaaagttaagtttatgaatacagagcccagaacaaaggatcctatacaatgaaatcaaattgagactatacataaattattccacagcagtaaaagctatgaacttaatgatctggaatagtcacttaaaactgtaagattctagaatagacacagttttgaaacaacagtataaatgaatgagtaatgtgatccaaagcgtgaagatactgaatgccaattttagaaagagtcacagcaggttgaatagattaaacattttgtataggaaaaaaatctattgacgtctcaaaattacatgcactagagtatgaacagctggttctcctttattggttttcatgcagaaatgattattttccagtgggtaattactgactgatttatttcctatatccatttgctcacattttaatgtccctgaatacttagaagaggtcatcttttgcaaggaaatgtgtttgaaatgctaaagttactgtgattataaaatttctaaattttaataccttttcaatcattggttaaatatatattacattcacttttttccaggacaaattaaacagtagcaaatgaaataggaactctcagataataccaaccgtgataactgagcacaaaaaagccacttgttgtgaaatcactgtggaatttgattagaatctgatttgaagtactgtagactgattccaaagcggtattgccactgaactgaccgatctgaggtgaattttggtctggtccatccctatgagacaaggattgggaaaggaggagagatcaagattgattgtggaagtagttttgaaccgtatttaataaaagtattgcatatatttatattctaacgtatcaataataaagatgcaggaagctaaccaatgagtacaaattatatattctatatctatgtaggtgaccacatatttttaaatgtcaagtataaaaatagattacatttttactaaatggaatgtactcatattagttataatcaatacattgtctttgtttttttttttttttaccaaaactctgatgcttttaaatgcttgaggtttgcccctcttttattttcttcagcaacagtcttgagaatcacagactgttaaagttacaactcttagaactcagataaattatcagtagttaattattaattcagatactttctttaatacatttttatttatttatttatttagagccagggcctcactccgttgcccatgctggagtgcagtaggatgatcacagctcactgcacctttgacctcccaggctcaagggatcctctcatctcagcctcctgaatagctgggaccacaggcgcatgccaccatgtctggctaattttttattttttctagagagagtctcactatgttgcccaggctggtattgaattcttgggatgaagtgatgctcccactgtggcctcccaaagtgctgggattgcagatgttagccactgcacctggccttaatatatttttaaataaagatgtttcaattgacaagactttaatacaattaaatttttatggcagaaatccactagttatattaaataattataatttcttaaattccactggcttttgtaagtagagaacttccataccttaaacttaagtctgttaacttcctgttttagcacattaatttaataatattttttaatcttgttttcacctatgaagtctttgttccacaatgcttacctagttcatggggcaaataagccaaaacctatttctcttgtgtatgtaattctacaagacacatactgtcaccctcagttactcacatcaattcaaatatcagatgacaatttgtaacagaggattgtgatatatttttattccaaccttgttttactgtgtatataattgaataaatcaataacaatagtcctgacttaccatacagtaatgaaatcatatattggttctgtttgaaggacagtaaaattgatgtagatgccattcccagggggtactcttacaagccaaaaacaatcttgaaagtttggatattcatcaggatacccaggagaataaatggtgccattcattgcagttatattcccaccacaaagagctacggaaaaagtcacaaaacaaaataatattttaaaataacaataaactgactgtggagaaaaaggcaaacatttcacatatcttaagcattatgaaacacatttatgccttgtttttacttcagttgaggtatgtataatgaagttggcaacagtgcacaaaatagagtcaacttttatttatttttccacatgaggtatactaaataattgttattaatgatcactagattagtaaattacattgtcttctctattatttaaatattttatatcaatgcaaagactttaactttcatttgcctcttactatgtgtacatataaggccttataagaggttcaaagccttttatttcaaaggattttctagaggaaaggaactcagtagcagtatctgggttagtggtttatgtaagaatgacttaaatgcatacaaacccacatgcacccccttcccttccccacacacataagaaaagctctaaagtgtgaatcaactattttttcactcccaataggaaaggttaggactcctgccaataatgataaaatcgttattcattatagagccttaggggtttaaaaaatatcttcagctgagagactatatatttagcatgctattggaagaggaagacaagtaaaaagtgccaaaacaatattaaaaacagatgacatcacctaaaagatagcttcaagttagaagcataccttcacaccttggaagtggatgattccaattacgactgactccgtgaaggcatgtgagagctgaatttccaattaatgtgtatcctgggaaacattcaaatgaaatggtttgacccacagtaaaatcattaccaattacaaaaccatttcgaaacgggcgtggatcaggacagctttgcaactgataggctggaaagaggaaaaagaaagacattttttctttccaaatttcagaggccacagatagggtactacagcaattttgcaacttaaaaatagatgtgatgctacttgcagttgattataaatagcaattcaggtttatgataaatgctgtcaatgacctgtgacataaatttcttctcatgtctacaattttcatatttaaaatgttagtacaattaataaaaacgcatgctttcttcacctacttgtgcaacccaactaaattatgttttaatgaaaatgtaaactcttcttaaagctacaattttaatccaatgcattctgattctcttccagagaatgcaattgcttcttgattatgttacaagcacacagaatgcaataagaatatgtataagcctaattctgagcctttttacagtttgttttactaattgtttttctacagatcacaatatacttctgttgagttaatttcaaagaagttagtttgtaaaataaagcactggaaaaaaattttattttaatataaaatgaactttgtacttcagttatgggataatttgggcaatgcagtataattgcctatttatttgttcatacttctcttgctctacattttgtatgagatcaaagttcctgtttgtattattatcatatctcaaagccttggctattgcctttcacagagtagtgttaaataaacattactaaataaatgttagacctatgaacagggcctattctcataaaatatcaatatttggaactttttaattaagaagttcaaaattgtattctaattagtaaaatttaaatttctgaaaatcaaagactacttctctaccaaaccgttaaaattttatattcctcaaataaaaaatcacattcgaagttaaataaactatcctgttgtttattacaatataactcaaatttttaggactaaagatttcagaattaatgaacaaattctttaaaatgttaagtgctttcattcttaatgtgtccttttcattttaattgatattctacacaaaaaatattctacacaaaaatatattagaaagagttcttattccaacttaagacaaatgtgtattaggaattgatcattaggagttggaatatattattctattaaatataccctttcaatttctactccaagttttttagtttaataagtatagaaaatagattttaagtgtgtaggagaaagttcccattctaatgttatatacaatacagtgaggtgggagaattgggtctggaggcagggaacctaaggctgtctaacaccaacttcctcaaactaaattgaaaggaaaaccctaactttccacaacttagtaataagaggaccagaggcaactccatctgcaaacccctcacctttttggcccagcagatgagaaattggctgtctgcaaccaatcagactgattgcaggccgagtcctcgtttgcacagaagtataactttgtaacttcaccttagcctctgattggttgcaaaaagcaattggttgctttttgcaaccaatcagatatttgcacaggagtgtgatctttgtaacttcacttcagcttctggttggctgctttcagatcagactgattgcgggctaccacttcatctacatggggtgagcatgaagtggccaatgggaaacttctagggggcatctggacccaaaaagattctgtatctgggcccttgagccactgatcggcctgctcccacactgggagtgtacttttgttttcaataaatctctgctttcgttcttttgttgcttcattctttctttgctttgctgggcgttttgtccaattctttgttcaaaaagccaagaatccggacaacttgcagtcacaatcttgtaccggtgacaacaggacttaccaaacctaataatcttgtcagtaataacattaattttcaaactgattccttcagtagatgggtactctaaattgtacagtataacttttccaaattcagaaggttcttaaaatttaaccacaaaatcaatccaaaaataatattgactctgtgaatatatatgttaactatttctttaaaatgcactaggttagttacataaatgtagcacaaaaagaaaccattttaaaactcagtgtgattcacaacatctcctcatcattgtaatacattatggctcctgttaataatacgtcagtaacagtgaaaaaagtttatatattttacacttttattaggtcaataatgaattgtttttcaaggatatattaactgaaaatatcagagttaataaagctcaatttctagttttacatcattcaaataagaacattattttgagagagagggaaaatgagaataggaaaaaaacaggtttagtctgttttaaggtgcatggcaaagaacttggcataaggccatgtacacttgctaaagtatatcacaaatatggttctgagtcttctagcagcaaagaagagaaattcaaccaattacccaattgttttaaaaataattaatttccttgcaagcatggttaattcaatgtgctgggaggtgattgaaatgactcctattttatgaaagtgattatgtgtaatgtagtgttcttacattatgcacgcaagtataatacaaattataattatttcagatccatgtaatttgatgtttaagacctatctctatcttaactactttcaaatttcctctttggtagatactttagcaaatatttattgtgcttactgctctagatgcttatgatactccaatgaacaacccaattgcctgttcttgaggagctgagatacaaaagcattacataaagtccttcaataattagggcagagatgtaataacattttagtttattttgattaaaaatttcagccattagaaataaactttattatgtaaaatatcattttaatatttaattttaacagaatatacacatataagacatgaaataatataatagcaatagctaaaaaggactgagtaattactaaaaatatacatcatggaatacaccttacatacattttttaataaaaagttcaatacaacttatctgaaagtataattaactccattatgcacatgagcaaatggagagcaaggccgaggccacattagatagaataggaagaatcaacatttgagcctagctctacttacgcccaaaccctttactcaaaagagataaaaatcttgctcaaggtcatgcagtagttctgtttgagagataggtctaatataacatgattatcaaagtatttatattctcatgacaatagaacaaaatgaaggaatgtcatattagtcttatcactataaagtaaaagaacattttacataatacaacacatgaataatacaaaatatcttttcaatatattccttttaatataaaagcaaagatacatctttgctgtgcagctggccttgcttatttgccatgccttgcttaatttaattgtgtattaacttaagactaattcaatccagtttcatggttaggattttctaaggtctcagagagacatcattctccctgtgtagttcccagagagttgcattgttctaaaaatcttcctaattgaagctcaccttggcttaagtttttttttttttctttctaaaacagaatacagaaaataattagactcagttaaatatttctaatagctgatttggggttatataaattttcattttttattatttctcttaccttggtatacaatatgaaacccttgtttgttttgtgaatagtcactgtgaaaatataagctggtttcatgggtggtgctgaataaggaagatggtatttgaggaccactaagccggccaataacagtactagtttctgaggatccacttcgtacttccaaataatcatgtatggtttctgtagaaaaatttacaaactggagatgtacacctgaagaagaaaacaaacagaatgctactttatttgctttaccgaattaaacataaatatacacacacacaatcacatcaatgtacttagataagtttgcatttaagtcaagaggcataatctcaagatctgagtcatggatttgctgtctgcctaggacaggtaactttgctgaggttcaaagtaaaagaatactgctctcacatgtccattattagttaaaaggaaaaacatttcatttcattataatgtcactgtatgaaaaatgatccaaaaaagtggctttcttattctttaatacgctttaaattacataaactaatttttagaggaaaaggccgcttttggcctaatttgtgttatggaaaaggtcaatctaaggttgaaaataattgcaaatttgtaatatagatttgtaacatagattccacaattgcattagaagttattcattcacaggagagaaattaacttctcagaaatataacgtatataatttaaagggtgctctttcagtgttttgcttatcagaagataatgcaggcttttatataataaccttaataaaatctggtgatcattgttatatgtggtcatattgcaatgtaatctcaatatctttataagcataactaaaatacgagacagtgaaatgtctctgggataaaaaatgttaattaaagtatatttgcttaattaatttaacactcaattttagtaaatttgatgtttttcttactattatcactctctaaattatttgtaataaaatctgatatttggtgaaagttttaagttatttatatttgctacacattatatatattacctgccttaagtgatttatatatgctaacttatttaattctcaccatttcatgagaacaaggaaagtgagtcgcagagaagtaagacacatgtaaagtttacacaatgacccagtaggcttgaactgcaaaccgaggcattcagactcttaagcttatgatattaataactacactggggctctgagtaaacgcgcatcatgttactaaatgattttttaaacagtcccttggacaaataagctttggaaatatttaaaacagggtttaaaatattaaacaactttctaaaaaattagattaactttttagaactttggacatgcaaccttaatatgtgaagaccgaagatatgcactttttgtttttatttttaactgagcacttttattacaaacattttccaaaattgtttcatatattcttgaacatatgtttctttacctcttgaaatgtattatatatatatatatttatatatatatatttatatatatatatatttatatatatatatatagtttaaatacattggacctaatatttgatttaatcaaaactcaaagaaaagagtatggttattaaaatgtaatcaagtatctaaatctcttatgttttcatttataaattagagctatatattcaagttttaataaagttggttttcaaaatcaagaattagccagaaattgaagatcatgttataatgagattattgaaactatttttaataattcattttaaaataattcatttagctacataagctacagtggctagtgaaagacgtggaagagccatgctggttcaaatctgttgttcatttacatcagtattctatcaatggacatagaagttcactacaacttcgaatttagagtttccacattttagccaaaatgatcctaaataggatttctaaatagaaagtccccagcaaccttctctcaataacgttctgctttcccaaaacctcaggccagtcacacagtgttcaggcatgtttaattttttttagctttctcacctgcatttttctacttgttaccttgtttacctggaatttctttcacacgtcctgcagcagactgacattctttgctggactgacttttacttaactttttgttttttcatttcatttaatcatttatttattttttaaagacagggtggcccagctgctcagtggcatgatcacagctcactgtaaactcaaactccggtactcaagcagtccttctgcctcagccttctgattaggtgggacatacaggcgggctccaccatgtgtggctagtttttttttatttatagtacagacagagcctcactatgttgcccaggctggttgattatttatttattatttatttatttattttttgagatagagtcttgctctgttgcccaggctggagtgcagtggcaagatctccgctcactgcagcctccgcctcctgggttcaagcaattctgctgcctcagcctccagagtagctgcgactacaggtgcgtgccaccatgcctggctaattttttgtatttttaatagagatgaggtttcaccatgttagccaggatggtctcaatctcctgaccttgtgatctgcccgcatcagcctcccaaagtgctgggattacaggtgtgagacaccatgcctggcctggttacttatctttaaagctaaagtttaagcatcactccctctgtcaagactttactgcatttcctatactaggctgatgtccattctaagtacaatcctgtgctctctagttacactgtatcataataatacattttactgtctcctcattatgactgtaacttatttaaagaaaaatgcaaagtctgcattgccatacattttatctccagcacttagcagtatctggagtataatatacactcagtaaatatttgtcaaaactatgagttatctgttaatttatgtaaaacatttaaatatgcatttatactctgaggttgtagatgcttactgggtagtgagatacccaagttcagtcctcaataagtgacatagtacagaatttcctaataactctaaaactacctggtttgtgcttcaatgagtatctattcatcctagtcttctgtgatttaatgaacatgtgtaccctcaatcaagcacttcttttagtgcatttataaactcataggatctgcaaaagctgtaagagagtatattagtgatgtaagggtaaggagaatttattaaatatgatatattatgtaatgtatcaaaaatattgggaattattacattaaaattgggaaggtattatagtgatttgtatttaaacctaatattttaaaattcatactactttttaaaaataaaatctgatttacttgcaaagaaaatgggatgaattcaatagattactagaaaataataactgtactacttgattacagcaataagaaaagagttacaaaaacaatgcacataaaatttaggttgaatttatcattattatacatatctaattcagggtatatccatacatagcgactgaaaaatagtataagtctgtctagctatatcagtctatacatctctatatataattataaaatgacctggcacactgttggtgggaataaatattagtacagacattacaggaaacaatatggaggttccacaaaaaaatttaaaacagaactaccacatgtgccaacaatcctaccactgggtatatgtgcaaaagaattgaagtcagaatcttgaagagatatcttcaatcttgtatttctgcagcattactcacaatggacaagatacggaatcaacctaagtgtccatcatctgatgaatggataaagaaaatatagtatacatacacaatgaaacactattcagccataaaaaaaacaagggaattctgtcatatacaacaaaatggatgaacctggagggcattatgttaagtgcaattaagtcaggcacagaaagacatatcacatgatctcacatgtggaatctgaaaaaactgaactcaggagtagaaagtagaagggtagttaccagggtgtaagagagaaggattaagaaaatgttggttaaagggcacaaaatttcagttacacaaaagaagtaaattcattgtacaacatggtaactatagttattaacaacatattgcgctcttgaaaattgctaagagggttttaagtgttctcaccataaaaaatattagagataatatattaattaactttatttagttcttccaaaatgtatacaaatttcaaaacatcatgttgtacatgataaatatgtacaatttttatttgtcaattaaaaaataataaatcagagtaaaaaaaaaatatgcccatataccttcaattatccaagtactccaagtgaaatgtatttgacttaagcaacaattatttaaatttcactcttcaatttacatagttgtatgtattcctaaactaaactgcaatttgtgaagattttataaattcttattcgacattgaaatttattttaaggctacattaataaatattgaaagctctttcacgtgtttttaatacacataccaaaacctatgggtagatttattgtccatgtgcaatctaaactgctgggatagtttccaggaaacccaggactgaggatcacaccactgaagtctgacatagcaccaccacactgagctgcaaaataacagaaatccaaagtaaaccagagtagaggaataatttactgtattaaaaaacatattaaaatcatttcacgttttcaaggctctgagttaaaactgatataaatttgaatattgtctgttcactcactatacactaggaattaaatataatcaacaacagattttctaaaacagcataaaaagacaacatccttccttcctcagaaataagtggaaagtaaatcaattattgcataaaagtaacagatcatgtgcagtaaatataaacgaacaaagacatgtgctttgccacagcgggcactttatttctcttcctcaagtagtcctagaaatgttttgaatcatcccaaagacgatataatttagagtaaaatcaagccaaccacttcagctctaagtactgtattcaagaggaaatcattttcacagccttccctccttttccttttttttttttttttttttttttttttggagaaggagtctctctgtcacccaggctggagtgcagtggcgcaatctcggctcactgcaagctccgcctcccgggttcacgccactgtcctgcctcagccacccgagtagctgggactacaggcgcctgccaccacgcccggctaattttttgtatttttagtagagacgggggtttcattgtgttagccaggatggtcttgatctcctgacctcgtgatccgcccgcccaggcctcctatccttttcctctttttgtgagaaggctcaataaagatttgtaagcaaaatattggtttccattcatatgtgagaagttcacatattacacattagatatggccttattttatcctaaaagaatcaagacaaaaaatagagaagtaaaaataagtaaaaagatgcacacaaatttgagaatgtagggagttcgtaaatgtgcttgtcttggaatccctattatacggtttactatcaataaggtaagcaaaagctctaagaccagaaatttactcaagtttttaaatataattagatagaacccttgagcatatatgaaaggcaattgcattttagaaacctattcttgaccgtctaaagcacatttttatcattttattgttagatgaagaatcaaatttcatgactacaaatgaagttcaaaagttacctatacagaatacttatttgcaatcgcatccatttatttcgtgccaagagtagcaacacacagatactcaaatctcaggttatatattttaaaggcaaattcagtaggaattttaacaatgttttatacaatattcaataagtttgacaactatcttttgctatgtgaactaaataaattatgtgtcaatctgattttatataatcttggagtcaacctgcatataaacctttcatcaaacttgtgattataatcaagctctaaagatatacccatatgcttttttatgcttctgaaatctcgttaattcacccttaaaccaaatcaattttcaatgaagttagtatttaccaattcattttcctaaattcaattgttcacacatattcatcacaaaatctgataattaatgagttgtaaaaacaatagtttgctcaattaaaatatttttaaagtttatggcaatacatttgtaggtttgttttgctttattctgaaatttgagtaaaaggcaaggactatcttttattttcttgccttcacaatttcaagtctttgagctgctgattgtccttctaattctgttactttctatctctttagatatgaactggaattcctgtcctctgcattgatggccccacctttcagggtgaaaaataccaaaaccaaaagagaaaaagaaaacagaatagagtaaagagataacaacaacagaagaaaaacaatgacaaatcattagagacatatgaagaaggataccaaagaatgcatctgccttcagcaatttgttcatgtctatttcctcagtatctctgcaatctcaacactcctatgccttgaatatcaattttgtgtgtgtcatcagcagcttcatgtacactcttttgtgtcccattacactctttttgttagggacaaccataccttagtcttccaaaataaaatcaacttctgttttttcatcttagttgtctctaatatctaaaatctcacataaattttccttctttccatcaaaatatctggcagattgcttattttccagttcacgaggctgtagccttgttatctgatgactagtgttttaagacattcgctgaatcagcctcttgcttctagtttctccttacaatattgctattgtatcactgccaatattttaatactctgtcacatgtagtaccagcttattgttcaaaatttataaaatacaaaaaaaaagagtaaaaaggaatttaaaatgggtcaggtgcggtggttcatgcctgtaatctcagcacactggtataccgaggcaggcagatcacctgaggtcaggagttcgagaccagcatgaccaacatggtgaaaccccaactttactaaaaatacaaaattatataataaaacaatttttctaatttagtttataatataaatgtaaacttaatcaaaatgatactttatctactaaaaaagtaattttttaaaaaattgttttgttacattttatttctcttttgccctgtcttatggtgctgagaaaattgataattttttaagaataataattgatgtaagcaatatagcaagatgggaactgtcctgtaataatagagtggtatttaaattggtacaaccttctggagcaatttgataatatttatgaaaggttttaagcagttctattcagtgacataattaatctatttaagaaaaattataaacaagctattagagctgttttctaattatgatatgagatgtgttcataataaatataaaattatgaagtacataatgtgaaaaaataaatatgtaatttataatatcaaaagatgagaaataaacttttaacgaaaaagaagtaattgcacaaattagacaatgctatgtgtcaagaatcaaaattcaaattttgtttgtttcagttgtagtttttgacatttcaaattttgaaaacaatatggtatgagaaattcttacacgttaacatcaaaaagaaaaacattactatatatatatagtatcccaagcctttacattaatttgttcactaaacagtatataatggatgcctatttaagatgagaaacttttcaggcactagcaatatggtaatggatgaaagatctaaactctgtgctttcatattagcagaaaaaaacatatttattttactctttgtgctcttttatattctcaacttttatactcaattggatatacacataaacacacacacaccacacaatatatttacaatcaccattatctgcacatatgtaagtgttcagaattgcattacatgtatatatatgaggtaattttaaaattggtataatatgcatttacaaattaatcatagtaccttaaaaacttcccttaaaaaaatcatccaatttaaagtctgagtgttttcaatgtactttgccaattaaacacatcatcactcttaaacatttttcagtactcttcaaaaagaattgtgtgcattttacgcagatgttgtggacttaattatgtccccccaaaatttatattttgaagtcctaacccctaatgtgactgtatttggagatagggccttaatgaaggtacttaaggttaaatgaggtcataagaggagggtcttaatccaataggactggtgtcctttaagaagaggaagagacaccaggagcgtgggtgcacaaaccaaagatcatgcaagagataccatctacaagccaacaagagaggcccttagaagataccaatctgctagcaccttgttttgtaacttcaagcttccagaactctgagaaaataaatttctgttgtttaaactacccaatctggagtgttctgctatggaaacccaagcagaggaatgtaatacaggtacggtcattgtgcagagttaagtcacacaagtcatggactttttttttttttttttttgacttgggctctttctccaactcagaaagagatatcttcttcctccatgtgtcttaattagacttattatccaaaactctgtgaaaaccttgcaggctgaatatgtttgccaatactttagtcaaccccagtctcacttttctgaaattccatcatgtagttaatgataaaatttaactctaaattatttgataacaaattcatttattttatttctagtactccaaatagtaattgaatgttttaaaggtagggatcatacctcacattactttctcttactctttacagcccagtatattaatagttgcacacaaatacaaaaaaaaatgaggaagagaaaaaaaagcatgaatagaagtaatttggaagcagcattgagttaaagcaaaaatgtgcacctgtactttcaaagtacccaagtttccttttaatatattccatatcttgactgcctgacaccactaaagacatctcatgaggtgtcatactccttttgctagacactttagattctttatctattcccgctcaatagtaagcaatagaatatttacttatttttctgttcaatagatatactgagaaaactctctaagaatttttttaagtcttttcttaatttctacagcttaagtcatccactgatactgaagttgaggataaataaaaataaaaattttaaattaaaaaaaagaagatgtgaaatattttcctcaaaaagtcatttccataagatctggtaaaaggcaaactatatgtttgaaaatcatgatatacagaatgaaactttaaaatctgatgaagcttacaaatactttatagtctttttttttacactttaagttctagggtaaatactttatagtcttttaacttacctaaacaaattgggattggataattccatcttcttacaggtcctggcatacatgtaatgtgagagtgaccctacataaacaaaatgatgtggttcagtacacatacataaaaagtttaaatttattgtagcatagtcaattattattataaaaacaagcttaagtacatggctttatttttatacacatatttacttatatgaaaatcttagcatgattaaagtaagaaaggtgattatatacacctatgataaaatgtaagaaatagctacatgatagtggtagaaaaaataatacttcatatcatattagaattgcggttttaatattttcctataacaatatgttttactaagatattgcagtgattatataagtgaaagggcagtatacatggtggtttataataaattgctataacacacaaggtgaagtaggttaaagaataattttaaaattttttcacaaaaatattaaaacaagtcaaagtatattaacttttatattgaaatataaagtcctgaaagatctgtttgcacttctgagatttataattttgtgatacaactttaaagactataaattattaatttttaattttgctttctctgaagaatttatttatctaatatgtgaaacagtattttccttaactttttatcttaatgagtttattctttaaggaaatttttatgttactataaacctgggaccctcgacaaaaaaaatcaaaaaagatcaatataaatacataaaatcagaatatacattgcaaatccagttccttagcaaaatatacttgtagtaaattttcactaatttgggaaatgtattgttatggaagtttcattcagtgttttaagtggcatttccctttattttcaaattctaaaaatccaggaattcagttgtcacaatcctatgtgaatagagacaaaagtaaagattaatttttactttaaaagactttaatctaattaattaaaatcaaggagaaaggacttccctaactttcctaattttgactcaaaatcagttttgtttacttccaaacaaaacaaatttagtcaattccagcaatatttctcatgtgcatattttattatcaaattgagcacccttttgacctcagacacaaaccaggatcaatgttgtaaaacccgtggcttatcaatcattgatttgtaaaatattctgaaagggccatgaaaatcaaaaccacaactttaaaatagacttacctgaagagaatatccttgatcacactgaaaggatactacatctccaaccatatatctgtctccaattttaattccactgctaggagtttgtggttcaggacaggaatccaaaccaattgctaagaatatttaatgataacaatttaagtaactttcaagtgataaatgcttaagttatgcatattaagttgctaaaattgaatatcagtgtctcatcaaactagatactatattgagacgttgagaacgttctgtgaacaagatttaactgtagatgtcaagaataatgcacatttgaacatcattataaagctatacaattttaatttttatggcaccagtcattaagctagctgtgtgaatatacctaaattgtgttttaactccaggcttaattgttttctactgtgaaacaaaagtaaaaatttctgaaaagaaaattcctacatgaaaattaaaaataatttattatgataatagaaataaataatactttaaaaacattcttagcaaaaacttaaaaattatttgctattttgtcttccttgcttaactctttcttcttttattctgaatcggcttttaaatttatgaggtacattttgatgtacttcttattatatgtaaaatttttaaaatatagttgtaagtagaacttttctttctctgaagatactataatcaaaaaggagaggccaagtgcggtggttcatgcctgtaatcccagcactttggggggctgaggtgggtggatcacctgtggtcaggagtttgagaccagcctggccaccgtggtcaaaccccgtctctactaaaaatacaaaaattatccaggtgtggtggcaggtgctgtaatcccagctacttgggaggctaaggcaggagaattgcttgaacccaggaggcggaggttgcagtgagctgagatcttgccattgcaatccagcctgggtgacagagcgagacttcatctcaaaaaaaaggaaagaaaggagaaaaactggtgtctcattgagacctgaaaagtattatgtgctacttgaattcagtatttttctgataaggagataacaatgtaattcaaaacactttcattatttttattaggtaagaacttattttttatctagagcaaaggaaaaagttcctggaaacatgcaacctcccaagatagaattttttatctagagtcaatgaataaatccttgcaaacacacaacctcccaagatagtatcagtgagaaactgaaaccctgaacagaccactgagttctaaaataaaatcagtaagaaaaaaacctaccaagaataaaaacaaagccccagaccagatggatttatggctgaattctacaaaacatacaaagctgataccaatttaccaaaacttacaaaaattcaatgagaagggactttcctaactcgttctacaaaggccaccattaacctaataccaaaacacggcaaagacacaacaaaaaaagaaaaatacaggacaatatttctgatgaacacagttcgtaaaatcctcagcaaaatactatcaaaccaactccagtagcatatcaaaaagttaattcaccatgatcaaacaggattcttcctgggatgcaaggttgtttcaacatatgcaaattaatacatgtgattcaccatgtaaatagaattaaaaataaaagccatatgatcatttcaatagatgcagaaaaagctttcaataaaatccaacatcacttaatgataaaaaccctaaagaaactatgcattaaagtaacacatttcaaaataataagatccatatatgacaaacccacagacaatataatactgagtgggcaaaagctgggataattcatgttgagaagaggaacaagaaaaggatgttcactctcaccacttgtactcaacataattctggaagtcctagccagagcaatcaggcaatagaaataaataaaaggtatccaaaaaggaaaaaacaataagtcaaattatctctcttcactgacaacatgattttatacttggaagaccataaagaatctgccaaaaggctcatagaactgataaacaacttcaataaagtgtcaggatatttaatcaatgcacaaaaattagtagcatttatatacaccaacaacatccaggctgacagtcaaattaagaatgcaaccccatttacaataactgcaaaacaaataaaacatgtagcaatacatcttattaaggaggtaaaagatctttacatggagaactacaaaacacttctgaaagaaatcatagatgacaaaaacaatgggaaaacattccatgctcatgaattggaagaatcaatattgttaaaatgaccatatttcccaaaccaatctacagattcaatgctatttccatcaaactaccaacgtcatttttcacagaactaagaaaaaaactgtgctaaaattcatatggaactgaagtaaagcccaaatagccaaagtaatcctaaaccaaaaaaagaacaaagctacagtcatcacatagcctacttcaaactatactacaaggctatggtaaccaaaacagcatggtactggtacagaaacagacacaacgatggatggagtggaatagagaactaagaaataaatccacacatccacaactacttgattttcatcaaagttgacagaaacaagccatggggaaagaactctatttaataaatggtgctaggataactggctagccatatgcagaagaatgaaaatagacacctatctctcacatttacaaaaactaactcttgatggattagatatttaaatgtaagacatcaaatttcaggaattctagaagaatatctaggaaatgccactctggacattggccttggcaatgaatttatgacaacatcctcaaaagcaattgcaacaaaaacaaaaattgacaagtaagacctaattaaactacagagtttctgcacagcaaaagaaactgttaaaggagtagcaaacaacctacagaatgggagaaaatgttcataatgggagaaaatgttcgtaagctatgcatctgacaaagctctaatatccagaatgtataaggaacttaagtcaacaagcaaaacacaaattccccattaaaaagtgggcaaggccgtgcgtggtggctcatgcctgtaatcccagaactttggaagtctgaggcaggtgcatcacgaggttaggagattgagaccatcctggctaacacggtgaaaccccgtctctactaaaaatataaaaaattagccaggcgtggtggcaggtgcctgtagtcccagctactcgggaggctgaggcaggagaacggcatgaacccaggaggcggagcttgcagtgagcagagattgtgccactgcactccagcctgggcgacagagctggagtctgtcaaaaaaaataaatagataaaaaataaaaaaataaaaagtggacaaaagtcatgaatagacacttctcagaagacacatgaatgaccaacaaacatgaacaaatgctcaatatcagtaatcaccaaagaaatgcaaatcaaaaccacagtaagataccgtcccacactagtcacaatggctatgatgtaaaagtcagagaaaaacagatggtggcaaggctgcagagaaaaaggaatgcttttacactgttggtgggaatgtaaattagttcagccactgtggaaaacagtttggagatttctcaaggaacttagaactaccatttaacccagcaatctcattactgggtgtagaatcaaaggaaaaaaaatcattctaccaaaagacacatgcactcgtatgtttatcacagcactattcacagtagcaaagacatgaaatcaacctaggtgcccatcattaaataatatgcagccattaaataatatgcagccataaaaatacagtgaaatcatgtcctttgcaggaatgtggatacagctggaggccattatctgaggagaattaatgcaggcataaaaaaccaaataccacatattgtcacttataagtgggagctaaatattaagtagacatgtggatgaagattgaaacaacagacactgggggttacttggtaggggaaagaaagaggagggcaagggttgaaaatctatgagtactgattcggtttggctgtgtcccctccatattccacttcccatgtgtctcctcccacaacacgtgggaattctcatcttgaattcccacgtgttgtgggaggaacctggtgggaggtaactgaatcatgggtgaaagtctcttccatgctgttttcatgacagtgaataagtttcatgagtactgatggttttaaaaagaggagttcccctgcacgagctctctctctttgactgctgtcacccatgtaagacaggacttgctcttccttgccttccaccatgattatgaggcttcaccagccctgtggaactgcaagtccaattaaacctctttcttttgtaaattgcccagtctcaggtatgtctttatcagcagcatgaaaactgactaatatcgtaaattggtaccagtagagtggggtgttactgaaaagatactcaaaaatgtggcagccactttggaactggataactgacagaagttggaacagtttggagggctcagaagaagacaggaaaagatgggaaagtttggaacttcctagagacttgttgcatggctttgacaaaaatgctgatagtgatatgaagggtaagttccagtctgaggtggtctcagacagagatgaggaacttgttgggaactgaagcaaaggtgactcttgttatgttttagcaaagagactggcagcattttgcccctgccctagagatttgtggaactttgaacttgagagagatgatttaggttatctggaggaagacatttctaaggggcaaagcattcaagacatgaattgggtgctgttaaaagcattcagttttataagggaagcagagtataaaagtttgaaaaatgtgcagtctgacaatgtgatagaaaagaaaatcccattttctgaggagaaattcaagccagctgcataaatttgcataagcaatgaggagtcgaatgttaatccccaagacaatggggaaaatgtttccagggcatgtcagaggtcttcatggcagcccctcccatcacaggcctagaggcctaggaggaaaaagtggtttcatgggccaggcccagggtccccatgctgtgtgcagcctagggacttgatgaccttcatcccagcctcaagccttggcagcttccacgtggtgttgagcctgagagtacacagaagtcaagaattgaggtttgggaacctctgcctagatttcagaagatgtatagaaatgcctggatttccaggtagaagtttgctgcagaggcagggctctcatggagaacatctgatagggtagtgtggaagggaaatgtggggttagagcccctacacagagtccctactggggcactgcctagtggagctatgaaaagaaggccaccatcctccagaccccagaatggttgatccactgacagcttgaatcatgcacctacaaaagctgcagacactcaatgttagcagacaggagtgaggctgtaccctgcagagccacgagggtggagcttcctaagagggaacctacctcttacatcaggatgacctggatgtgagacatggagtcaaaggagatcattttggcactttaagatatgactgccccatttgattttgaacttgcatggggcctgtagcacctttgttttggccaatttctcccattttgaatggctgtatttacccaatgcctgtacccccactgtatctcggaagtaaactgcttttgattttactggctcatagatggaagggacttgccttgtcttgaattagactttggactgtgaactactgagttaatgctgaaattagttaagacttttggggactgttgggaaggcatgattggttttgaaatgtgaagatgtgggatttgggagaggccgggggtggaatgatatggtttggctgtgtccccacccacatctcatcttgaattcccatgtattgtgggaggaacccagtggcaggtaattgaatcatggagcaagtctttcccatgctgttcttgtgacagtgaataagtctcacaagatctgacggtctttaaaagaggaattcccctgcacaagttccctctctttgcctgctatcatctatgtaagacgtgacttgctgtactttgccttctgccatgattgtgaggcttcaccagccctgtggaactgtaagtccagttaaacctcttactttgtaaattgcccagtctctggtatgtctttatcagaagcatgaaaccagactaatacaattgctatgctgactaccgaggtgatgagattattcataccccaaacctcagcatcatgcagtaaacctatgtaataaacatacccacatatcccctaaatctaaaataaaagttaaaattatgtttttttaaaaaagagtttatttttcaaaataaactaaaaacatagtaaaagtaaatggttttctgaaaatgattcattgaaagccttaacaaaatgtttgcttttttgccaaaacatttttcaaatatgcaactattattattaaaaacttttcatcttcattaaaagccattgtttattattcattttgttgtaattacattttcaggctaatctaatgcatatttaaatgggttagaaaaagaggtcaccactccagcagcattatactgtatacatacggatttcatttttaaaaagcattgaaaactaaaccctaaagaatgataatgctttatatgtattccttcattcctgtgccagattatttctctctgatagatattcttgtagcaccaccctctacattctttttggatacttaacacaatctgataatatataaataattgtgcaattaattgttcaatatttatctcccatctgagaatgaaagctccagaagggccgttagagaacagtgtcttgaggaggcactcagtaaacattacttgtgtgaatgaatgaataatataagaaagagagtgtatccctatatctagattatttcttaataaatattaatgcctaattatgcaaaggaaagctatctaataacacaatggttagagtagcttaaatcatgccaaactggatgacatttaacaatagaaaatgccataaaagcagtgacttgatagagttatgattagattagaaagtcaggcagtaaagatcaggagtaaagtggtcatttgggaatacatttgaggcagtcttgaattagataaggagagtctgtacattgcaatcccaatgcccagtgccttaattagttaggtctccaagcatgcatcatgttctattcctttttgtagtattgaatttatggacctaggaaaacttggttactattaaattgtgacctaattttaaatgtttaagggtttacaactttcttctccaactagattttggaatctaagaagagatagaaattgccttccctgtgtattaatcttacttaatacccgttgataagcctcacacatcaaattcatctgatttcatagagtcttcatcagaaactaccgaatacaaaaatagtgaactatgatataaacatgtatgctttgtctatacaatttcaccttcctttggtacaattttagtttcttgggagtcctgaacagtaaatttattactcttcaccagtaaggacattcttgcaatcattctcactgagaaggccaaattttgtacacattcatttctcttcctttctaatcaaatactctattcagggtcatatatataaaaaactatcaaaatccagtagcgacagtttccttctccaagaggagaataaataaaactatgttagtgaggtagctgaatactgagatgctcatttttaaacaagattttacataatatacataaacaaaataaaatgtttgtgaaggtgttttaactttttaaaaaatgacacaaaactctataaactaggtaaaagcaattttgtaagttaaaacaaattcttatatgtatataatcacagagataaataaccaaatgtaaatatgccaaatggtggttgtaattcttgattataagattactggtgatttgtatgtcattccttgtattttcctgcatctccagagtttctataataacataaattatttttgtatataataaaataacttataacctagatgaattagtactagcagaaaatttagaagtacaggaacatattcccttcaatttttctagatgatattgaattgggctagctaagttcatttgaagagatcaatcagcaactgatttgtgttagggaagaaaataatgatataatcagataagtcatatgctgatggcttcattcatttttttgcagcagtttctttttcatgtgcagtaaagaaaatgaaacaaaaatacatgaaagtcctacagtttgaattttgcagccattttttaaatttacacaaataaatctccaagtggttaaatattaactctaaaatatctttgggaattatttttcacctctttataagtgacaaaatcaataagttatttgtaggaatcaataagagaatttttttgtagaaatgtggaaaaggcttctcttctgcttaaccaaggctagtttcctgcttaacaaaagacatcaaaacattgagtcattttaaggttcatgagtataaattttgtaaaattatgccgttggcaaccaaagctgctctctgattaaatattttttaatgggattggatcaattaatctgctgttgtagccaaaaaaaagaaaaatcagaaatgaatccagggaccaatccatacaaaaaattgcacacagttatgtctgtctgctgtcaaatgattgcaggcagttaccctggctgaaaatattaaatccttactgcttcacattactaatatttatttataatcaaaacgtattatttccaattctgttcacaaagcaatcaatcaatctgtatcagaaatgttgttaatcatatcatatatagttggtaattctgaatgtgtgtgtgtaaataaaagtgtgtatgtatatatatacacatacatatatatatatatatatatatatatatatatatatatatatatatatgtcctagtattccaaattgatttcaaatgagtgattaacgcattgagatacgaagacatggaggggaaaatgtttaattactgctaagacacccagtaacattgttttgttaaaggaaaaactcattcataaatttgacatgacaacctatgtatctatttattgaaaatgcagaccaaaaatattggttttgcatttatgtgagaaagaaacaaaagttaaatcatgtgtctttgcactaaaggtggtatttagtgatagtaaagatctttttattccaaatatgttgcatgtctttgattttcatcttttctctaaattgtggatacaagacaactattatgtttatgttgatactacctttaagggttttaaaaagatataccaaaattatcatttcacattccacatctatcattataaagataagagttcaagaataatgtagacatttgtggtaatcaaacggtgaacccaatatgagttggtgtactattaatagtttgaagacttgtagaaaactgctttggtaaacatgcagatatttttctggcttaaggtacctcagaatcaattgattaatctactaaacaaatattttgtcaaatacctaatcatgtaacaagtaacttcatgaatgtttgtggataaacttttttggaagcaataattctgactatcatcactgatgggcagcaatgctttgggaacatgtagcacaggctacattaacatttaccttgatccttaatactttatttactttatctgtgcttactgtaactgatatttaacttagaattactctgtataagtaaatgaatactcagtaatacacactacttatcaaattttagtctatagaataatactaagttaaatgaacaaaaagttaaatagaatcacgacgtgtaggtattattcattcattcaataagctgttggtgagtacctattgcgtgctctgtatcatgttacattccagaaatgcagagatcaatcagcaacataagcaaccatgctctaaagagactcttgacggaacaggagaggagtttgatttgacagatgatgattagagcgcggtggaacaattgcaataaatgaaggtcatcctttgtttaattagataattgctccatagaagtaacccatatgagtactgaaaaattatatattttaccaattcattatcctgaggggtagttgtgtatggtgttctgacacagaaagtaacatattaaacgaatggagttcttagagatttttctttcttttttggaaaggagggaagtgtttttctcaaaaacacattgtagtgttctgtggaaggcagcaagaaatgaagctgaaatggaaggcagaatatagactgtgaacagtcctgaaatcttaaccaacacaggtatttgaactttctgtgtttaatgcagggagaattcagagttaagaccacaaccttttgtgtgcatcctggctcctctagttgcatgctggttggtttgttttaaagtctgagatgttttctatgcctcagtttcctcacctataaaatgggatgagtaaatagtgacttcacagtcatattatgatacttaaagaagtgcatgcataatacttagagtagtgccaggaatattggaagtgcctaacaaatgttaactattgttgaagtgtttcaggcactgaagtgaggatgtccatttgtattttagataaaaagtatacttttcttcttgtcacgaagggtatatttctgtttaagatcaagagatttcacatgtgtgctctagtagtattaatacaaaaaatatataaatatttatataaagcaccacaaatttaagcatcctgagtctttcaactgactcaacatgagaggcttcttctatatgcagctaaaagattattaccttcactgcaagaaaaccctgggtaccaggaccagtgtccctagctcatgatataactagagaaatgtatgaagacaaaaacacaatgtttacaaaattcagaaacctagattaggctaaaactatctctacgtcatcatcacaaaggggtgaaaaatcagtgagataatcaggaaataaaatatgatggaaataaaaggaagcaaactgtgataaatctgtaagggctttatagggttaagaagtgcaatgtgtttataaagatcaattacacttatttgcatgcaatgtattctgagttaatggcaattgaaattagaaatgacaaatactaataatttaatttgggcaggaggtatttctacaattaatatttattacatttatgaatgttgatgtgcataaactagttaaaacaagaaaattagtgtaagtaaaaatacagttaatcttaaaatccctgtttttcccaaataatcaattatataattagctcaagggagaagaccatttttagtgattataaaagtaaactcattaagaactaatgcattatctcttaagcatattgctcgaggatgggaagcagtaaaaataataacagttatgctgaattgaatcttttgctatttataagatagagtcaaatggatacatttctgggcatttattattttgagactaattttatgctttttacaactactacaagggatagaaagatgctttcagatattccagtttttcctaggattttactgaaaattataatcatgagtgctcttaggtgtaggggaagagaaaatctattcattatggtaacatgtacctttgccttcctcagggactacgtcctgagatttttgaagacctctaaagatcttcaaaggaccttgaaactaccattacttcatgcagccttctcttttaaaaacatgtatattttataagttcaaaatgtaattctgctcattgatttacatatgctgcaaggtccctctaggatttgccattagtgagattttaacatgtgtctctacaaatttaaagaaatgagatggaaaggacatattcatattacaatcaggcaaagagtctaatccaagactattaatgctgaggcttcactaaaatccaagtggcaggacaactggaaagtacaagttctcttagtggaagcctaccaacaatcaatatatttaatgatattccatgagctaggatcattttccctagcaataaaaatgattatgcatgatataaaattacaaacaggagcaaatatatttgaaaaaacaaacacaccagaaagcaaaaattgtcagtttaagaattgattcccatattccagtgctaatgtggatcaggaaaaagaaaacttgaatacttcatgtgagaaaaatttggggtaaattctatgaattcagcacagctacatttgttcacaagactatgtaaccaatatatgttcctaatacaagtaatgatgtagctttatttggatttatgatagcctatatcataaaataccaaaatagtaatcagcctccactaaataatgtttaaacttctctctaatgaatagagagaaatgtgtccaccaatatctggtatgtttgccttaattttcctatgtctcccaaagttgccaagcaaatagattttcttgaattctgcctgcctccttcctcttcaatattcaatcccctttgttattaacagaaagcaaaattggctctttttctcaacctttccattaatatttgaaacttatttatatgttaggtaatttttgttagcacaaaatcagtagaagacatcaaagtttaagaaaaaacaattagggtgaagacacaaattgagaaatttatacaaggagacttcaaaaagtttgtaaaaatgtatattatgaaaaaaaattacgcatagatttccttttttttttttttttttttttttaccaaatggacttctaccatcttcttataacatgtttgaatagaatctactttcatgcaccaagaaggataaaatactagtttgaaaaaattcccctatcagagcaacatgaattctgcaaaaattacatgaagaacaaacatcaaacttatggtgaggtttgggtggaagaatggtgaaattcattgatgctttacaaaaagtgtatgggaacaacgcacccaaacaatcaggagtttacaaatggataactcattttaagaaggaatgagagaagaagatgaagcctgcaaaagcacaccattcacatcaatttgtgaggaaaaatatcatctcgtttgtgctctaattgaagaggatcaatgtttaacagaagaaacaatagctaattgcctagacatctcaactgattcagcttacacaattccactcaagggatgccaaaacttttgtgcccagatcagctgcagacgagaacaaagctttcaatttcaatggaaattttaaacaagtaggatcaagaccctgaagcatttctttgaagaactataacaggagatgaaacatggctttaccagtacaatcctgaagacaaagcacaaccaaagcaatggctaccaaaaggtggaagtggttcagtcaaagcaaaaacagactggtcaagagcaaaggtcatggcaacagttttttgggaagttcaaggcattctgctggttgactttctggagaaaccaaggaaaatactgcttattataagagggttttgagacagttaaccaaagcttttgcaggaaagcttcaccagagagtcctttctactgcaacaatgctcctgctcattcctctcatcaaacaagggtaaatttgaaagtttcagtgggaaatcattaggcattcatggttttttgttttgtgttgttttgaaatggagttttgctcttgtcactcaggctggagtgcaatggcacaatctcggcgcactgcaacctctgcctcccgggttcaagggattctcttgcctcagcctcctgagtagttgggattacaagtgcatgacagtatgcctggctaatttttgtatttttggtagagatagggtttcaccatgttggccaggttcgtctcaacctcctgacctcaggtgatttgcccgccttggcctcccaaagtgctgggattacaggtgtgagccaccacacccagccaggcattcaccttatagtcctgatttggctccttttgacttccttttcttttgtaatcttaaaaaactctttacagggcactcatttttcttaagttaataatgtaaaaaagatggcattgacatggttaaattcccaggaccctccttagagatggacaaaatggctggtatcattgcttacaaaagtgtcttgaacttgatagagctttgttgagaaatagagttcatatttttaaatttatattttaattccatttttaattccctttttatatacattcaatttttctataattcaatttttctctaaaccttttgtagtcccttcatatttattaccttgctttgtatgtctgtaacttagaaaaactgcaccaattcaatttatttgtggcatatctataacctccaaaatagtatagtttgagcagcatgactataaatatttaaaatatatgtatataataaatgtgctatcacattacaattttttcttactttacaagtagcactatattcaccgtccatacaagttttactctttgaagaatacatctatcttgtcattatcattagaaattaggaaatacttttggttcctagattccacagaaacatatgagatccaattactacagttaaataaaagcacttatgctgaccttgatataattaaatcaatacctagatgctgaaaacaaaaaagtctagggagttgaaaggccagctctccaattaattaaagcaaaactgttatcatgtaagaagtgatattatctaaagtgaaaaacaaaacagaagaccagaaacctgagaatcatcctctactcctttttctctctcatccccaacatctaattggccataaagcttttcaattatatcttattaatatctcttgaatctgctgccatttcatctacacaaccacaactactgccttcagagtttcccttgtgaaccaatgcaacagcctcctcttaaatttctttccttgggcttattctcaccatgtaatgcatacttcactttccaaaataaaaagtcctctttaaaattcaaaacttttgttactctaaaaatccaagtccttcaatgaggctactctttctccaagaaaaaagcctatgccacattttaaatctataccatttgactactccagctatgtgggtttatctcatcagctataaagggtagcatttattaagggtttactatataactggcactgcaataagcactttatttatttaattataaagcaatctttcaaattagaactatgtattatgggtgagataacttggtttttagggaacctcaaaaattttctgagtgtcacatggccatcaaatggcagcgtcaagatagaaacctgagtctgactccagagtaaatgctcttatatctatctgcattccaggaggtcccttcaaatgccaagccattctcatatctatctttaaattcttatttgccagaaggaattcttttgacttttgatgaggttttccctgactctaccaccagtaacccctaatacaaatgatctccaccttctctgttcatcacctaaattatacaagatattttcatactttggccattgtgagagtcactttgggaccttggtaaaaatgcaaatacttgagtgaatctcagataaactgacttgacattctgggttggtagccttgtcatctggagtttctaaaagacttcaagatgattgcaatgcacaattatctgagaagtactaacttacataaacatattaatagtgcttacaccattttgcaattgctctacttgtttacatgtccttactcttaattagtctaaaaatattttaaggctagatgttacacaaatttgcagcacctacacctagaaaatgtaccttgcatttaacaagtactcaataaatacttgatgaataaatgaatgggtttgttctcagatttgaaaagcaatatgaagatgaaaaattatgggaggaggttataagtagggatataatacaggagttaggactaattgctttggaataaaattatctgaggtctactctacaacttactaacttaaaagtacctaagctctgagattattttctataattttccatttgtaaaatagggttaaaaatgtatctgcctcacagtaatttaaaaaaataaaacaaaaatacctctatgaaacatttagcaatgtgcttgacatatactgagtacttgaaaatgttagctttttaaacatataatgataatagcataatgttgtataaccttctttattataattataataatgacagtggaggtatcattagctagtttcgaagaatctaagcagtcattcaaatgcttacagttcataatactctggtacaaatggctatttacaatgtggatctaccacactttgaaagtagtcatagacaagtcaatgtgagcctcaaatattggttcttttcatattattaaatagttttctttgcttttattattttaaaaggaaaaatatatgaaaacatttaacgcagctatatagaaaactttatttaaaaatataaacttttagatttgtttaatgcttgaaaggaataaaaaatttacaaaaacccaaaagcaagatttttcttactctaaaaaatataatttttgaaatttagttccccttctttaataagcaattaacaaaagaacatattacaaactagcacatttggtgcaagtagcttgttagaagtcaggtatttggtgaccatcaataatagactggataaagaaaatgtaacacatatacaccatggaatactatgtagtcataaaaaagaatgagttcatgtcatttgcagggacatggatgaagctggaaaccatcatcctcagcaaactaacacaggaacagacaacaaaaccccacatgttctcactcataggtgggagctgaacagtgagaacacatggacacagggaggggaacatcacataccagggcctgttgggagttggggtgcaagggcagggagagcattaggacaaatacctaatgcatgcggggcttaaaacctggattacagtttgataggtgcagcaaaccaccatagcacatgtatacctatgtaacaaacctgcacgttctgcacatgtatcccagaacttaaagtaaaagaaaaactaaaaataaataaaaattaaataaataaatcacaatttgctattgcaagaagaagaagaagagggggaggaggaggaggaagaagaagaagaagagaaagaggaagaggaagaagaagaggaagaggaagaagaagaggaagaagaagaagaagaagaagaagaagaagaagaagaagaagaagaagaagaagaagaagtagtagtagtagtagtagtcaggtatttgtatactcagtgataatagccaaggcatagcccatagtcatacaaagtgatcatcttcatcagataaacataatcattgttttgttttgtttttcacttttccagcaaatattcattgaggacataaaaacagcaaaacatcatcttgtgtcttattggaaataaataatgtgcaacacactacccaaaagtagtttaatattcatgcacagagataattcaagaatgctaattacaattattacctaagcattagaactgcagaacatggtaataccttgtaaatcagagcatgtcattcctctgctcaaatctccctaatgatttccatttcaattagaggaaaaataaagtccttacaatggcttataagccccacttacttttcctctctcatttaatttcctactacctcacttttttgttcttcatacttctgtttcgtggtattggctctagctgttccctaaagcagtatcttcacttaccagtaaggtttattcctgcaccaccttccactacttgctcaaatgtcacagtctccataaggtctgccctgaccaccataacatccttctttttatccctagcactcctgatccctcaactctccatctatttttttctatgacacatcattttctaaaatgttatatagattactcctttattatattttcaccttttatctgtcttcacctgatagaatgtaaaatccaagggggcaaaagtatattgcctctttggttgactaatgggaacaatgcctgacacacagagttcagtaaatatttgttgaatgaatgaagatataggcattgagacaggtaaaaaggaaatgataccagaattcagagaaggaagagaccacttctgggctgggttgatttgatcaatgaagttaaaatttagggtagaaaaggagcaaggatggagaagatgctcagaaaacatgcagctgcccagatttcccctggcctcctactggggatctcactgctgttctccagcccatgagaggaagtgggcagaggtgagggcctagcccacatggatatggggcacacgctgctgggcagagaaatggctgcacatatactgctcctctgaagcaagactccttgctggtctccttctctttttctccttaaaatattgttagaatgcagagatcattgatttcctttgaaacaattcccatacagaatacgacatctcaaacagttcctcagcccttggcaatatttgtgtgcaggtgtttcatgagaagcagcacataaggtcctgagaaccaatgagtactggggagtggcacaaggagcttgtggcacctagcactgtggcatcccctacactccaggaattacactccctcctaaatgtctcccccatctccttgctaacctgacttccagcccccagtcttaagtaaaataggaattatgttttctctcttactacatctgtgaggtgtaagataaaaacaaatgacaaaggatgggcacagtgggtcacacgtgtaatcccaggactttgggaggccgaggcgggcgtattacgaggtcaggagttcgagaacagcctgacctacatggtgaaaccctgtctctactaaaaatacaaaaattagccgggcatggtggtgcatgcctgtaatcccagctactcaggaggctgaggcaggagaatcacttgaacccgggaggtggtggttgcagtgagctgagatcacgcaccattgcactccagcctgagcgacagagtgagactctgtctcaaaaaaaaaccaaaaaaacaaaaaacaaaacaaaacaaaaatacacacacactcacaaatgacagttccaaagacaaattaatctgcagtgaacaaggtggaagaaaggaagaatgaagactacttgataacaaaatacaaaaacaaacacaggctaaaacaaaaaacatgaacactgatgggataaaaaagttcacaaataaaaataatccatacacacacacatatgcacacacacacaattcagagttgagtcttatagccagaaaaaagaagagaagtagagcatgtcaagtggaggaaatgaatcgtgaaaggagtagagagaggaaaggcatgttacattttaaaacaaatgcttaatttgattaagtgggggaatattacaaaattcatgtgtgaaaaatgaaacattaagaaatcagtgttggaataagaggctaaagaatgttgcctttatttagtagataggaaggtaatgatatgaaatgaccaaatatctggaaatattaataagaccaaggtgtagaaagggttgagtggaaggaacattaggtttatctgatataattgatagtgataatagtattatgaaagatcaggcattctaaagttaaaatgccattatctcaggttcaacaaagaaaagataactataatgataaaaatcagcctatctggcgggcgcggtggctcatgcctgtaatcttagcactttgggaggccgaggagggcggattgcctgagcacaggagttcgagaccagagtgggcaacatggtgaaaccctgtctctagtaaaatacaaaaaattagctgggcatggcagtgtgacatgtagtcccagctactcaggaggctgaggcaggagaattgcttgaccctgagaggcggagcttgcagtgagccgagatagtgccattgcactccagcctgggtgacagagcgagactatgtctccaaaaatagaaaaaaaaagataaataaataaataaaaataaatcagcctatccgccagcatttaccttttaggtaaataaaaagcagggcatgtctgtgtagtaactctgccagcagaaaaaatatatatatatatatttatattttatatataaaaatatatatatatatatattttttttctcatgagtagaaaaatcagatggcgaaaacactcacttgctgggaggaatctcagccaaatttccatttactaagaaagaacacctgccatgtttcctgaaaccttcactatttaaaatactcctttaggaatatagtaagagtctactttcttggatgaaaaaaataaacactatccttttttatagaaaaccttaaagtgttctgcatctgttgctggtattcatagtgtgattatagactgtgatttccccactgtgattcttcccttatgttactcagtgggcagaacttttatcttagagactgtcacaaatgaaatacccaaaaatgtgcagtgacataggtgtctccttgataggaaaaagttaatatgcccaccctgtttacacacacacaccactcacacgcaatatcattttttcccagtacccagttgtttaagtattttgcttatctcaagtacctaaaattaggtatttaaaaaaaaatccacttagtccttatttacatgcattaaaaacacagttttctcttccagaggctgtatatctcaaccagcattttgaggcaccttaaaatacataaggagttcttcagaatttctgtatctagttattaaaatctgccttaacaaatgaacagattcttgaattgtcacaaaaagagatgtttctctaccaagagaagcctaccttttttgaaacttgacagaaattatgatgcccttttcataagcaaaatagattattgggcgggcgggaatcgatgtggtgcttgggtagagggcactgtattcgctggagtttctgggagtaatagtctccagtgtgcaactgagtgaatggtcagcctttctgattgccctgctggatattgttctaaaccacagctgctctatgtagcacttgatccaccaaacagattttaactgttattcaacctgttcttagcaatgcagccaaaaatgctgccgtggcttgttttatacgtttgtccttaaagaccagggcagaatttattagtatttttaattctgtaaggcaatacttagtctttaaattttcttgttcgatctcccaccattctcccgaatttaaactcaatacttagcaaatattatgttaatgtccttactgattagacagtagatttgcaaacaagaaacatattataaaattttaaaaaatgattaaaagaatgttagttatcctttggcacagatctccccactatcaacaaaatgtatctttttctcatctctctttatcagtccctctcccctattacctctctttttccatatcctgtaactctctttttcacatctatttatctgtatcctttcagttttctatttacaattataattttaatttagggccactgactttgtttaaaaatagcacctgccactgtagtatttttatgtcaccagtgtagtcaagtgtaccatttagtaaggtatttattaaatttcttcaaaaaagaaaggtctttgtctacatggagagttaacttctgctaaattatgatttgataaaattattatttttctatatctttaaaggctttttgtagtgctggtatttttaattatatttactttaattcaggaagttttcaaataataatgttccatttaaaaggaagcattcagcaaatgctttgatgtcttagttaaggcctatcaacacaatgctttaaaaagttgctgattataatatcgtcttctaataggttgccaccttgtggtttttgaaaaatacagttaacacatttcacagattgcataaatatcctgctctatgttttgtttgtttatttttctcttaggtgaagaatctagatagctaacgactcttaagaagtgtctagggatcattttgaacccaaagcatcgctttgcgaacatttagattatgtgaattcaaactaacagattaaacgccattcactttgaatagcctctggaccattaggagagttggtagtgttattatttaaagcaactgcacataaaacacaccaatgtatcatttgttcttatgctcattcattaccaatagtaaattctttcttacattttttagtttgattcagataattaatttagaggacagtggctttctttgattgcttgttttatagaaataacaagttgtaacttaattgggtaaacagtcacaaatacactacagggaaaaacatattccatgtaataaagttttcactcaattagaaaagagatttgtctcattcatctcccaattcccctacagttctaagcagagtgtccttcacataggcactcaacattactttctacattaaagatcatgattttaaatgcttaaattacaactagtatgtctttcccgtcaaagatgttggtttccaagacctaaaattgtgagatttaatgtgactagttattgatttccctcaggaagagcagtcaaacttgcaattctctgttctaaaaggcaagatactatgtattattagcacctattatgtgttaattaggatatagctcaatttttctcatttattaaaaataagaatttctaactaaaagaacagtttaaaaaatattatatataactaaatcatcttgttaaatattaatgatcatatcttatacaaataaaggatttttgcattcagcaatatattttagaaatgtaaaagttgtacacaagaatctttttaaagtttcatcaatttacttgtggtttattataatttaatggtctgtattatgaatgactatcaaaacatatgctgcttttgatctgtggcacctataacaaagtcaaatttctcattacgacatcctatacctttcaggagtagtcatgcttatataagcagccttagttactgccatgccctcaaatcttatataccaacccgactgaaatagtttgaattttccctaatgtggcatatttcatagctctgtctgaacatgaagtttcctctgctgaatctatccaccccgtcttgcttaactgtaaaactcctacttatattttaagactcaccccaagtgtcacctcctgtttgaagtattccctgaatttcctaaatgtagctgattatttattgcttttgggtgatctaccacaaatatatctattactgtattcaaagcactgtaatattgctttatctttctgaatcttctactagactcttcaaagaaaaatactgtgacatgtctatcttcacattttctatgtcgagcatagtgcctgacatatggtaggtgttcaaaatatttgctggttgaacaaagaatgaatgaataaattttgtcttatggatttgacatgtatttgcattacagtaatacatttattgtatctgaagttagcaataactgaaaagtaaacttcattatagaaccaaaacaagtaaaaaattaattacttgcacatgcttatcaattgcagctgttgttcgctcccactgagagtttcacgtcattcaaaacttccagtttaggtaatggtgtttcagtgaggaactaagtggcctgaatgaggtgatgttgaggagctaatactcagtgggaagcagaagccagcacaattacaaaacatatgcacacctagattctaaaccccattatggacaccagcatcagtgtaggtatactaatgttaatgatatatataccaacattatatgtccattatcttctacctctaggtgctatgtccatttattcatttactcattcaacaagtatattttaattgtttggtaagtttcaggatctatactcagtgttaaagacacaaaaacactctaaaggatatggtaaactgctatgaaagatttttgtcttctggagtttgcattttaagtagagtgtaagaaaaaccacagttacccaaacactcacctaattacatttgtgataattttatgtgtgaaatgacacaatgtttcatatagttgtttaacaggagaactaatctatttttatgatgaaaagttttgcaggaatttgggagatgaatgtacattttctatgtcaagagtagccactttaattccagttttaaaatttctacagcatctagttgctttttcgcaatttaaaaacacttataataaaaaagtaggcattacaattgatgtcacagaaattaaaagaataagagactactatgaacaattacacaccgaaaaattgaataacccagaaaaatgaaaaaattcctagaaatataaaagttaccaagactaaattttaaggaaacataaaatctacatggacccataactagtgaaaagattgaatcagttaacaaaatcctcccaacaaagaaaggcacagcaccagatggctacactggtgaattctaccttacacttaaagaattaacatcaatccttctcaaactcttcaaaaaaaattgaagaggggaaaatatgtccaaacttgtttattgcagtcagccctgccctaataccaaagccaaagacaccacaagaaaagaaaagtataatccaatatcccttttgaatatggatgcaaaaatcctcaacaacatgatagtaagccaaatctagcagcatgtttaaaaacatcatataccacaactaagaggaatttattcctgggatgcaacaatggccaaatgtatagaaatcaataaatgtgatatattacattaacagagtgaagaatacaaggcacataattgtatcaatgaatgcaaaaaaagtatttgaatgtatgtgacaccatttcattattaaaaactctcaaaaaactaggtatataagaaatttacctcaacataataaagaccatatatgaaaagcccataactaacatcatactcaatggtaaaaaacaaaaagctttttctttataatcaggaacaaggtaaagatatccactctctccacttctaatcaaaatactactggaagtcctagccagaggaattagacaagaaatagaaataaaaggcatccaagtgaaaaaggaagaattaaaattgtccctgtctgcagatgataagatcctaaatgcagaacaacatgatgactccacggaccacactgaggtgtcatcttgccccagttaaagtggatattatcaaacacacaaaaaaaaatgtggagaaaagggaactcttatacgttgttggcgagaatgaaaattagtcaaggtattataaacaatagtagggaggtttcattaaaaaaaagaaaaaaaaaacggaaaatagaactatataagatccaaaaatctcactgccggatatatccaaaagacaaaatcagtatatcaaagagatacctccactcccatgtttattgcagcagtattcacaatagcgaagacacggaatcaacctgtgtccatcaatggatgaatggataaggaaaatgtggtatacatgacaatggagtactattcatccataaaattgaaatcctgttacttgcagcaacatgagtggaattagaggatgttacgttaagtgaaatgagccaggcatagaaaagggatattgcatattctcacgcataggtggaagctaaaaaagttgatctcatggaggtagagtagaatgatgattaccagaggctgacttggaaggcagggatgaagagaggttggttaatgggttcaaaaatacagttagatagaaataataaattctgatgtttgataagcagggtgactagagttaatggtaatttattgtatactttaaaataatgagaagaaagatttgaaatgttcccaacataaataaatgataaataattgaggttatgaatgataatacaattaccctgatttaatcactacacattgtatacatgtacaaaaacatcacatgtatcccagaaatatgaataattattatgtatcagtaatgttgaagagattccattaaaaaaaactgttagaactaataaatgaatcagtaaagttgcaagatacaaaattaacatgcaaagaatcagttgtaatttctatatactaaaaataaactatcctaaaaggaaattaaggaaataataccatctacaatagcatgaaaaataataaaatactttagaataaacttaaccaaggaggtgaaagacttgcactctaaaaactacaaaatagtaggcgggacgtggtggctcacgcctgtaatcccaaaactttgggaagtcaaggtgggtggatcacctgaggtcaggagttcgataccagcctgaccaacatggtgaaaccctgtctctactaaaaatataaaattagctgggagtggtgtcgggcacaagtaatcccagctacttgggaggctgaggcaaaagaatcgcttgaacccaggaggcggaggttgcagtgagccaagatcatgccattccattctagcctgggcaacaagagtgaaactccgtctcaaacaaaaaccaaaaaacctgaaaagctactaaatagtgacgagaaaagatacaaaagacacaaataaatagaaatacatcccattttatggattggaatatttaataatgttaaaatgtccatactacacaaagcaacctacagattcaactagatgcttatcaaaatctctgacaagtttttccaaaaataaaaaaagtactaagatgcatatggaaccacaaaagatcttgaatagccaaagaattctggagcaagaagaacaaaactgttggggtcacaattcttgattatatattacaaagatacggttaccaaaacagtgtagtaccggataaaaacagatatacagaccaaaggacatccagatgaacctggaggacattacacagtaaaataaaccaatcacaggaggataaatacttcatgattccacttccatgggaaatctaaaatagtcagacccaaaatggagtagaacagtggttgtcaggggatagggagagggggaaatgaagagctgtggttcaatgggtataaagtttcagtcatgcaaaatgagtaagctttagagatctgttgcataatattggacttatagttaatacaatattgcacacttaaacatttgttgagagggtagatttcacattaattattcttactcaacaacaaaaaaacttgtaaattcttgtgaaaccattaaaactttattcatgtaattttgcaattgaactgaagtaatagttcaaactttcaagaaaataagacaatgttttctttgagaaagttgctataatatgtacatatcaacaaaaatatttttaattaatataaacttgttcttaacctttttgaatggcacatgatattatttttacctgtgtattcaagatgaaatcctgcagcagaaacactgatgtctgattgaaaatttagatacagattattagacgtactattcaaaagatggggtattgttgttcctgaaatgatatatgagaaggcaagacaatgaccacataataagtactataataaaattaagtaagtttactaatcagccaatagaataccactaaaaatatgcattattcaagttgtttttcaaaaaaaatttaatagaaatatttttctcacaatcctctttcaatatactattcctgtttccaagaagacagaccacctgagatggctttagattgcttcctaaaaataggtaggagcaaaaagagcttgtgaaagttaaagctatacgtttgacatgttcaccaaaaataaatgttgaatttcatgtggatttcagtattccgtgcacaagctaataataaacaataaatacatatatatgtaaagttatattctgttagaaacatgaatgtttgcaatgattgctttcaaagagattattactctgtattctctctgttttccaatatgtttttttgaagactgtgttataccagaggcttctgattgtcaaagtgataaccagttttaactgcctgtatgtaccagattggtgaactaactaaaaagaaacacaaaatatgaataaaacacagtttgcaaactaaaaaagaataaataataagcttaattttgaactttgcaaagtaacaactttttatgagtcagataatatagtcattgatttccttttaataatgaattaaagttagacagctagatagatagattattctataccaggtcaagtgcctcaatgtttcttataccctgacagcaaagctggtagtcagctttcaaaaaaattccaattatgaactactgttactcttgtctttcagcaaatgcattataatgatatttttctggacttctgaaggagatcaaatttattttattaagttattgagcttgaaaatataaagtatctgcttgaatcaattatttcttgactttgctattgagcaaagagtttaagatctttgactccacctctagcagtttcaaatggcaagcatgaaaataaacaagcgctaattctacatcttaagacatagttcaacaagcatatgagttgaggtcattacaaacatttctttataagtaactactttctttacatttgctttgcgcaactttgtggacctcacccctgatgtcttctatggaagaacagaaagaatttattacacagcacacacttgcttcttttctggccatagtgtgataacagcaaccactgaagacagggataaacagaaacttaaaaggtcatttcacctgccttaagtctcttacaggatgttattgattaagagctctaattctggagtcacaccaggtgggtcccaatctcattctaacattagttgtacaacctcaggcaacttaatctctctaagcctcaattacctaccaggtctgctagaaagatcaaataaggaaatgcatggcaaatgtcacacagagctagcacttagtaatcaacagctgttatttatcactcatattatcattacattattattttaaaagtattacagatgggtatggtggctcatgtaataatcatgggattacaatcccagctaatcaggaggctgtaagacaggaggatctcttgaggccatgagttggaaaccagcctaggcaacatagcgagacctcagctctaaaaaataaaataaaataaaaattaattggggttgtggtatgtgactgcagtcccagctactcaggaagctgaaacagatggattacttgagcccaagaattcaaggctgcagtgagctatgattgcaccactgcaccaaagtctgggcaatagagccagaccctgtctctaaaatgcaaaaaaaaaaaaaaaattaataatactactaataaagtattacccctaacctattacaaataaaagtgtgctaaaattgtgtgcgatttttctaagatttctatctaaatctatattgttcatgtttaaatcaaatcactcttgctccagatatttctttcttttcctcattggtgatgataagtaattggttccacaagtccatttaaaaatctcttaaaagcttaaagccattcaaatttatttcagcatatctgaattgagtaagttaatatgttagctatatttatatttctagagtttaaaaagtataatagtaaaaaattaacaaagtaaaactttttattttaacttctatatgtcaaaagaagcttttaaattattgcataaactaccttttaaacctcaataaatctggctgggtgttgtggttcacacctgtaatctcagcactttgggaggccaaggcaggtggatcacctgaagtcagaagttcacgacccgcctcgccaacatagcgaaaccccatctctaccaaaaaatacaaaacttagctgggcgtagtgacgcatgtctgtaatcccagctactctggaggctgaggcaggagaatcgcttggacccaggaggcagaggttgcagtgagctgagatctcaccactgcactccagcctgggagacagagcgagactacatctcaaaaaataaaaaccttaataaatctaacagattttaaaaacaagtcaacatcttacataaaaatataagacttctattttatttatttctggtcttgttaaacatgtatacactaattttatataattttattcatttcatagaaataattctgtattctctttattctcatttaacagtaccttgtagcatttacctggttattttcatgacttcatagcacacaattcaaagcacagtctaatttttaattattattgctcatccttttcttttaaggaaaagagcgtacatactattcctgaaccctaactcagctgaaaatattaccagtaacataaaaccatcaataaataattacacaaatataggaagaattggtaagaatgtaataaggttttaaatatcaatattgatatcatctttaaatcttttaaacttcagtccttgtatctttgtgtatagtttgtaaaaagcaaattaaaactaccaagtaagagttgtagatagctctttaattttttttatattcctaattatatctgtattttaattaagctcagctctcttatttacctgaatagcttccaagtcttggagcattgttgtctcccccatcataaaagtccagagaatcccaattatgttctgtagcaaagctaacaacttgcacctgtgaaataataattacaggtaagaatacacatttctaaccagatacacataactatagtccaccaatcccccttggaaaagagagttcaaatcctgaaccacataattgtgacccttcatagaagggtttttaacagaactgattttttccattattgcactggcttacacgagctgatttttatatagaaaagcctttgaagcaccgaccaatgttcattgtgggtataaccagagcaatgtctgtcactatctcagaacattctcttttcaaaagatttgagctaatctaatgactcagtgccaggaatctcaatgcatgttcaaaacaatcggtgaatttttatgtatatgtactgatttgagttttctaatttgcttgtagctattaggaaaaaccagatctgtggtctacaagcctgtaggaccttataatatacctttttaaaaccaggtttatttctggatacttttaatttatcctttccttgcataaactttgctcaatttcttctcttccttttatttaaaaatttttaacacgcatatttttaataagtttcagtatggatgacacaaaaaaatgatattttgtaattaattcaaatgaatttttaaaaatttattttaatgaatagagttatagtaactacgtcacagtgaaggtccttaaagttgagaaggaaaatactggggaggtttaattctctcctgtctattacagtttatttagagaaagatgcatgtgttactttattgcacatcacttggcacagcttgagcttttgcaagaacccacaggaccctcacaactacggatgctacctattttgctatttctttattaaattttttgtggttttagaggaaggaaaggaataactttattaaaagttttttaagctaaaatctgttaaaaatgtatgcactgcactcattcactaaataattacaacaatttcactcattaaaaatttattatctgcaaaatagcccatcattattcttccatgcaagtgaatgctggtgcctgtttccaggggtgagtgccacatggcaatagataccctgcctgtatgattggcatcagacccaatggcagtgttctaagataggaataagaccagaagtaaagccgtatgattgtagtataaccgccacctccttaaacaattatcaattccctcttcatatctaaatttccctttccttcaattcagaggaagaaaatactgcattcagctttttaaaaaatgtgaagattcacgcaggagttgacatttgggctaagctgaagatattgagttattccactgaaggaaattattgagtgtctaacaatgtaaaaggagtcaaaccataagctagatttagtggaccatgagtaatcttctttagctacagtggggggtatttacataagaataaatatacatgaaaagttcgagaaagaataaaaaagttcaaaagagtagagtacagtagctaaatacaagagaacttagaatcaaagaggctaggtttgcaacttcctggctccctctcctcatgggcatatcattcaaggaaagttgttcatctttctgtacctcagattatttacataaattattgtcataagggtatcaaattcataaattcattgtaaaaattaaattagttaattcatataaggcaccctgcatgtagtaaagactcaataaagcttagctaagaggaagatcaggggagaaactcaataaaaaactaaaccccagcatagcaactatgcacttcaagacgtggtgatatcttcagttttccaatgaaggtttcagaagtcggaggaagaacatgattaagacagtgctctaagtacagcactgcattgggtgaagaaagtaaaagtgaaagacaatttcaatatctatttcagtaatatttcaatatgtattgcagtaaaaaacaatgagagactcaagtgtattggaggcaggagtagtaaaaatgggaacccagacgtcacatgtgttgctgtagaggaagttattaaattttgtgtgatttgaataggggaggaagtgaaaggaaaaatttgagaataatttattttcttttctgttattgagagtagtggggtagcaagagcaaaaatgtagacatctccaagaaaatctattgcctaggtgggagaaagaaagtcagtttacttctggatacatgtgtctagtgtatatagctgaataatggcttctggagatatcaggttctgatctctggaacctctaaatactaccgtatatggaaaagggtctttcagatgagcttaatttaagaatcttgagaaaggggaaaagaggccaaaggagattcgacattcatagaagagaagacgatgtgaacacggaggcagaaattggagtgatgtggccagaatccaaatgccagcagccactagaagctggaaaaaaccaaggaagagatgctgtcattcctgagaccctgaagtgggcagggacgagggaggagaggttctgccagcatctcaatttcagtgcagtaaagctgattttggacttcttgcttccagcgctatgaggaaaaaaataaaatctgttgtttgtaactataaaactcatggtaatttgttacagcagccagagagatgtaatataatttgccactgggattcgaggtacattgtgaatgtagtttggcataataaaaatataaagagtgtagaagcagaatttggccagaagaactggcagacaatgctatgagatttgttaagggactcaaatacatgatcgagtactcactatgacagaagacacatgaaagccaaccaaagattttttttttcttttttagacagagtctcgctctgtcgcccaggatggagtgcagtggcgcgatcttagctcactgcaacctctgcctcccgggttcacgtcattctcctgcctcagcctcccgagtagctgggactacaggcgcccgccaccacgcccggctaattttttgtatttttagtagagacggggtttcactatgttagccaggatggtcgctatctcctgacctcgtgatccgcccgcctcggccccccaaagtgctgggattacaggcgtgagccaccgcgcccggcccaactaaagattttaaaagaggtaaatactgattcagtgttcagagtaactttgcgttagatatagttgtccatcatggtaatggaatagcttcatgaggtaatgaatttccaatcattaaaactaggcatctatcatataactgttcaaattacattttactttagattatataaaatcacgataatcatgctgtaaattgatacaataatgtagccaacatattttcccccatggcttattacataaatatttcccttttcttgatggctatcactgctaattttgaatgtagctgcactggaattctccaatagaccctgctaaaataaacaaacaaacaaatgaatccactctttgccacaaagagtgggaaattctcatgtaatattaacaaattgtttgttcaggtaattcccaaagaatgttcaattattctatattattgtaatttttcagcattccatatgtttcttcttttctcctcttttcaagaatgattatcccactttatctcatatatgatttattgaatattcatacaattctttattcacacacatatttggcccaacagagaaaaatattaaacattgctttaaacctagggtagtagccagatagcttttaggtaaatttaatgaagtttcaaatgtaagtcatatattatgtgtgtgtgtgtgtgtgtgtgtgtgtgtgtgtgtgtgttacaagtttctatgactcagtgatatgtctaaaactagcatccatgtaaatggttaattagaaaaaggtccttgatagtttttttttagcgtgtttaaaattaaaagccccaaatgctttacacactatatgtttgctaaacgtgctgctaaactcaaattttgttttctaaagtacagtcaataaacaaagtccttcctcagtgaaagattttagtgttattcatatgtgtccagttttgaatagtgtttgcctaggataagtgatatataacacagtttttctgcaaacatcttagtagttcgttatgcctgctaactctaaaatagtcaaaactccacttgtgcaagtattcattgattcgttctaaaaatatttactgagaatacactgccaagcactgtgcagcatgtacttccactgtactagttgtcagaatggacttggcactgtcctcatgagcttacagataattagtagtaacattgaaatatgatggagaacttaaccttgtctcaagttcatggaaggtcttccacagaaaatgtatttaagttgagacagaaatgttaagtaagaataagcaacataaaaggagatcatagagagtgctcacagaaagaacaacatgcacaaagggtccagaggcaaaatgaagctaggtttttataaggagctgaaatagtgcagatagaatagttacaaaatgagaacagagcacaacggcataatcgacagtgtcaaaagagataaggagattggagacaactgaggtattagatacaagaaaatgatagtattagatttttactttcagatggttactctactggacgtacagggaatagactgcaggagaataagaacctgggacaagggtgatgctatctgatctcgggtagtaaaagtgtgaatggagagatatagatttgtttaagagatttatgaaagacaaacctgacgaatttcattgtaccgagtaagagtcagaaaagaatcaaaatttctgacttgtgtaacttaatggatgaggaagttgttctgagaaagagaacactgagaaagttctatagttttgagaaaattctatgaagtcagttttagaggttgaatttgacaagccatcaagaagtttagctgaaaatgtccagtgggcagtcggacatatgttttgcagcttaggtgagaggtctgagttagatatttaggtctgcatgtcatcatttattcagtccctcattcaaaaatatgttttctgattatctattatgatttacgtcctcgacatctctaacacataaaagtagctgaagccatggaattagacaaggtcccagagagagtaaagtgaaatgaacaaaggccacagaatctcataaacactaatatttgaacaatggattgaattgcaagaggagaccatgtagtagatatagaagtaggagctacagatgtagaagagaaaacaaaacaaaatccaagaaaatattggtgtcctaggatctaaggagaaaaaaatagtctattaggagtcaggggaggaacagcaagatagagagctgctgacagagcaagaaagatgaaccacacaatggatttaatcatatttagatcttcactatgagactggctctattagagtattagttgctgaagccacattgcagtgggtcaaaaagagaagatgataactaaagaaaacatgtcagggttttcaaaattttaagattagatggaaataagtaagctgatttaatatatagatgctcttgaataaccttgagaagattataaccagatgatgtggtaaaagttctatgaagattctaaaggtatcatatcatttcagatcctctatacaagctggagcatgggcaatcccaaaatccttattattctactataataagataggattgattcgttatcttcaaatttgacaaattgtctataaactagcaagaatgtaagtatgcatctataatctttggatggccttaaaactctgaaaatgtacatgctttttgttttgtcattggtttgctggcatattttactcccaacacctgtcaagtaatttttaaaacgtctgaacaattataaatccatgaagctgattttttttactaaaaattatgcttcaatctaatttcattattaatgcatggcatcttggctaatttttccacaactcttatatgtctcaagtttctaaagaaaaactctacaaatcaattagagaagtaatcaagttatatctgtgaaggctagataatatttatgaagcataattacctttcataggatatatatactgattctgcagtaaaatattatcaattcatccagaaaaaatatatatctttatgtaaaacagaataactggtcaaatagcagcccccaaaatagccataattcaaataacaggacagtcactgttgattacctatttttaaagagcatcttccttccttgctaacacagatctggcttagttcaattaagtgagagatgtgtgcataataggaggctgcacttattgcttactcctgatacgtaatatagttttatttgagccaaatcatagtaaatctttggttgttgcccattgcataggtttggaacggatatgattgcaatcttggtcaataaaacaggagggaaagtctgctggcaggtttcctgaaaagttttcttaaccactgaaatggtacataacatagggacattctgttttagctgctggccattgctatgtagggctgttacgcctagagcttttgcagccacctcaagacctcaggagaaggtgtctaagaactaaaaccaacaggctgagcatggcagaacagagagatggaaataacgtgggtgaggaaagacacactgaacccctgaaataatgtttaaaatctgcttacctcaagattccatgttatatggggttaacacattttttttgtattgcttatgccatcttgaattggctttctgttaattctacgtgaaaaaaattaataacaaatatctttctattcatttcaaccatgtcagtcaaaaccacttgctaaacttttagaaataatgttcattctgtcatctctgaaaagattaactacacacatacaatgaaaagaagaaaaacttaaatattcttacttgaatgccagctccctctggcactgtgatcttccacacacaattcagattgttgtcataaggctcagggtatccaggtgacaaaatagtccctttgcgcttagttaaaattccaccacagggcactgaaaataaagcagtccaagagagggagttaattctaatgcaaaggattaaaataagagtaaaggtcagagataacatcttagacagatactagacttgcaaatcaaatcatacttttttcaaaactgataaaagcaatgaaaatgaagtttttgtataccatggaaacgataacaaataattagacagcattaatggatgacctttgaatggcatatctaaaaatcacactacaattaactcaataacagcatagtatttgtattatattactaaaacacgcattgactaaatttgccttaaaaatagttcatttttagataaaaattgtctcgaatttttaaaaaattatttggtactttctccttcatgcattctttgaggagtaacagcatccactggaaagtaatgaggatgatgataacaattatattatgatcataacatttatatagagcctactatatgcgaggcacccttctaagtactttacatattttaactcatttaagccttccaacaactaatgagatgactaagtactctccacattctacagctgaggcaatcaaatggagtcattaagagattgtcttgcccaagatcacatatgaagagatgaagctggccaggtgcagtggctcacgcctgtaatcctaccactttgggaggctgaggaggctcaccaggtcgggagttcgagaccagcctggccaatatggtgaaaccccgtctctactaaaaatacaaaaattagccagacgtgatggtgggcgcctgtagtcccagctactctggaggctgaggcaggagaattgcttgaacccaggaggcagaggttgcaatgagctgagattgcgccactgcactccagcctaggagacaggataagactccatctcaaaaaaaaaaaaagatgaagctgagatctgaatcctggcagttgaagccagagtccatgtccttagatggaactgaagatacttgaagtggtcccagtttagttattgccagtctaactactacaagaaagaatatgtatgcagacctactcagaagtcaataaaggcttctatcatttttagaaggtactagtctgaaagtaaaattctcatgccattaatagaatcaccttgattctggccatgacctaactcataactcttaaattctgtgtgactttgacctgttctttacaatctctgaaacacagatatcttatctgtggaatggtaactctattgtttctaaaaggcttttgtgaaaaatacaaagaagctagaatgtacataagaaacaagcacacaccttggaaaacagttagaaatcaataaattatatttccttttgctacaaatattattttaggtcccaattgtactgtgctcctggggaatttgtcctagtatggctataaatgatgagatacaaagaacatatcttttgtaataataatttattttaaaagtgaattacagttttgtgccacttccaaagacaaacgcaaaaaccagggcaattactcaaaaaaaaaaaaaaaaaaaaagatgttgcaaactttttaaaatagtgtgacaatatatttttaaagaaactcacttagtcgtgttttcttacaaagctctgtaaatgggttatatacaaattctgtttaaattagtcaaaattaatttagctaatttaaatagaaaaccagcagttttgcatgatttgagaatgacatgcaaaagacagaggaagaaatttaaaatattcacccaaaaaatagaacaaaaacgtaattgatgaagtgttgatcctgctgatgaaaaaaaaatactttatagatgctcttcctctccatcgccaccgccacaacttttcctcatacgtactttttttttttctgagttactacattaatcaaataagtggcctccctatggctggtatgttttccatgcactatatttttcaaaatactgtcaaaattatttttctaaattaaaatatgacatgttgcttctctggtgaaaatccttcaaaaatttccccattgtctgaattcacagctcacagatagtttcttttttttctttttttttttttttttttgaaacaagctctggctttgtcgcctaggctggagtgcagtggtgtgattatagctcactgcagcctcaaattcctaggctcaagcaatcctcccacctcagcctacagagtagctaggactacaggtgtgtgccatcacacccagctaatttgtgtacagatattcagctaatttttatatagctaatttgtagagacaggatctgtgttgctcaggctggtcttgaatcaccagcctcaaacaatgccgcctcagcctcctaaagtgctaggattataggcacgagccactgtgcccggcctacagataaatatagttaattgtattagtctctgatttcatctccaggcttgtatgtaactataatttcccaagtcctcatcatcttaatcccccaacccagtccagccttctaaactaatatgctttcttattgctgtcacttgatttgtccccttctctcacctagctaacacctacccatctatggactttcagtgtgaatgttaccgcttcaaccctttggaatttccctgtgttaagtgtcctgtagtttaccatagcaccaaatgttttcctgtacaattttatcatactatgcttccgtattatttttatgttagtctcttgaaacagactcaagtctgagcagacaaggtcacccttttgcctgaaactctgtttatcaagattctaactcttcttctttgcattataaattttcttccatgctgctacagtgacaagctatctcctcttcctccatcctctctttcatgcattgcatcagacttttgtcctcactactctggtgaaataaccatgtcaaagtcaccagaatattaatgttgtgatatgatcaatccttaacttgcattttactcaatctatgaataattagctctcactgttgatcactccatctgtcttgagcctttgtttgcttgaacatcagaacaccatactctcctggttttcttctctattattggctgcactcagattttttttttttaactcattctcctctttgtaactttgtcttaggccatattctctttctaatcactgtccccccttccatgtcttctatatactctgactaccagatgtttatctctagctgtgatttctgtgagttttgcaatcatatgtctaacaagtatctcaaaatggatatgtccaaaataataactttgaaattcttcttcatccacactctctttcatcttagggattgtcaccaccattcactcagttcttaggccataaacctaagattcatcttgatttatctttcttgcagtcaagtttacatttacatctattctcaatctatcagtaatggctccaccttaaaaatatatcccaaagcttactaattctcatcactgtgaccataatcttcctatccaaatcacactacttttcccctccattaccttgataggcttctaatcagtcatattggttctactccacatctccctacactaactacagtgatttattagaaactgattaagatcatatcactccccagctcaatatattcccatactagttaggaaaatttcaaactcaccgtggtcttcaaggatccatgtgacttggccctctgctctgcctctctaaactcatctcctatcactctttgctatcatttactgtgttccagacactgtggcttgaacacgtcaagatctctctccctcaacagtccatacacttgctcaccaacaagaaagacttttattcatccctccctctgttcattttattcaggtttaaaatggcagcatgctctgggtgtcttgttgcaactccagctcctgctttatttttttctacagcattctcactccccaaaagaaaagaatatatttcttgatgacttttgtcctcctccagtaaaatgtaaaatgtaaatgcaaaatgtaaggacaaagatcttatattcttattcaaaactatgtcaccagtgcttagaatagtgttggcatgcagtaagcactcaataaattattgctgaataaatcactgaagaactgattgtgtatctgtacatatcttgtgctttcaaattacctctttatcattcctgcatcattcctgtctcccagtatttttctaaacaagccatatttgtctaattctactgcaatcatatttatttatttaccaacaaaatatgctatagaaaaattagcagatacgcaataccacaatctaacatttgcatcctgttttttaaaagatatatgataaatttctgttctgatcagtattcaatataatatgtggattaatagagcaggctttcaaatcaagcagcctaagttcaaatccaattctgcctttttatctaaaccaagaggttttactatctgtaaaatagagataattatatctaccttccaaagttgatatcaatattaaatgagataatgcttaatagtgcttcattcaaatgccaaaaattgctatttattattgtatttaataactttttcatggatgaatggatagatgaataaatggataaatgaatgagatggagagtttgtatatatttcttcatgaactttttttcccattctaagaaaagatgaagtagacaggtgttgccatggagactttcaagtaaaagtagttctttctgggtctctaaagaacttgaaaaaacagaaccagataagcatgatcagataagcagctaattaaagactctttgcctaaggggagtaggtggcagcttccagggcttttcaaaaaagacctcccactaacagaagtacttatgcctaaggtcatatattgtcaaagctattagtggctgcagggggttatttgaatcacagagtctaaaagggaggaaagcctgggggtttaggagactgcatagtttaagaaatgtgaaatgtaacaaggtcaaatttggaagataaaaactcagtcttcagcataagttttatttttcagtttttcattggtctcaagtctaatttttttaagtaaaattttattgtattttattgtaattaagaaaggcttggaactacagctttgtacaagattattaaatattgtttaaaaactggttgttaaagtttgtgaatcttctaatttagtatttgaccattttaactataagcacaactcacatatcatgtcttatggggctgctttccaatcaacagtttagttttagtatgtcagtgtgtgcaaaattaatgaacattttcttgtgctttactgtgacagaaaaaaaaacagtgttgacagtaataataagaactgtgaaactgaaatgatacaattgagagggaaatcattaggaatgtagaaagcagtattgttttgctttcaattggatgctgacttggcttaagttattaactgagcattcattgaactaagacagaaaaacaatcatcatgtataaaaccctgtaaataggctgtcaaagattatatctaaactgtaaagggtaaatggagaatttgctctctctcagaataaaactccccatataatatgtaaatcttttgcttgtgttttaccaacatacatatctttcctgcagatgtcagaagagtttgaaacctcagatttgtgaaggtttaagcaaggaaactatgcaagagtatcaccatgtggtggaatactgaaatggaaaaagtatggaccttggacttgggaagttggtaagggttgtcagaccctctacaaatattcaggaaattgatacagtaatttactaaaatccactcactgaataaaagtttgctgaacacctgttgtgtgccaagtcctcttttgattgagcccaaaaccaatatagtgacaatggaaagagggacaattaagacagattaagaaatgttttacaaccaaaaattatacataatacagttcgatggttgctgtaaaggtaatggtataaagagtaaacggttgatgggtggcagaaaattattttagataggatggccaagaaaaataggagacttcaatgaaatgatgtagtgagataaaaagctatctgttctaatcagaggaaataagaaattcaaagaccttggggcagatgttttatgcagttaacagaggttgaaaaggagcacaaattaaagagaacactttgatattaacgtaagatagctctgtacttgactctcacatttgaatatttaagacactgagctttttctatcttaaaaatattttaagacatgaccatttttattcagaacattttgaagctaaaaatatttatagttaaaaatagaaatgcaaactatattttcatttatgtaaagattagtagttgcaccaaatggtaaaacttaaacttgtctatcttctgaatgtcatttagaatcatcacctttctatttcttctgtcacatagaccccatatatccatctgtcatattgtcaactttatggatttacacctgttccacaaggaagaatatttttaaaacggtataaggtaatatgtctttttcatgtgatcttggcagaaaatacaagtcatatgacacaattttctatctctggatatgcacttttaaactgcctcattctattcaggccatagcaaaataccatagaatgggtggcttataaacaacagaaatttatttctcacagttctggaagctgggaagtcagcactggtagatttgatgtctgctgagggcccctttcctggattatatacgaccgtcttctggctgtgtcctcacatggtaaaactggctagagatctctctggggtctctttcataagagcattaatcccattcatgagagctctgccctcataactaccttccaatccctgcccccaatactatcatcttatgggttaggattctaacatatgaatttgggggattcaaacattcagactacagcattctgctgctggcccccaaaattaatgtcctcacatgcaaaatacattcattccatccctatagccccacaagttataatttgttccagcatcaaccataagtctaatgttcaaagtctcatctaaatatcatgtcaatcacatatgggtgacactttaagatatgattcatcctgaggcaaactcacctccggctatgagtctgtaaaatcaaacaaactatctactttcaaaacacaatgatgagacaggcacgggacagatatttccattcttaaaaaagaaaaacagggcagaagaaaggggtaacagatcttaagcaggaccaaaaccttaaaattcaagaagaatctctttgattcaatgctctgttcttcagtcccactgggcctatggtctcacctcctagactcacaggttggaggtctccacccagacacgctgcagggaaggtcccacattctggacctactggaggttatagtcttacttctgtaggtttgctgggcataatacatactacagctctcacaggttagagttgcatgcctgtggttctccctgactaacatcacacaccagtggctctactgtttcatgatcatattggtggccccacctctgtagctccactggacatttttccacaaggcaatgctaaaggtgtggggctatccacatgacccctatggcagttctttgcctgggcagagaggctttccaggacaccctttgaaatctacacaaaggcaaccacatctccatagctttattgggtaccgagcatggtgagccagacccacaggaactatccctatgtagccaagcagctgtgtgacagactgcatgaatcagagcctgaggtttaaggcccttcctttgaaatctgactccaaggcccttgcactatgggcttgtgactggatgggtagcctggatgatctctaaaatgcactcaggttcattcttcctttgttttggacaataggtcctggcttctgtttagatggctaactaatgctctcattgtattgatgaatagcttctagcttctactgagattgtgagttcatactaatcttcttatcaaacgttacttgattaaactcttttttttttttttaagacagaatctcgctctgttgcctgggctggagtgcagtggtacgatctcggctcactgcaacctctgcctcccaggttcaatcaattctcctgcctcagcctcctgagtagctggaattacaggcatgtgccaccacgcccagctaatttttgtatttttagtagagaccaggtttcaccacgctggccagggctggtctcaaattcttgacttcacgtgatccacccgcctcggctaaactcttaaagttctcttttgaataggtcttcccattttcccaatacaggtaggttgaaagtttttaaaatatagaagttttgattccaaattttttttttttttagacagagtcttgctctgtcagccaggctggagtgcaatggtgtattcttggctcactgcaacctctgcctcctgggttcaagcgattctcctgcttcggcctccagagtagttaagactataggtgtgtgccaccacacccagttaatttttgtatttttagtagagacagatttcccattggccagactggcttcgaactcctgaccttgtgatctgctcagctcggcctcccaaagtactgggattacagttgtgagccactgtgcctggtcccgatttccaatcaattaacaattccatgtttaaatcattggcagtcaagagaagccaagctgaaccattaacactttgcttagatattttctcagccaaatattcaatttcattgtttaaagttttaccttctagaaaactccagaacatgaacacaatcagccacttttgttataaagtggcataatctttgccacattataacaagaatattctttcctctattgttcaacaacttgttcctcatttccatctaaggattcatcagaattacctttactatccacatttctactaatattctgttcataaccacttagatattttagtaaaaagatgttgcctttctctagagctttcctccttttcttctgagccctcatcagaatttcccgttacagttctttcacaacaatgtaggctttttctagcatgcacctcaaactcttccagcctacacctgttacccagttccaaagctgctgccacgtatttaggtttttgttacagtagcaccccactcctggtaccaattttccatcttagtctgttcaggctactataacaaaaaaacatagactaggtggcttataaacaatagaaatgtatttcttatagttgtaaaggctgggaaatcaaagttttctaaagcattggcagattcagtatctgatgagggcccttttcttggttcatagacagctattttcttgctgtgtcctcacatggtagaacaggtgaaaatatccctggtgttgcttttatgaggacactaatcccattggtcatctcctaatggccccacctcccaatacaatcaccttaggggttagaatttttacataaaaaattggggaaaacaaatatttaaaccatagcaagaatcaatgcaaaatcaaaagtagtctgttctttatctaaagactcctgatggatgcagtgtaaggattctcaaaaagcccaggaaatacagactgctggatctctgacagagagatggtgtgggttcctgggtacccacatcttttgccctaaaagtaggaagtgagttctggctgaatctaggttgagaacagtaaactagcattcactcctgaagtggaatatcagtaatagactaggtaacagcctaaagcctttcataggctttagttcctggtgttagctactgtacttgctaagataaatccttagttggatagcatcaccttactctttttatatagatttttatttttgatggctaaaatgctgggattaatcaattgatacatttgaaatacaaaaacactttgcaataatcatgtagaataggggccctcttcagtttcagacacaaatggttaatggtttaaaatttatagtcttgggccaggcccggtggctcacacctgtaatcccagtactttgggaggccgaggcagatagatcacctaaggtcagcagttcaagaccagcctagccaataaggtgaaaccctgtctccagtaaaaatacaaaaaaattagccaggcatggtagtgcatgcctgtaatcctagctgcttgggaggctgaggtgggaggattgtttgaactcaggaggcagaggttgcaggagatcgcaccactgcactctagcctgggtgacagtgcaagactccatttcaaaaagaataaaaataaaaacaaaataaaatttatagtctcatattctctattctatgtttcacaaatattctcttcaaatgttcactttcttcactcacttctcttcgcttgctattttgctatttttttttaatttttccttttctctctctgtttaatgtgacagatcatttctcccatctatatcttgcctctttctaactctgtctcatctgcatgtcttcatggatataagaatatttatttctttggataatgtgatgtttaaatttttagggtaagaagaaaagcagagcataaacattggttaaatatatacttgcaaggcctattaaaattgtagtaataattattttaactttgtttttattttatgttaaaaaatttgccaacaatgaaaacaaaccaaaatgtctatttctttaagtacactcctcaaccatttgacctggaatgcattaattggtggaaatttcactgtcctcctaaatggtatattttaataaagatttactagtattttcaataaaatcaacacatttttcctaaactttcatataaattttaaatgcaaatagaagtcaaacattcaaggaatcctaaattagagttggaaagaatgacagtactcaatgctttcagccttttccaaaatgcaaaaatcttctgtggaaggcacattttccatataataactttaaattgttttaaaaataaaatgtcaacaaattaaaatcaatagtatcaaacacttgatcagtactgcatattaagtcctatattctgcatcgaatacttttagaattggaatcttctctcttgattttgtggtggcttatttgacaaaaacaaaaacaacctattttctttagtgcttattaggttccaagaactaagccaaggcttttagtcatttagccataatgaacctatgaagaagttttcttattttcttgttttattggtatgggatttgaagatcagagattatgtaaattttccaggatcttattgtaactcacttcaattcagtcatgcggacaaagcgaagacattcacccacgactcttgtgctgataatttagtacaattcccagctctgatgatttcactcaattttacataattctttacaacctttcacgttaattagcacattaacatgatagatatacaaacagaacctttaaggattaattcatacatttacatttcagttcttggcatatgtaggttctttgaacactctaactaaaggaataaaagggtttttgatgatatttaaagattaatgaactagtttatgaatttccatgtcattatattactctgtttttacagtagattatatgaaactaaatgaagagaactacttatctaagtccttctatttttacagcattgatattttctgtcaatacctacataaatatattaaaagtgacacagaaattatgtaaataattactggggaaagtgaggcagaaataatgattcttagtaattacagaaaaagatttaaaaatctactgtgagttttgaagagagttattattatgtgtctgtcttcaattattaaactgatttcaagcaatgtaatttccaatttatgcatattgcatgactaattttcacagacatatagaaacatttcttttagctcatgattcctttagttcagaatgttataaatgttatttataacatttcatgagtatgaagtcaatgtattgtgttgtatgtattgtggttcagaaaagaggacattatttgttttgtctttatgagagtgcaagtacctaaggggaggatctctctgccatattaaccccagctctctggtaggcacaagataggcggaacattaagtccagctgatttatctcctgtatttgtggactgtcaaaaatgtattttaatagagtcagcaattctgcacaataaatgaggcagaaatgtaattgggaaatagcttataagtcagaacataaagagaagcagtaatctatcaattaatttagggttcaaaggtagaaaaacttagttttaaatcctgcctccactctaacccttactatgctctgccactttaaagagaactattttacctctttcagactcagtttattcatctgtacattccaaaagtaacagttccatagatttgtcagaggattgcaacaaatatgtatttaaattacttagcatggaatcgggctcttttagacaattcaggctgctataacaaaataccatagattaggtaagttttcaacaacagaaatgtatttcttagagttctaaagattgggaagtctaagatcaaggtgccagcagatgtagtgtttggtgagggcttgctcggtgcttcatagacagtgcctctgtgtcctcacatggtggaaggctgaatatgcttcctcagacttcttttataaaggcacaaatctcattactgagggtagagcccccgagacctagtcaccttccaaaggccccacttcttaatacccccacatgggggattaggtttcaacataagaatctgtgtgtgttgttggggggcggtggggtgagggagagaataaatattcagacgataggattggcaaacagtggcattaagaaaattataaatatcagaaatcagaaatcgtggttatttagctaaaagataagaaaattggagagtcatttacagtcttctagtgttttaaattattttttgtaagtgttcattcaacaaataacagaataatacaagaatagttcagattccatctattgtcacggaaaaaataaaatatttgttttaagaaaaaaatgcactgtgaaatatgctaggtatatttttggggttggggtgggagtggcgatatcaaattcctagagaaatcaaatgaccaaccatccttcctagttatttgtgagagcctagtttataccattatcctagcacaattgttgacaatgtcctgatttaaatggtaaaaaaaatatattttacttaaagcaaatatattctataaaaattacataacctggctgggtgcggtggctcgcacctataatcccagcactttgggaggccgaggcgggtggatcacgatgtcaggagttcaagaccagcctgaccaacatggtgaaaccccgtctctactaaaagatagaaaaaattagccgagcatggtggtgggtgcctgtaatcccagatacttgggaggctgaggcaggagaatcacttgaacctgggaggcaaggttgagtgagccaagatcatgccattgcactccagcctgagtgacagggtgagactccataaaaaaaaaaaaaattacatatcctgtgaatgcatatcaacagatttatctttgatctcttctcagtagaaatgaatgtaccttctatgttatttcataatttaaaattattttttattctaatgacctatgaactgacatgtgaacaaatgtattttaaaaaggtaaaaataagaatggcaaatataatttattttcatatggcaaaatgtgttattaaaaagtaattttatatatttatgattgtctattatgtgtcaatatacacactcattcctccctatggagagtggactattaagattattaaaattaaaacaaaaataaaacaaaaattttgcttatcttttattttaaaaagtattattttcagctgggtgcggtagatcacacctgtaatcccagcattctgggaggccgaggggggtggattacttgaggctaggagtttgataccagcctagacaacatggtgagacctggtcccttttgtattttgtaaaaatacaaaaattagctgggcatggtagtgcacgcctgtaatcccagctactctctatgctgaggcaggaggctttaacctgggaggcggaagttgcaagggagctgtaatcatgccacggccttccagcctgagcgacacagcaagactctctctcaaaaaaaaaaaaaaaaaaaaaaaaaacccccatatatatatatatatatatatatatatatatacatatatatatacacatatcttatttttaacatcacatactaatataactttaatgagaaacaactcaagtcattagaattattttataacctgagattaagtcttaccactcttttttgaatttaatattatgtaatttaaaaaataataaaaattcccagatatgttcttcgggcagaaaagagagtaatttccctactttctatattttctatgtctatggaactctacaaaagccaagcgtcattataattaccctgaaatactataaaattctaaactattaagatatccataattttagatagtatacattctatttaccaatgcaagttagatatactattgcaaaaacaacttcgaaacaataagatttttggctaaccttatgcattttactcattcaaaatgttaccaccaatatttgtgaaagactgaaaaaatttataattttatatttttatacatatctgtaactaatagagtaagaaaaaattaattcatattttctaattcttttgatgaccaagcaaaatatttccagaaaagtcagcttttggattcttaaaagatctctgaattctttacatattggcccagaaatctttgcacaaacttttaaaaataaaaaataatatttatttcaaaggatgactaccagagtctgagaactgtagtggacaaaaacacagagtgtataagatctgccatttgatagcacaacagtgtgactacagtcaataacaacttaactgtacatttggaaataacttaaagagtataattggattgtcgcaacacaatgaataaaaactagaggagatggatatcccattcttcataatgtgcttatttcacattgcctgcttgtaaaaaaaatctcatgtactccattaatatatacacctactgtgtacccacaacaattaaaaaaataaaataaaaggatagtagtccttcataatcccacattagtagcagcagattctatgttcctggaaatatatatatttacttacatccacataaatccatataaatcagtaaatgaggaaattatttagctaattcaacacaaatttttttattgatttcatcaccaagacaattgcaacaaatctccactgatttttcatatttatataaagcatacttattaaattatttaaaattaagtacataattattagatctgaaatttaaaaaattgaaagatgtaaccaatttttatataaactatgtataatcacagatcatacaaatttatatactcaccaatacaagtaggtaaggaatcattccactgggccaaagaattgggcactgtttcacacctaattgctatggatccatggagaatatatcctggattacaatcaaaaagaaccgatgaaccgactgcaaattcattgccaattcttcttccgaatcttggttcaggcacagaactgcattgtgtagaacttgttctaggaacagctgtgtagaaatattatatttattttaattttatatggtagacaaatacagatttcaaaatgtaactgtttaaacacatttttgagaaatcatcactttttatcagaacttgaattaacaatttgaatacattcttaaagttttaaatttcagacagaataaaatataatttaaaataaatattgttattgtcatcaaggttttttattagaaaagttttacttttgattctttaaacatcaacgatttttgttttaccgaactcattaatattacaaaatagttttagttagatatttttgtaatttgtgggatgaaaactgaaagttttttttctttttaaacttagaataccaagttcaaaaaatatgtgtcaggttatatcaaataattttacatttttttcagtatttggttcttaattaaaaacagattttataaaggcaaacagtactttattagtttcataaaatttcacaaacttaatttcaaacacatttgctattgagaaagataactacatttggactaggtagaatatatgtcagacagattaacaacaataaaagtttttactttaataatcatacaatatcagatttgaaattgcttttagattttataggtatgccctttaattgtgccttttttttggtttagtaaaatagaatgataacaggatgttttttctttttaaaacacataacaaatgtgattaaagagattgacaatagcccaaaaaatgatatgatgaattctaaatagattaattcttcttatgcgacttgagtaaatataattccattcattatagtgcctttttgcagtcgtaataccacacattgtttccagggggaagtactacttaacataaaagagtacaggattatagtcaactgataaatggggtaagaaggtttaataggaataacaaatcacaaatgtttatacatttcttagtaataaagtgcaagatacatttgagattaactactatatgaccatatatatttcaaagacaatatttcaaataatggctcttaacttggtttaatgataacgtagaaggttgtctaccacaggcaagaaataaaatgtgtaaacaaacttctaattgcacaaaagtcctaataactgaagaaagttttaattctcctgagagaatgagaaactataattttagaatggaacactgatttccttggcatgtttaagtacatcagcaccaaaatttttatatctttaatttcgagtgctaaactaaattagactaaatagtctagagtgctagactgttagaaaatagaaaatgtagatagtaaaggattgtcaggaaaaaaaagtagatgttttgaaaataatatgtgggaaggaaggaaaatcagacatttaaactgagaatgatgatggaagcaatagattttgtttactttggtcaaggtgacagtgatctagtgatggtggaggggacaaaataaaactgcttaaaaacacttttatctagaggatttcatcattcaaaaactctgaatacatcatgggaaaattatatcattccttagtgtgtttctagactacagggtcacttaccttggtaaacaaagtgaaatcccttagctgttattggtccaactgaagtaaatcgaattgtgatctgattacctgaactcagtggaagtgattctcctactcaacaaaacaaacactaagatatcataaataattttcattcagtaaacctaacaaattatattataatcttacactgtcatttgaaaatgtcaatctatgttctatcaaattactttaaaatatcctacaactaccaatatatttcctttgggttcaacttgtattgcaatctttttctcagaaagctttaattacatttttatacatattgcctcattcttcaaagaattcttaaatattttatattacattaaacaccagagactaagtgattaaatatattatttacttggttacaatcccagagaatagttggttgtatttttctcaaccttctgagttaattttgtttctattctttagaaaaaaaaaaggtgacactattttcagtttgctttatttcttatattgatgatataaatctcaactttcactacaatactaatcaaagtcagtctttaatcagtaactgatgcatggcagttctattaaaggatacctgaatgggatcctgagagggaagataacagagaagattgctgagttggcccatcatacacctcaacaacatcgtggagtgatgtctggaaaaatacaaactggccaaacaccactgatcaacaggaacccggagaagcaaacaaatcaccaaccatccaaaaacgaaaacaaaaaacaaaaaaatagaaagaggaggagagagagaacaaagtattacaatataatagtcattttttttctacctaaaagaggataggtgccaattggttgatattactgacacatgtacttcaggtcataaaagaagtgaccatgacctaaagcaataaaatattaagacaacaattcttaaaaatataaatgagcatagcatttaatttggatcagaaatcataaaattgatgattaatactttatagtaactacttttggcttttctcaatggtggtttgattcttttcactttgtgactctcttctctttttctaattttttacctcctcctttagataagatagacacagttttaattcaggggattttttaagttgtccttaaaaatgttattccattatgagtaataatttcattagaaaaagattagcgagattcttttcagatatagtgtttaatttatattctaagttttaaatgattcctaaacatttattgttaatcttctgccaaaataaagaaatattatttatgattcctcagcaattgagatatcataaaattttgcaaaataattgctcttccatggtaagtacagttctgaagtacataccaacagagctttatagatgtgtctttttcctccatttttacttatcctttaattacatactaaacttacatgcagaatttacccaaactaaaactataaagaacctgtttcaagaacagaaatcagtttgctttgtgtttttttttcttaaataaaatcagtaacaaaacttatccttaaaatatttcattggtaaaattgtggggtttaaaagagtataattttaatgaaaatttaataatgccaaagcaaggtcacttttataaatttgaaatcacatgaatttaaattgttcattccatgagtatatacaaatatatttttcaaatgctgattcaaattgtatacctcaaatgaaggctatggacatcctctggtggtccttttactaacaggctaattcacttgaaacatggttacttttgcatatgaattcaggtatacacataatatggcaaacaaagctatatgtagtttttaggcctgtaaaaataagctggtgatctcagtccagttctttgtggagtaaaagaaaatgaaaatattaacagatacagcgatgtttctttgaacgtttctgaacattggctgtgctaaaatttgtcaataatcctccttaaaatatttcctagaagtcatgaatacaaatttatgtttccacctaaccagacacatgccgtgaattattttaatggtttacaagtcatacaaacattttgaattcagacctttttaaaagatcccaaatttgttccaccaaatcccaagctacttccaaaatactccaaatatatatatatatatatatatatgtatatttgttttctaatggaaagaaagagttaaaggatgctgaattgtactatgtatatacatacatatgtatatatatatgtgtatatatatatgtatatatatgtgtatatatatgtatatatatatgtgtatatatatgtatatatatatgtgtatatatatatgtatatatatatgtgtatatatatatatgtatatatataggaaaggttttgttttctgtttttgcattagattagtgtttggatgatcctgttctcaaatatgtcttaagaagtttctattatataaagcagattgccattgccttacaaagtagccggaaaaaagaaaaaaaatggtattttagtctaatcacgggaattttgttacatcaagcacactgcccaaaaaggctcttggcatgtaatttattctttctcttagctttttgggaaatcattaaggaaaagtacaataccgcatcctttaactctttctttctattagaaaacatgcccaatttccttgcaaaccactatatttacaaacatttaaaacaactaaaatacacaggtatccaagagctttttctgaggaaaaagaaaaaaaaattcatctttttttttttttttttgcctttaggcctcttctcaattattgtttgtatgcagataaaacagttttgcattacctctaaactgaatatgttgagactataactgttaataatgcagccattaaccccacatttttgtatcatattaagtatagaaaactgtagggcatgctcttttaagtgttaataatttgtgcttgtaatttgttgtagttattaactcggttgggagagttgagaaagctaggagtgggggagtacagtgctgaatcttgccttattaagcaatgagcaagccacttttctttaaaagcaatcaactctgcattaatatgggcaattgaaattttaaattaaaagtagctttcaccagaaaaaaagttactctgagaggatatggaatcactatagtaaagacaaaattttaaagtacatgcctagtaagttattttgtagtatgaacaatgaagaacactaacatagtgatctgatttcccacacattatcatattagctattgtctcattaaactgatatattataataatgaacctaatactcccagtcagaagtcttaagaactaagtgatgactctcagatttgcttctccattctgtctgtaaatgtcttaatttatttagttttttaaggtgcaaacagcagtaggtcttctgattctaaaatgttctgaatagccaaaggtatttgcctggttgaaagtgatgcaaggaaaatgtgtaagagattttaaagtggctcaaaagattactggttattgtttttttgaaagaaagttgtccagcaaattgggttacttgtgttaaatggagactgtggtataatgcaatggattattgcccagtgaacagatttattttgtctctatgcatctatttgtttgtaaattcattttaacattcctgattatctatcttatctacagatctatctaatttatctattaaccatctattatttggttatttgaattctcctttgaaccactgtaacatcttactgggtttctcattatttaactgggagttaaataaaatttttgatttaaatatcctttatatttatatgagagtcataattatgctctttttaaaaattacctcttaacactgacctgatgctggtgcctcaatccaatgggtagaacacccttttatttctaggactacaattaaccccaagtctgtgctgattatgccttttgcatgattaacaagctccgtggtggtctgtttcttcatttccaagcacatacagaattccctgcatctcagctccaagcttcttttctgttttcttaagcatatagatttcaaaacgattttgctctcaagatacaagagtaagctgtatacatcaagctatttcttaagggaaacactactcattttttttcttctttaaacataatagatgttaaagaaaatgtttttatctcttttgttgaaaaaatcaatttttatagtggtatatatactgtagtaagctagaaaaaggaaaccagtaagataaaagcaaacataaaaattatctagtttttatgcctgaaactatatctgagcctattatattttcatacattgtattttagaatagagtttattaattccaccagcattagttgattctatgatgtgccaggaactgggttaaatgctagggttaagaaagtgaccagtacagatagggtccctgctctttaactctattaattatatttctgtttattgatgtggcagcttttctttattccacccatgaaaagatgttaggctggccaattaattataaaccaacaatagggaactttgggtacatatttccatgaagagtattgctatactgatcaattaaatccattcttcaaagcaaagcacctactaatctctaatggcaacattcgtggagttctcgaccacatttttaataaatctataacttagattttaaaaaaatcactttaaaagtctggagaaatcacttagaggaaaactaatttatatcacattgctataacctttatcccaattttaaagtattttcctagttcattttctcccccatgaataaattcagaatgagacaaggcagtgtatctatctactctttcttgtagacaaagcaagctttatttgacatctaatttttgaagtatccatccaaataagattgagaggtagggttccattgactgagaaagtttgcataacataaattttcatttaactgtttcaataagcatttgttttctattctctatcaaaccctgtcgaatcctttttcctttggtcacattcatttaatacctgagacttcatccaatttgcttaattaagccatcccaaatgtaaatcaataaatgatgacagtgtgtaagatggcataaagaaactcttgagcattagcatagataactggcagaattctcactacagaccaacagttaccctgaaagcatcactgtggaaacagtatagtgggtgcctggaatatgtcataatgcactaaaatgggttagtgctcacaggggagggcctttgcttagaacatgaataaatagaacaacaagaatttaaagctcccttttccactaaactctaatctgcaatatggttgaaacgttctaccactgctagcagtctctcctcgaacaatgtttaatcaggctcttctgaatcctcttcccaactaggccctgactattttacttctgtgtctgtctttgcattgtccaactttaacaagaatcctaatgagctggtttagccaaaacccccttccctcaatgtctgattaccctctcacctccaccatcccccaggtgatatctgttcaccctggtttgctttcaccaacagtactgttagggtggtttggccagaatccccctcatccctgatgtttcctcttaataattttccatctactgacctccatcctgcttcttgtctataaattcccactttttcttgctatatttgaagttggctcaatctctcttctctactgcgaaacccatcagagtagttcatatgcctatcttgatacttctgaatagtctatttgatacagtttggcttcatcttcacccaaatctcatcttgaattgtaatcccaataatccctatgtccccctgagaggtaattgaatcatggaggttgttttccctttgttgttctcatgatagtgaatgagttctcatgaaatatgatggctttataagcatctggcattccccctgctggctcaccctgtgtcctgctgccacatgaagaaggtgcctgcttctcccgttgccttctgccatgattgtaaatttcccgaggcctcctcagcaatgtagaactgtgaatcaattaaacctttttcctttataaattacctaatcttgggtatttcttcatagcagtgtgagaacaggctaatacagtaaattggtaccaggagtggggtgctgctacaaagatacctgaaaatgtggaagcaactttggaactaggtaagaggcaaaagttagaaagttttgagggctcagaagacagggagatgtgggaaagtttggaactccctaaagatttgttgaatggctttgaccaaaatgctgatagtgatatggacaacgaagtccagactgaggttttctcagatggagatgagaaacttgttgagaactagaataaaggtgattctttctctgctttagtaaagagactggtggcattttgcccctgtgctagagatgtgtggaacttactttgaacttgagagagatgatttaaggtatctggcagaagacattactaagctgcaaagcattcaagtggaagcagagcataaaagtttggagaatttgcagcctgaccatgtgatagaaaataaaaacctattttctggggagaaattcaagccagctgcagaaatttgcataagtaatgaggagccagatattaatccccaggacaatagggaaaatgtctccagagcatgtcagagaccttcatggaagcccctcccatcaaaggcccaaaggcttaggagggaaaaatggtttcctgggctggctcagggctcccctgctctgtgcagcctcaggacatggtgccctgcacccagctgcttcggctctagctgtggctaaaaggaaccaaggtacagcttgagccattacttcaaagggtgcaagtcccaagccttggcagctttcacacggtgttgagcctgtgggtgcacagaagtcaagaactgaggtttgggaacctctacctagatttcagaagatgtatggaaatgtctggatgtccaggcagaagtttgctgcagggtggagccatcatgaagaacttctgctagggcactgtggaagggaaatacgggatcagagctcccacacagagtacccactggggcactgcctagtggagctatgagaagagggccaccgtcctccagatccagatggtagattcactgacagcttgtatcgtgcaccaggaaaagtcacagatgctcaatgccagtctatgaaagcagccaggatgggggttttaccctgcaatgccacagaggtggagttgcccaaggctgacagagcccacttcttgcatcagcgtgacctggatgtgagacatgaagtcaaagaagatcattttggaattttaaggcttaatgactgctctattggattttggacttgtatggggcctgtagcccttttgttttggccaatttctctcatttggaactggtgtatttgccaaatgcctgtacccccattgtatctaggagataactaacttgcttttgcttttacaggcttataggtagaagggacttgccttgtttcagatgagactttgaacttgtacttttgggttaatgctggaatgaatgaagactttggagaactgttggaaaggtatgattgtgttttgaaatgtgagggcatgagattggaagggaccatgggctgtgtcctcatccaaatctcatcttgaattgtagttcccataatttccatgtgtactgggaaggacccagtgagaggtaactgaatcatgagggtggtttccccatagctgttgtcatgatagtgagtgagttcttatgagatatgatggttttataagtgtctggtatttccgcttctggctctcacttcatcctgccaccctgtgaagaaagtgcctgcttctcctttgctttctaccatgattgtaagtttcctgaggtttctcaagctattcaggactgtgaatcaataaaacctctttcctttataaattacccagtcttggatatttctgcacagtagcatgagaatggaccaatacactattcttctattgtttaacaagtacacgaatgatttctttttaaaactgcctaagcaaaccagaaacttttggaagtcacttttaatttttgagccatcaaaataactagctgttacattatatagaggttcactgatttagcaattaattaacttgaaacgaggataatgaaacaaatatggacatgattaccataattcaatgatcaggattggagttattgaattaaaaatgaaaattgaatttatgtaaattaatatttcaatttgtttgtcatttttttctcagaggggaataattctctgagtatcctaatggcatgacagtgtcagaaaaaaaaaactgagacttagactggggcatggttaagggaagagattcaaatcctatgtagaaggtgatggagagttaaaattaaaatacgtaagaggttgtagtgaattcagctttggtttaaacctgtaaacctgttttgatataaaagtcttcaaatttggtggagtaagggcagcaggtctctctggaagcaactctagtagtcagaaggatagtgccaaattaatgaatggtgacaatgacagtgccaatcaaagcttgccaaatgacaagccctctttgttgcatagaagaatggatgaagcaacctaaagattatcagcacttatagctgagcagatttaggaagattaatgttttcaaatgaccaacttatgtgtctgaaatgtcctgtgatattaaggtatttcataaaattgcttaataaagagttaagcattcaatttctggaatcagactctcaaggacttaatccaggattaaccacatgggaaagcctcagtttcctcatctgtaaaatagggataataaaagtacctgacctcctaggattgatgtgaatagcacataaattaatacttgtaaaacattttaaacagcacctgaagcagtaataaatgttagtcaccattactagtaactcagctttgtaaatatatatgttcctaattcagtcagaaaacttactgataggcaaaatttaattgaacttttatgtgagcatatcctctttcattgtctgctttctatacatcagtatttagtaaaaaagatagaactgcctgggtgagatgagtactccagctattttaatcaagcttagtttgtcttaagacttcaagatggctatgcacttctctgtctacttgattttacattctatccttttggatgaaaaaggaaaatgtaattatcagctttcttttggggctaagaaaaggggagcaaggtgagagtgcattctacctttgtttttgtttactccctcaatcttaattccttctgtttcaacttcatcacaaaagaaatagttccacatagaaggaagtcggtgcagaaaaggaaattagaaaatatcataaattcctattagatctatgtttgattctcaacatgcttactactccttttgcaaaatctacacattgttttgtatttcagggtttattttgatgcctatattaggaactgagctggtttgccactttgttaaaaattgtatcacccctgttttgctcaattttcattttattaccaacacagcacagatgaaaatgcacatgtgcatccacagtactgacagaacagaaataaagaaggattcaaatcaaagatgggtagagtactatatttcactatgtgtgaaatcataaaaaattactgttggtaacacaagctcttataatgtttggctacttttatgtgaatttctgactcgtattttcttttttattattattatactttaagttttagggtacatgtgcacaacgtgcaggtttgttacatatgtatacatgtgtcgtattttcatctcatatgaatattttaagacaaaatattagacattttcatgaatgcaaaatgcttcccttttaaatcagtaacatacactgtgcagaactgtttgccctccatactgtatactctgaactgtgaaagtacttattgtataaatagctacaaatttgcattttgggatcattataccacttgtatatcatgattttaaaggctttatcatttaaagattattacaagatgtgcaattaaaacttcaattttatgaaaaacaaataaataaaagtgtagtattatgaaaatttactttcaaaagcatcagaaagccagaatcttaaaaatcagtaccaaatcaaatcaatgagctactgttttttaaaactatcatctagcaatggacaagtttagatagaagttacattaattgattaatgaattaaatatccctaatcccaaaatcccaaatcaaaaacgcctcaaactccaaatattttttggtgctgaaatgacttcacaagtggaaaatttcacacccaatgtcatgtgacggtcacaaatattatttaaaatattgtataaaattaccttaggttatgcatataagaagtatatgaaacataaataaattttgtgttcagatgtgtgtcccattccccaatatctcattatgtataagcgaacatttcaaaatccaaaataattggacatctaagacacttctagtctcatgcataagggatgattagggatacttgactgtactatcaagtgaaacttttattaatagtttgaaaacttttatattttctacatatcagttagattccaggcacttatggttattatcatagtacaatagcagtaaacatactaactcacagtgagctgcgttatgctgatttagcattttaaaatctccatgcagaagcatggctccaccctagaatgctggggccaatcctgcctttgagcaaaaaagtctggagtgctaagtcagcaactcacagagtataatgagaccattctggctctgaaaaataaatatgtgaaaatcttaatatgtattgctattttgtagtaattaggaaatacaatatgttattaaaaaattcaatgatttgactatggtacccaattatccagtaatttggtagctccaggaatctaggtttgctttgaacttaacaacaataaatggggtcgtaatttatctttctgttaacaatttctttgtgtgatacttttgtcaacccataaactaggtttgctgactaaatccataatatctactttcagatttctctaaagctagatttctgtctgtattgtgaccatttgcctactgtcaaaatttcaaaactgcctatttgacatattttaaatgtatagacattaaaaaaccatcttataagcaaatatagtttaattttctttaattgttccaggagcaaatatctattccactgcaagccagaagtttatctgcaatttggcagttgtaacatttcccagaagttgagaattaatttggtgtttaaaagcaaacgaaataaagaaaaacacaataagcgattccattgtatgtttaaaagaattaaaacagaaaagccaaataaaaagtttaaagtgttcaaatatgttattagcacttttgttttgaaccattttcaatttgaatgtgtgcttttatttaatcacctttcatatttttttttacacattttgtagaacatgtctgccaaatcccaattaggtcagaaagattaaagccagaaaaacattctcctatggactataaattaaattactgggatttattttattatgtaaaatttcaaacatataccaagtagacataatagtaaacacccatgaaaccatcacccaacttcaacacttatcaacattatgccaatcttgtttcatgtgtctcttcctatccgacctgtatccccaacctggagtacttttaagcaactccccaacatcatattctttttccataaatgctttggtatttgtctctaacagataaaaactttaaaaaatagccacaatataattaccagatctaacaaatttaatgataatttctttatttcatcaaataactatttcttgttccgatttccctgattttacccaaaaatagtctttttatagttagtttaatcaaatctgaattcaaagtccatacatttcattcgattgatgtgttgctaatgttacttttaatatataaaatctataacccacatcttatttttaatgacatatatttgtgaaaaaaaatgagtcttttaaagcagagagactaaaataggataaaactcaattgaacaaaattttactggcatctagctgttggtgagagttaattttataaggttattaaagaatgtaattcaatttgtaggttacctctagaggtgagagagatactatgtggatatagttcctggcccccctagctcctacttcagttagagaagttttgtttctctccgctttatgtgtgggactttgacacacaatttagcattatgcccagattcaagctcttgctttcattgaattctttaactccactctgcatgttgcctcctacgcacactctgccatgccttttctgcaggcaaagtaccctcaacccctcaactttcaaagttccatttactaagggctctttcattggcagaatgtacagctatttcagaataacaggtggaggggtacaccatatgtcaacattttaaaaaaggttcttaactttgcaaaaaaaatcatcaccagtcatctctttaacttgggctctagctttatgttgagagtcatgtttgcacattttttttttaacagaaggaattccaagcttacttattctcactataaaatgctaccattctttggcacttattttgccagactaggctgggcgcagtgattcacacctgtaatcccagcattttgagaggcctaggtgggaggatcactttaggtcaggagttcgagaccagcctggccaacatgatgaaaccccatctctactaaaaatacaaaaaattaggtaagagtggtggcacgtgcctgtagtcccagctacttgggaggctgaggcaggagaattactggaacccgggagccacaggttgtagtgagccaagattgtgccactgcactccagcctcggtgatagaggaggaccccctgtaaaagatatatatatatgttatatatatgtaatatatttataatatatattacatataataatatatgtatatatacatatgtacacatatatgtaataatatatgtatatatgtaatatgttatatatattacatatatatgtatacctatatatatatattgccagaccaaagtctattaaaaatttccaatgaaagtgagagaatttgctcctggtagaaattgagaaaatgaataaaaaacaattttaaatgaataaaaaacatttttaaaaggtataatattaactagttatcattcattaaacccttactatatgtaatggactgtgcaaagttctttatacatatcagcttcattgatcctcacaaagacctttgaggtaggcactatcatctctgttttgcagataaaaaaacaaacaagacaactatcaaaaaattagtaagctaaaaagggaaagaactaagatttgaattcatagaatatgaatttatcttaagcctggtctcttagccattatcctatagagcatggcatcatggagtgtactggtggacaggtcacattaaaaactactgagaaaacttaaggtcaaacacaacaattaagacacatgataaagaagcagaactgaaagaaaagagtgaattattttaaggatattttgctgaaaagatgggggaaatattttataatttatttataaatacattcatcctaaatggccaaattattatttagtcatcatgaataatagaggaatagatttctattatcttaaaaatacacacatcatttatataaaatgtgttctgaataaataaggtgacatattctgcagacttttagtactttcaggaatagattttagaattcacaggagtagcagaatctattgagtaacttttattttcacaattgttacaaagtaaaacgttagtcatagagagttggggatttgcatttctacaaacccagatttgacaagctttgctacttcctggtgtgtgcccttgaacatgctactaaacttttctgaattgttttcctaatctgcaaaataatacccactcctttggattgttgtaaagattaatctgtaaagcatcttgcccagtaggtagacgaaacagaaaatgtcactcacatgtacactcccaacaaatacaccatattctgtggcatttctagtctgttatcttacaaattcaaaattaatattgattttataaataaatcaaattaaccacttattgtttaactctgtcaaagacaatgatcaacagcaaaaacaagtaaccttaatagaaacaaataagaaaacttaaccctggaaacagataaggatgatagaatatcaatgtgggaagaggttttatcagtcatttggtccaatttctcagatgctatacatattcctttagttacttaaccttctccagagagtacatagacacagaatggaacataaaggagttattgaaataaatctacagaatgtgtattgctgaaggaacacattgatttgcactagcagacaaatggtcttatgtattgtttcagttcgcccaaagactttcctttgatagttattttttttttcttttcagaaacagtcttaaacaatatcatccataaccaaaaagagcaaaaatataataatttatgctaacctgggaaggtgaacacttctaaatacaaccaaagtaacacatctcaccgtggctatttcaatctttgctatcactgttgtcatcttcatcactgatttttggcaacattattgtcatcatcatcaaaagcacataagagtcacctgtaatttcattccaaacagccacatttttattaaattagttactatttggtatgtgcaaagcactgcactaattgctaagaaacttacaaatggaaattctagatatcataaacattgatatatttcaggctagagtgcagtggtgtgatcctggctcactgcagccttaacctcctgggctcaagcaatccacccatgtcagcctccctagtagctgggaccatatgccaccatgcctggctaagttttgtattcttttgtagagacagagtttcaccatgttgcccaggctggactcgaacttctgggctcaggctaaagatacttttgacaagaaaatcatttaggtatactaatatgctgaaagaaagttgagacttttttctttacttggtgcacatgtaaaactaatttggattagtattactagctgacaagcaatgagcctattaatgtttgagcctctacctcttgtcccaaagcttttatatatatatacatatgtaagtattcaagttccatgcgttgtctaggcctggcagaagctgtgaagtatggaatcgttttaaattacttaatatgctataattccaatggaagtttctcatattacattttaacaaagtttcatacttatacacgcaaattttattcatagaattctataaagcatttagcctttaaaagaagctgtgtgaaaaatgttttggattctattcaaagggaaaatggttgaaaattaatgattttgtatctgaatgcaaaaggagctaaaatagcatcacctccactcctcccaacctacttgcaggaataattaacgattcaaagcccagatcgacggccaatagaggaaaaaaatagttttaagatatgattgcaaaaaacaacaacaaccttatctatttactaattggttcctagttaccataccaaaggcaagaagaattaatagtaagttctaaacaaatatttaaaaattaattttaaagcagactcacattatcattatcagtaaaagaaactataaagaacataaattatttgcacatgtgacttactttgtattatgttttggtcttcaatggtttacaaagccatggtaactcacttcaaaacacaaatggatctttttaaaacaatgaattaaaccttattctcaaggtttgttaagactctcactagagaccaagaataagataggtaattccctaaaattattcagtttccctaactatgtcatagcttgatccaaattaggatcagaacattttttcttcttttcatgttcccattcttctattttattttattttacttacttatttatttatttatttatttgaggcggagtctcactctgtcactaggctggagtacagtggcgtgatctcggctcactgcaacctccacctaccaggttcaagcagttctcctgcctcaacctcccgagtagctgggaccacaggcatgtgccacaatgcccagctaatttttgtattttcagtagagacggggtttcaccatgttggccaggagggtctctatctctcgaccttgcggtctgcccacctcagcctctcaaagtgctgggattacaggcatgagccaccgcgcttgacctattttttatttagtaagaatgttgtttaaatgtttcttaaatatcagttattctgaataagtaactacattttacttctcagttgttagttgttaaaaattctttacagttaaatgatgctggaacccaactagtaataaccattaatcaaaaagcctcatgtaaataggatcattatcatttattttacatactatgatattccaaaatagataagacatcctgaaaagctttgtgaaagagtcatgtggctaactaatgttttgaaagatatctagaaggttatattctaattttaaatggtaaatattctgacttcaaattgtgaaccccaatttttttcatgttaatttggacttaatttatagattcagcaactcaaagtcagtggagggtgagaaggagtcttaagaacaaatctaaaggaagcctattgtctttcttgcatggctatatttgctgtactcacttatctgtgaggagtttaatctgtattgtctcagattttacttgtaataacttgagtagtaggtattcttatgcatattttgaggatgaggaaacaggcccccagctaccccaagggagacttatgctgctaacattcatatccagtgcctcttgaattaatagctactcactttcaagcactgttataaacaattccataccaagcatattgacagtcagattagataattttttaacattccccactgtggtaaaactattttcatgaataatcacaaatgaattaataatactggccagaaaataaatatagactgtgaaaattttctattattaaactctgtgtgtgtgttaaaatagtagtaaaaaaatctcaaaataagaaaacaaatattaaagtaccaaaaaaaagatgaagtcatacattcgttacataagtgtatttttttaatgggaagaaacacacactgaagtttggactctattttagtcttctaaattttaagcagaaacaaaaaatacaagtggttacatagaattccatcactgaaataagtcaagttctatttctttgtcttacaattactgttccatcatatactgtctgaatgcacaaatacatagtaaaatggagctggagacataaaaaaagtgagctgcaatagtttcaaatcattaaaactttactctgaaaatgattgtttagcttaattctagtgtgtcaaggacaacaaataaaataagataaaattccattggtgaatttgagtgtgtgtgcagggggtggggagtgagggtgaaaacttttttttaagcacattttaataggtagttggtattgattgtgaaccttctatattttttggaaacaattcatttcatcaaagcaactaaatataaacatagtcatgtttaattattttactgttaagtaagaaaagctgaaacaactgaattattccatttggtaaggaatgcctggccactctgtgactcttcttcctgaaacccatgaagccagacttcacagattgatacccccaagagcatctcctaattgtgatttttctcccacttctctgactttgcttatgctagactatctgatcttcttagctaatgtctattcatctttgaagactcagctctggtgagctatcaccagatactatcattacctcagaatttatctgattaaggtttgctcaaatacttttccattgtatgcactgcttattctggtcatataaattattgcactattttgaaattctgacttacatatatttttccttcactactttagattattcgtgtattccagtaactacttccctggcactaacaacacctttgtgcaatgaatgtggaaactccaattatgtacaaaaaataaaatcagaaatgctaagacaatgttttcactcttttcaggtaatcgtgataccttgcaatcatttcaaataccaggtgttcaaaagtattgtgtcagcatggctctcctttttcattttatttgtttttacccacaagtagtcaatattatttaagcaaatatcaatcatatctgacagagcttccttaaatataaattgagctaccacaagttactttaaagaaataacaaaaatgaggatatttagttcagttcacttgtgattgatggcttcctgtcttgaaggaggcaacacagagtgctacaagtcaaatacaaacaagctgcctgtctacaactaaactcatctttgtctcccaagtctttcctgacttgataaaagatatatgctgatatggtttggttgtgtccccacccaaatctcatcttgaattgtagtttccataatacccatgtgtcatgggagggacccagtgtgaggtaactgaatcatggaggtggttacctccatgctgttctcatgacagtgagttctcacgagatctgatgttttcataaggggtttactgcccctctccttcacactgcatttctcctatgctgccaccacgtgaggaaagacatgtttgcttccccttctgccatgattgtaagtgtcctgaggcctccccagtcctgaggaactgtgagtcaattaaacctcttacatttataaattaccaagtcttgggtatttccttacagcaacatgagaacaaactaatacatatgtcttgtcaccaaattcattcatcaacatttatgatgacctactgtgtttctatgctaggctgtgagatgcagggtcagcttcatggagcttcatcctacagtatatctttccatcagcttcatacatagaagcattcaggtcattactttgtatcttctaaatgtgtcttgattctcatctaccacattctcatgattcccttcattacatcttcaatgcaggcccacaccatctctagcctcgtaagtaaagttcctgtgtacaaatcctgtccaaatccaatttattctccacacttttatggaagtgattaatctaaaatgcaaatatgatcatgtcacttccctatataaggcagttttgctgtggaattgagcagatgggctgcatcaatagtttgatattttcacatttcccccagctatttccttggcatttaatttctaaagtctatctagaatcctggcaccatcactgcaactactatttagaaaaggattcatgtatgctttttaattttctgatgtaaactctaggttattaaattctattagtgttttattaatgcttgttaagcaacaactgttttacaatttcagtctttatctgtaatttagtttctggaaaagggatttggaccaagctaaaacagagtatacaaatgtaagtacaaaaaaatatattctcaaaacagagatatgttaaagatgtattcttaacatagagaaaataatttcatcacagagggtaaaaacttggatataccaaacaaccatgggagatatgatctggggaaaaaaacaagaaaacctgaaaacttgatctcaaatttgcaaccacattagaaaccaggttaatatccaattattcaacaaatatttattgagaactgataatgtacagtgtaaatgaatattcctggagctgagaatatacagctcctgccttcaaaaatttcacaggctagtggaggagtccaatacattagcaaatacttaccaccctgtatgctaaattcagtggtggaaattcttttcttggtgttccattcatgtgactctttacttagaatgacttttctcttcccctctacatatatgacatgtatcactttgccagcagagaataaggctcatctgttccgtggatcctccctgaattctcattattccaccctaccatgttcataaatcacttgaacttaatgggcattaatactggcaccacccattctgatctgcatgtgttgtctttagttttttctttttaattaaatttttttgaattgatagatacaattgtatgtggatatttattgtgtacaacataatattctgaagtttacatgaattgtggaattgttgaacccagtcaactagcatatgcatcacctcacaaagttgtcatttttgtggtgagcacattttacaaccactctcagaattttttcaagaatccaatatatctttaactatagtcaccatgctgtataatgtatctctagaatttattcttattatagaactaaaattttgtatcctttgaccaacatctccccaccttcccaccccactaaatacctcaacccctgttaaccatcattctactctctaattctgtgaaattgacgtttttagatcccacatatgacagatcatacaatattggtttttctgtgcttgggtaatttcacttaacataatatctttcaagttcatccttgttgttcttatttaaaggtgatgtctgatggagaaactctgtgcttcatgttgcatgtggcattggggacacaagcaaaaaagatatatatatatagttcaaggtttcatgaaactgtggtctagcatgaaagacagccattaaatatcaaaacatagacatatgaaatgagtgctatgaccccagagtgtggcaggacaacataaaggtacaactaacatatttttgttattactagtatgaaaagctgtaagaatgactttaaatggctcctcctacctggatttcaattaggcagagagtttgaaaataattttggtcatcattaaaaactgtgtgacacatagcctaaagtcacattgaactttactaatatgcagacaattgataatttaaaatgcttatgattaaaatattaaaagcaacaaactcatttacaaacatgaaagtgtgtaacctctgctggaatagatcatcagaaattttttttctttttttaataaaaacttaaagtttaaaaattatcagtgatttttcagtaaacaacattcacagagaagccactatcctgtggactttataatgataagaagaaattgaggtcaaagtttctgtattttagcaacaggtgggattaaaaaacagtagtgtctggtggtattatctctaatacttcttgcataaaactttcttacaaagacctcttagaatgtatttaattttgtcctacacatccaaggctgggagaaaagcaaacctgtttttgaatcaaatacttgtacgaggaacatcaggtaggaagcgtctacaaccagttttctaactccgcttccatattttccctattattactctctttcccaaacaaatccaagaaattagccataaagagactcaaatgaagagtgacaaaaaaacagattaagtgggaaaaaagaaagcagttattaccaacccccagaaacttccccataactcttcccaaagatagatacattatctcatgtaagaaaatgttacatgattaaattcactcatttaggtaatcagttataataatcactatatatgccagatactgacggcaggcctgaagcatgtgcgaatcctcaactagctgataatttgttgccttttcaaatcaatactatttaattactaactgggatcaggaagaaactgctttttcagtaataaaaattatatatatatattttatgtttaggatatgggatttattatatgaatatcaattcataaaagaacacttatgaactagaaggtaaatatattaagaggtatagtaaactggtcacataaatcacttggaaaaagcctatgccaagcattagtaagtttcagaatttcaactgatggcaactgctgattttggataatactcagttcactggtctagagattgatggtgcggactataaaatgtaatatggagccacattagcctgtcctaaatgtactcaagagagacaggtcaacagagggaaaagggatttaatttagttgttacgggtgtttgtgtgtatatgtgtgtgtgtgtgtgtgtgtgtgtttactttcacttgaggtaatgaaggattctagatgaggataggatcaatttttatttctgtgatttaatgctctgactagttgtgcaagctctgccagccccaaaatgtggctctgaagataactttagaattattgttgtcaagtcattccctgccctcacagatatttaggttaacttcattagactataggctattgaaataacaaaaggaagaaatgaaactgaaagaagcttaaactacctctggatattgacattgatgtctccttttggttttaatgtttaaaaggttaacctgaaagtcagattctactactaaatataaaaattaatttttaagtttaccaaaaatcaattatactttttgaattttatttttgttttaagctgactggcaatataaaaaataggtgaatatttttgttttaagctgactggcaatataaaaaataggtgataaaaaataggtgatttttttaagaataattttctaaaaggtaattttctcactgtatatgtattttatacataaaacatacagtacactaaaagttgcagattgctagtaatgacttagagaaaagggcaataggaaaaatgaatggtgatgaggtatggtgcgtgtctactgttcaatttctttagagaggtcgagcttgaacagcgaaatgatggatgaattctgtatagtgcactactcaataaatatatgaaggccaccttgagctgtgaaatctactctctctacaaagtgaaattatttttagctgacccatgcttgtcaccctgaatgtgaaacttgctgtactttacagctacatactcctttttgaggattgactgcctctgtggcaattgttcatgaagttctacatattgagtcatattcaccacaagcacaaatataccaaaaatgggatagacaatagacaaagcttagtaacttttttctttattttcatactaatttccacacctctatgcacagcttgaaaatcttttctctcctctctcttggagaatctacctctcctaggccccagtcataaactttgacactttgaaggtttttactttcctttcacctctctagttttgtctcccattctctcatcttttgattctacattacacaatcccactgaatcatttgagaactaacaaatacctcctacaggtgaaaaaaaaaatgagtgagcaaagcaacaacccaaagcaaggcagagggtaaagctaagactattccatatgttaataaatattttcctgtaatgcaagagttggagattcatgcctatgtcatgttgtattgttcttcactaaacacggaagattgcacaaactgaaggtcaagattccttaataagttataaaatttattcaacttattttactttattttagggtcttgctttgttgcccagtctggagtgcagtggtgccatcatatctcactgcagctttgaatgccagggctcacgtgattctcctgcctcagcctcctaagtgactgagaccacaggtgtgagccaccacacacaaataatttattattttattttattttatctaaatatagagtctcactatgttactcaggctggtctcaaactcctgggctcaagttttcctcctgccttgtccacccaaagtgttgggattaaagatgtgggccactgcacccagccagaatcaatgtattagatcaggacatgcattgcatttttaatgaattagactagtaaggtataggataggacagaacagaacataggacatctcagaaagaaagagaaagtaagtatgaaccggtttgggaagcaaaacacattttttaatgtgggtctcagttgaaaagtttggatatttggccataggtggtggctcatgcctgcaatcccagtagtttgggaggctgaggtaagaggatgtcttgagcccaggagttcaagaccagcctgggaaacgtagcaaggctccactggaaaaaaaaaaaaaaagagtttgaatttttataatgatatcaggtgctaaactattaatttccaaacagttacaacttaattctgaagaatatgttaactttttttgtaactattaactgagatcaaattacatttttggcatgaattacaggaacagaaaagaaactgtgacttcaattaaattataattccaaaagtacaggctaatcagttcaaacagaagtttgtatgaaagcaatgctatcattgtttatttagaaataaatgtatacagtaggctcatattctgaaaagacagaataacttagcattgcaaacagctacctttcaagggcagaaataacaaagaaataatacttcttttatgtattttatcagttgtgtgggacagaatatctgttcttgtgggaagagatgtctggggacatatttaggtctaattgttacctttaaaaaaaaaaacacagcagggcaggtggctcatgcctgtaatcccagtactttgtgagaccaatccaggaggatcctttgaggtcaggagttcaagaccagcctgggcaacatagtaagaccctgtctctaccaaaagtaaaatgaaattagctgatatggtgacgcatgcttgtggtcccaactactcagagtgttgaggtagtgggatcacttaaacctgggtggtccaggctgcagtgagtcaggatcatgccattgcacttcagcctaagcaacactgagagaacctgtcaaaaaaaaaaaaaaaaaagaaagaaagaaagaaaaaagaaaagaagaagaaaaaaacctacaacaaacctatttgaaaaataatcataactgtttgctttacaaatgactacagcagactttttaatcaagctaataattattaacttttgtatttagtgagttaaaaagcatagaaagccatctattttagtgctaagtttttttttgttagaatcaattacttcttttatttattgtatgaatctcctttatggttattgttgaatttatttgcaaaattccattagtgtgtgcatatggtataatagctattttgttttttcagtgggatatgtgggtttaagttgtcaaggaattgggtaggttttcaaatatactaactccagaacacattcatttgcttccaaaacaaacttggaggtgtttacctgtgcccaagcatttttgaaaagttattccagacagtgtgaagtggtacttgggagtaaaatctgacagatgtgagctgcaaactcaccactaagattccctaacaaagtaactttggacaagttaatgaaataagactaccttattcaattgatataaatattaaataagataatgcaaacccctggcataatgcctggcataagttcataatcacatttgtttttatacaatttacgaggcagagttggcatttataccaaattggttgtttgatttataaatggaaatttcagtctactatgctaatttgctatcatcatcattgctgttgtaagcactctgcaaagcatcttcctttaactttcctccaaaagtctaccagcatttttttctcctttatgaactcttcagtacttataatctatgccacataataccatctaaaatgctgtattgttattaatatttgtactttgctttttcccagaataagattgtaaagtcttccagaagagagaagaaaacaaaatcacgtaattccacttggcagacgtaaatttactgtgaagttaacaaagctcctacctcgcacaggctccttctaagaccctagaaaggaaccatcaatgtgttcacaaggatacattgttttataaaatttgcaaaaaaacactttaacaaattctttttcttaatgagggctccccaagtaataagctttagtacacacaaaacttgtatccattctcacctctggacatgaactcaatgaaaaagctcatctatttgtaaagttgcctcatacttgaaaatctttgacctaatgtttttaaacgaattcaatgacgagttcaccagagtagatcttcagtccatggtacatcttgactgactgcatactttcagcaaaaagcaaggtgcactttgttttatctattcttaagcatggtagagcagctacactcagagttggcaatcaaaatagcactgaagattttgcaggggaaaagaaaccacagacactgttacctttgggacaatgtttttgaaataagcatagatgtgattccagaaaaataaggtatggaaaaatgtagaaaagtagttatttttcttgaaaatagagaatacctttttgtgcgggtagatagcattgaattctcaagtatgccaattataataacaatactttacaaaaacaacaagaataaggcaaagtgctctataaccattatctctgaacaactctgtgtggcaggtattaacattcttgtttcatacatgagacaattgacacttagaattaagtaatttgcacatggctgcacagctagtaagagacaagctagtactagaagctagtctaaattttaaccattatatcacactgtatatgatgtatgccaaaactgaaaatactggcttttaaaagtagaattcatcatgagctcatttctaagattaattttctcaggtacatttcaatgaagtcagacccaggctctggaaactaatgaacttgggtatgatgcaataacttaaaatgttttttggtaagtaatcatttttcacagcagttagtggaatgcctactaagacaaaaacacagatggggcacattttttaacttgtatactttcaagataacttaaaaaatgatttacgtcttagatttaaaaactgtgtctgatatactatgctctgaaaacaatgtgcatttttcctctctgtattttttcactgagttgtcactgctaattggtagagatacaatcttgattatttctcaaaaactctgaaaagatgttttcatttttttgtatttatgaccataatgcatttactataggcatgaaaattatatttacaccattaaatttgaacataatttgtggcaatgccctaaataccagaggataaagataaatcagacatgacacactctcccaaatgacttccagtctaacataatgattgtcaaatagagtgcatatgagaatcatcttggatgcttttaatatttgtgagggagctgtccccagagaagattagttacaaaattgaactagaacctaagaaatctaaattttaattgctcctctgattcctaaatggcttatcctatcttgagaaactgatctaatgaaaaagacatgtgtgcaactaatttccatataaatgtatattaaagtaaatataataaagttataaaagatatttttctatgccttattctgattaaaaataatcagcatattcagtttccatttagaaagagagttactaggacaaagacatgaggtatacaggaaaaggtccccttcttttatccatgattatatgaattaaagtcattttaaaatcataaaacagaaaaatattgatagtactatatactacatcctatactgctaagtacaataaatttctcccagctatagtagtttttctgcttaaagaacaaaatttggaggataagctagatttttatgtatatatatgtatacaaaaaagtgtatgcatgtatacatatttgtgtatacatataaaaaaatatacacaaatacatatacaaagatatgcatatacaacaactgtgtatacatatacagatatacacacacacatttccctcctacttgcattgttattcagtagtaattgtttatttctaggttctatataaattttatgttagcgtagtaggagtctactgaaatgctgacatttcaaatatattattggaaatgaaatcagtctatcaataaaaggaaatgtgttacaaatgcacacaatgcagagacatatggcatttgaatgaatgtgaatgccattgtgagaagtcaactgtggatgctcagtgggaaatcctcatcattttgtatttagtctttatccaatgtggactttaaacttggctaaaagacgggttcttatttgagcacagctagagactgattaagttatgtttttaccataccctaatgaaattcactggatttatataagatttagtgcctaaaccaaaagggatatgaagagatatatcaacattctaatgttaaaaaggaatagcttttggagtaaaatcaacagttgaaagcagttgtatttcactgttttagatgtttcagatgtaaatcactaggtttaattatttccaacatgttccacatgtttctatcaatttaatatcatttccaacaagcaaacacattttgttacatttcattgattttaaatgtcataaaaagtaagagtaaaacagtagttcaatgtatacttatttacagaaaaagtttatgatttgaatatgctctttcagaagacgaaattgcagacaacttacatagcctttgtcacgacggaatatgtattcactaaatggatgaactaaggaatctctggattcataaacaaatatgtcaataaagcatgggaattccatgtgaccatattttcctctctttggagccatatatatatgtgtgtgtgtatgtatatatatatacacagatctgaattatatgaacaatataatttggatattgaaagcttttcttttataacaaaatatactctttttttcttttgtcagattttagtgctcttgaaaaacaatagtacaattggtagctttccagtaatttttaatgttaattcttacaaaaatgtcacaagtatggtgaattcagtagcattattcagagcaaaaatagcgaatgtttcaagctcgtatggctacatgaaagcccaagagagctcctctaccttcaattaacttatacgtcagcgatgtctctctcctttccctcccactttatttgtggtccattctatattacctagcacttgaggatacagttttatttaaagttttctatttgctgagtctcatctaccccacattattaaccctcgaagggcagaaacatgaacttccctcacaattctccatcatatctaacctctccaactatgcccaagcaattaccaggaccaaaataattatctctgatatgtttcttgcttctgcctttttcattccattcaccttgaaattttcatagcatttcagtgacaggaaacaaacaacaaaaagaaggcaagtgaaaatttacccatttaaatgtaagagcctgagactagttgttgccattttaagaggtgactgttgctgaaaacagttgatcaggaggtagaacttcttggagataaattttgatttctggttataaactctaacatgtgacagaatgctgacagttcagaattctgctggagtcactaaggtggtattttgagttcactgtcaacttctctatttaaatgactaaattaatctcattgatgtctcataatgtcctaaattttcaaaatgctgacattagtactaatttcagcatctcttttaacaaaattttctgactttgtcttggatttgctatttgaaatatgaagcaactgggtatggcagagcaatagttactttaaaaaaaatagtaaaccaagagaaaaaactctactggctttcaaaaaaatcttttataaaagatctaccatataaatcaaagagaacctctaattttctctagacaatgttaaattggccaacagggtcatgaatcatgttatccatctagatatagctagtgctcaacaggaaagactcataaaagggtagttagcatttggttaaataaatgaaaaaataattataaccccatatagctactaccaaattcagtataattgtgtaataagcttttacaccacatttctaatgagtttattaatactctttctgaatcttttccaaagtaggcactgaattctgaggaaggaagaatgagaataggttttagcccttagtcattgtcttgtactcttgctaattttacaagctgttgaacctccctgcttaaattttctcataggtaaattgtaccaatcatacttcctctgcatgcttcacagatatattatgataataacatgagattctgtacctgtaagcactttgaaaaatataatgcagtgtgatatacttttgttttgtttgttttgtttgagatggagtctcgctctgttgcccaggctagagtgcagtggcacgatctcatctcacttcaagttctgccttctgggttcacgccattctcctgcctcaccctcccaagtagctgggactacaggtgcccaccaccatgcctggctaattttttgtatttttgtagagacagggtttcactgtgttagccaggatggtctcaatctcctgacctcatgatctgcctgccttggcctcccaaagtgctgggattataggtgtgagccaccgtgacatacttttaaaataataattccattttggagaacaggaacttaataatgatagcataaaggcatataatctgtaggactttatatatttatatatacctttgtatacaaaaatacaattaattttgtactagtccattctcacactgttataaagaactgcctgacactacgtaatttataaaggaaagaggcttaattgactcacagttcctcatggctggggaagcctcagaaaacttacaatcatggcaggagaaagcaaacacatctttcttcacataatgtcaggaagaagaagaatgaaagaagtgcagagcaaagggggaaaaggtccctcaccaaaccatcagctcttatgagaactcactcactatcatgataaaagtacaggagaactgcccccatgattcagtcacctgccactaggtccccccccgccaacatgtgaagattacaatcagattacaattcaagatgagatttgggtaaatacacaaagccagaccatatcattcaagtctgaccctggcccctcccaaatctcatgtcctcacatttggaataacaatcatacctttccaacagtcacccacagtcttaactcagtccagcattaacccaaaaggccaagttcaaagtctcatctgaatcaaggcaagtcccttctatctaagagcctgtaaaatcaaaagcaaattagttacttcctaaatacaatcgggttacaggcatttagtaaatgtatcagttccaaatgggagaaattggtcagaacaaagggactacaggccccatgcaagttcaaaatccaatagggcagttattaaactttagagtttcaaaatgatctccattgactccatgtctcacatccaggttatactgatgcaagggttggattcccatatccctgggcagctctgcctctgtagatctgcagggtatagccacccctcctggctgctttcatgacttggtgttgagtgtccatggcttctccaggcccaccgctcaagctgtcaatggatctaccattgtgggatctgcaggatggtcgtcttctcacagctccactaggtagtgccccagtggatactctgtgtcggtgctcagatcccacaattcccttccatactgccctaacagagtttctccaagagggctccacccctgcagcaaacttctgccagacgatcaggtgttcccacacatcctctgaaatcgaggcagaggttcccaaacctcaattcttgatttttgtgtacccacaggtccaacgccatgtggaagctgccaaggtttgggacttgcaccctctgaagcaatggcccaggctataccttgggcccttttggctgtggctggagctgaagcagctgggatgcaggtcatgatgccccaaggctgcatatagtagggaggccctgggcctggcccatgcaaccatttttccctcctagacatccaggcctgtgatgggagaggctgccatgaacgtctctgatgggccctggtgatattttccccattgccttggtgattaaccttcacctctttgtaacttatgcagatttctttagctggcttgaatttctcaccagaaaatgactttttctttttacttaattgccaggctgaaaattttccaaactcttatgctctgcttccccttgaatgctttgctgctttgcaaattcttccaccagataccatatatcatctctctcaagttcaaagttccacagatctctagggcaggggtaaaatgccaccagtctctttgataaagcatagcaagagtcacctttgctcccgttcccaacaagtttctcatctccatctgagaccaccgcagcctggacttcattgtccatatcactgtcagcgttttggtcaaagctacaagtctctaagaagttccatactttcccacatctttctgtattctgagccttcccagtttctaagaagttccaaactttcccacattgtcctgtcttcttccgagccctccaaactgttccaaactctgcttgttatccagttccaaagtcacttccacatttttggatgtctttccagcagcacaccactctttgtagtaccaatttactgtattagtccattctcatgctgctataaagcaaacactgggtaatttacaaaggaaagaggcttaattgactcacagttcagcatggcttgggaagctttgggaaatttacaatcatggcagaagcaaatacatccttcttcacaagatagtaagaaggagaagaatgagagaagttcagagtgaagggggaaaaggcccttacaaaaccatcagatgtcatgagaactcactatcctgagaacagccagggggaccccccaccacccaccatgattcaattacttcccatgatgtccctctaccaacctgtgggtattacaattcagattacaattcaagatgaaatttggtggggacacagagccagaccatatcagattttttttggtaaacatttgagtaccgtttatgaagaaatgtgtattattccatttgcattgctataaaggaatacctgagactgggtaatttataaagaaaagaagtttatttggctcatggatctgtaggttagaacttcaggaagcttataatcatggcagaaggcaaaagaagaataggtatgccacatggcaagagaaggagcaagagagaggaggtagaggtgccacactgttttaaacaaccatgtcgagtgtgaactaatggagaaataactcattcattactgaggagggcaccaagactttcatgagggatccatccccatgacccaaacacctcctactataccccacctccaatattgggaatcacctttcaacatgagatttgaaggagacaaatatccaaactatatcagcatgaagtgtagtagaaaaactacaaggtttagggacataatcatcattatcatcagccttgcaatattgaatttacatccaaactctagcacttactagctgtaggatcataggcaaatttctctaatccttgatatctccatcttaaaattacatgatttttacctctgtatcacaaagatatttttcttttacttttacttcttttcctttttccttataactgagacaacttaatgtcccacaatatccattctcccctttgtctttttagttttaagtagggcaaatgatcatccagctcgagaatccattctctgaactcaactccctgcagcctaacgtgtttctctgactcagctctcatcaaaaaaatatgagcagaaatgattggtaaaacttccgtgtcccattcttaaaagaaaaggactttactttgtttcattcatttcacctttcccacaaacaggaatgcagatgtgatacaagtgagtcagattcaaacatgcagacaaggccaacagcctggcctaagggatgtcagagcagaataatccctgtagcacctgtctactatggaactgttatacaagagaaaaataaacttctgttttgtttaacccactgtttttgggggtctctagggtgtactttcttagtctctatcctaataatataatcccctttttcctttttctttgtccttctcattctaatgttatttcttgagtgcctccctggtgccaggaacttaggtatggatttggttagaaacttatgtaaagtgcaaagtggagtgtttaagacactagtgttaagtgaatgctgttcttccctcactaaatgccaagaactatagtgacacacaggagacatacaatgaataaggcctaactctgattcgtgaaccttacaggtaataaaacatacagtagcaaacggttattttgaaatgacttatctcatggttatttgagtataatttggccaaagtccaaataggaagaaagaatgaatgatacattaagagctgagaaatatgaatttttatagataaaagactatatttcaacaaaatcaaatttgcaaaatatattcatacaaaaaatctatctcaacagttctgaaaatgtccacaagaaaagagtaaaatatttatctttacactgtacaggggtgcagcctatacaatttcttggtcaaagatgttaaacatatagttttataatttctttttatgtttttttggttcatttgtttataaaagaagggaaaaaagtaaaatgagtagagaaaatgccctagttatctttatattaaatgtctatctttttgttaaagtcagccatattgatttcattgagaatgagcttcattaaggacaggtaatatctggcttaataatttttctctcaaaggatggcaaaatgcctggcccttaatattaataatagttacaatgctatttattaatttaatttattattaatgaattaatagtactaatattgctcattgattgtttattatgtgtcagaccctgcatcattatgttgacacatttaatcctcataacagccctataaagtaggtacaatatctattctcattttgcagaaaagaaaaatgaaaacaaagagtttcagtaattttctcaaattcatattgtattacaatgtagtagaactgagtaactatttttgaatgcataagttccacattattttttggattcactcaattgaattattcttttatgtatgtaaaaggagcatatgggaaaaggcttcaaaatgaagtgtaaggacaggtaacatctggtttaccaaacagaatggctgaaattaaaaagactgataatattaatgagcatgtggagcaaatcaaattcacacactgttagcaagtgtgtaaaatggttaaccactttgggaaactatttggcaatttttatgaagtttaacatacaccttccctgtgacccagcaatttcattcgtaggtattgactgaagagaaataaagagaaatgacaacaaaaagatttaaacaacagtgttcacagtgatgtggttcaatataggctcagactggaaataactcaaatgtctatcacaaggacaatagataaatgccctatggtgcatacaatgggatattacccagaaatttaaaaagtagagcaaactcctgatgcacacaataacatgaatgaatctcaaaaattttatgatagcaaaaacataaggcaaacaaaatagtgcatacagtaatatttcacttgtgtggcattcaggaaaacatcaaactaatttagcagaataaaatcacaactgtgcttcccaaggaatagaagggagagttggggaagctgatggcaatggggcacaggaaacttttggaaataacagaaatgctctttgtattgatctgagtgatggttataagagtgtacacacttgtcataagtcactgagctgtacacttaagatcactgtatttcattacatgtaaatgatatctaaaaatgtatgattgaaatgaaaaagaagcttaaaatagtaagattcgttttaacaaagaaaaatgttcaacaaaagacatagcaggccaattgtggtgactcatgcctataaacctagcactttgggaggccgaagggggcagatcacttgaggtcagaagttcaagaccagtctgggcaacatggtgaaaccccttctctcctaataatacaaaaattagctgggtgtggtgatgtgtgcctgtaatcccagctactcgagaggctgagacacgagaatcccttgaacctgggagacggaggttgcagtgagccaagattgcaccaccgcactccagcctcgttgacagagtggagtgtggagactcaaaaaaacaaaaaacaaaacctggacattgttaataagaaagggagaaatttttgctccatttttgttgctatgaaggactacttgaggctgggtcatttataaagaaaatagattcaattggctcatggttctgcaggctgtacaggatacatggcgctggcatctgcttctggtgactgcctctggaagcttccaatcatgacggagggcaaagggtgagaaggtgtgtcatggtgacagtgagagtgggagcttggtgggggaaggtgccacattcttttagacaaccagctatcacatgaactcagaacgagaactcacttaacaccaaggagatggcactaagccatttataagggatctgcttccatgacctaatcacctcccaccaggccccacttccaacatcaaggatcacatttcaacatgagatttgaaggggacaaaacatccaaaccacaacacagagaaatacactgagtcatttttctgtgatgagatatatgtggtacagcctaaaagcaactaactgactttaacaggatacaatttttatgaaatcaagtcccaagccaagtgtatatttcataatctagtgcctactattttaattccttctgtataccacaaaaatgcacttaaagaatcaaaattttaaatcacagagaaggaactaatttcagcatttgttagttcttttgtaaacagagcatatattattaaaactttttcttaaataattctagaaagaggtaaacacatatcttttcttcaagaatattttacaaaacttagaatttaatattttctatattttattcttgagtcaactgagactcagagagatcaatgaacatccatgataacacatagctaagaagcattgggagcagaattcaaaattctgtagtctagaaacacagcttgtactcttaatccattaaactatcttgtgccccttgactacaatgtgtcccctgattgcatgcccagtgacaaactgtcttacttaaacaagcactgtataaatccttttccaaagcatcaaaaatattgttaaatatggcactaactctagcacagtggcatgctgatattgccaaaacttgagggtgacaataatcaatcacattatataggatttataaatcagctgactctcaaacttaaatgcacataagaatttttactttaaataggcagccaagtaattcttatgaaagcagttcacactttaagacatactgctaaaggcattttaaaatttacatgcaagaatagattagcattcagtcctatttacaacatactggagcagttgctcatctgatttctacctatggcatgaaggcttcagaatgaaataggtttgctgatttttgtagtttttaggtttttcattatttttgtacacttttggtcttttcaatatgttcatatagcacaagtttataattgcatatattaaatttgcataaaatgacttcaatatagtttgctttcagggtttactggaggctttttgctttcgaaaaccagattatgaaaatcatgttttctctgtggagactgggcaatgggccgggtttcagttttgatagcctcctgttacaggtctccttgacattcccttgggctagttcttatcatttggctgctacttcttccatcataatgtaagtatttattggtctttcagatatttctgttttcagttctattgattgaggttgttgttcatagttattgtaattagataaaggatgaaaatgtgggaaccaattattttaaagagtgtaatactcattatatctccctactgatcattttaaaaataaaatatagtagcaaatttatcaaattttatgtcagtaatgtattttttagaaattaagataagtctaacaagataaaaatctctttgagcctttggataaatattcaaactaagtgatatgtcaggtatttttctgctttattattttctgaagtcttatatttttaaatttttataatggaaaagtttatacatgtaagaaaaataaagaacagaataaataaaatgaaactcatgtagccattacccagcttcagcaatttttaattcatggcctattttgctttatctatgaccacatcccttggtgtttcaaagatcacatctaaaatattttaataagtctctttaataactcctatcccacaaataagatcactgtagttcctgaaactcagtgccctttttaaccttcatataataaacttagattttggctctatgatgacaatacaatcataagaagtatatagattctttggcagtctctctaagtgctccttttggatatttgttttaggctctgtggacctagctatctggaaataggctattacttggtataatcttacaaaattcagtctttgatttaatatatacatgcaaaaatacatgcaaaataccatttgtgcacaaaaataactgttgcccaaagtttgaaatgtattgaatttatttaggacttatcttttgctaccacatactaaggtgttaataaattgaaagcctggaatgtctcttttttaacagaaacacattgtcataacacaaatttcttagaaagatttaaacaataatataatcttctggagtgaattgtgtccccccaaagtgtaagttgaagtcccacccagcatacctgtgtatgtcaccttatttggaagtaggatttttacaaatgtaatcaagtttagatgaggccatactagaccaggctgtgtattagttagctcaggctgccatacaaaatgccatagactgggttgttcaaacagcaccaatctttcctcacagttttggaggctaaacatctgagatcggggacaagcatggctaggctctcataagggctttcttcccagcttgttagactactgccttcttgctgtgtcctcacacagtagagagagaacattgatgcctcttcctcttttcataagagcaccagttctattggatcagggccccacctttatggcctcattaaaccttaatcacctctttaaaggccctatcccccagttccatgggggattagagcttccacatatgaaactgggtggacacaattcccactcatagcagggtgagccctaaatccaatggctggtgtctttataaggaaaggaagatttgcacacgtacacacatacaacagaggaaagatgttcatgtgaaaacagaggcagtaattaaagtgatacagctacaagctaaggaatgctaaggacagccagcaagcaccagaaactaggaagagacaagaaacagattcttctctacagccttcagagggagcatggtccagatgatacattgattttgaactttcagccttcaaaactgtgagagattacatttctgtgttaagttgcccaatttgtggtaatttgttacaccagccctaagaaacaatccatatgagtcaaatactttgggagtacaatctattaaaaaaaaaaaaaaaaaaaaaaaccaaaaacctctactggagttctaggattaattggtttcttacagcattacattgggagacagaaaggaattcaggttaatcctttaccgctcttcaaaacaggccaaagtgctagaaagttgagggtggatattcaagctgttctttgataggaactgaaagggatcttgagatctggaatctatacatggaatggatacatgttgttttgtttgctactctagttctgattatatttcttcaattaaagggtactttcagggtttttctttgttttgttgtttgtttgtttgcattacaaacctcattctcaatctacacgatttgggtgagaatggttctatatccaagccagcagtaacctgaattggcttaagtgaatcaatattccccattcactagctttagaaggcagttcaaggatgattaaaatgtaaccccatcttagcataggaaatattttgaggtaattcatgagaaaggaaaaaagatttattttgtttttgtgtttaaaacaaaacaaaacaaaactagaagcaaccctcgctcttctaatggtgtggtataaattcatgagatctagcatcaacaccattttaccgccaaaatagaagagcgttgagttgtggtgtctgggagtgaggttgggggcagggtaaggagcattgacaggagcctgatgatgaagctaaccctaagaaaagctgagtgcagagacagagaatatgcgccgagtgctatggttttatctgtggatacagaatcacctgacgcctgtgccctttgcaaatcccaattttattcctttgaattttctaatgtgcaatcatatcatgtacaacattttgctactttcttccaatattcacacacctgtctcatatcttatggtatttctaatataagattaaataatagtgctcggtcatcattgttttgttctaaagttctaataggaatgttctacggatgtaccatttggttacaggctggagtgcagtggcacgatctcggctcactgcatcctccgcctcctgggctcaagtgattctcctgcctcagcctcccgagtagctgggcttacaggcacccgccaccacgcctggctaatttttcatatttttagtagagatggggctttgccatgttggccaggctggtcttgaactcctgacctcagcttatccacccgcctcagactcccaaagttctgggattacaggcatgaaccaccgtgcctggccaatcattcctattacacagtaataaaactgatcatagttaagaattattgaatatttcctacattctgggcatttgtgtttaattatttatattgacaatcctctcaataagtctataagattattcacttcatcttacaaatgaggaatttgaggcatagagagtttgggagacttgtccaatgtcatacttgagattggaagtcagattttcaaagtaggctgtgtataaatttaagaaccatactatcaaaggttaatatgatttctgaaaaatgcacaactaattgcattttcttacattgtaattaatatacagaatggtgtatatcacaaatagtttgatccaccagaaaataggggttttaaaaatcttcagatgttagttttctaagaagactttccagtcaaaaagagaatgcatttgcttgctaaaattagtattatgacctacttggcacatgtagtatgtaaattaacaacatgtcatctgattcatacatcagtatcttctaagggtggttggagagtttgagtccctacagaccagtacaaaccttacatcggaaaacgcagagctgaggtgtgaccttggtgagtttatccaggtatgagcaactcatgaggcttctatggaatgtcttttttctcaaaaatttaattgtacaaagtgctttgaatttatagcagactgcccttcagtttctatctaaatgccataagctttgtttcaagggatcagttggagtcaataatctgggcaatttcttacactttcttgagattgtaaattggctagacctctctggaaagtatctttaaaatatgtatcaagaatttcaaaaatgtgcatgctctctgatctggaaactcctcttataggaatctagtctagaaacaaatcagagatgccatcaaatacatatataaacatgtttattacaatgatatttgcaaaagggaagcaacttgaatgtctagcattatagaaatggttaaataaacattggtacaaatatatgatgaaaaaaatattatggaactattaaaaatcatgatgatgaaaaatatttgatagcaaacaaaaatacttaaaatacaggtagctacaaatttaaatataaatgatggatattttatatttgctatttcattacaattaaatacaaaataccagagagaaaaagcacaaaggttaacagtagttatctctggatagtgaagttataaatgactttaaaaaagtgaattctttgtattttttagaacacacataaaaatatttaaaataagaggaaatggcacgtgtttttaaaagattatggaagtatcatggaaacatgaaatgaaaaaaaagaaaaaataatagagcattattcttgaaggttttaaaatgcattcaatatgatttaaaagtaaaagttttttttacatgtactttcttttttgagtctgattatatggtcttttaatattgttagtaaacaaaattaacaattataagtacaaataatcttctcttttttttttttgagacagagttttgctcttgttgcccagggtggagtgcaatggcaccttctcagcttactgcaacctccgcctcccgggttcaagcgattgtcctgcctcagcctcccaagtacctgggattacacgcatgtgccaccatgcccggctaattttgtacatttagtagagacgggttttctccacattggtcaggctggtctcgaactcctgacctcaggtgatctgccctcctcggcctcccaaagtgctgggattacaggcatgagccacagcgcctggccccaaagatttttaaatgtagatttaatggtgttttatttcattttgtgtaaagatatttattatttagatttttttaaaacaaaggttgagataatttattgttttgcttagatactaacgtttcccataacatctgttcatttggtttacatttccaccactgaaccagtgactgaaattctccccagctgtgatttatgatctgtttatatacagtctgccagaccatactgccataaagccttcaagattcccaggtaggaagaaagtgaggttttacaatctatctcagacttccttatgttatatagtttaaatcttagcaaactacaaaattgaccttgaatataaataatcagaatagttataaaacaacctatctttggacttttcgaaacatattttattcagtactggattctagtttatactatgctgttggtggggacacatttaaactatgtacatcacaccaacacacagtgtcctgaaaatatgaggatccctaattgaataataaaataattgatgtaaaaacaatagtaacttttcatgtctagtttacattatttctgaaaatgtgtacatgttgattaaaaaaatttagagtagacaaaaatgaaaccaggtgttctaggctagtaaagttctgtgattaagtttctttaaaatttcttttaaaaacagggaaatgactatttaatctaagagatgtaacttccttttcaaagatgtagaagtacctacctactggtgaatagacaatattttattgcctttttaaggaattttcaatgacaatttaactctataacaggttttcagagttttcacatagcaatggattatttgattacatcactcatctgttgcttatttaaataatgcattttttctttaattactgaattgagcactcaaacagctaacctacacattctaacacagctaacctacactccatccttctctgcaaattataaaaatcttcctgaaatattttgtagaattctgaactgttttctgaactctgatctatgaaatacactgaaaagaatcacaaaacaaatcaactacagttaagagaaaagcaatggcctaaatgatgttattgcaaatactggttaaaattaattgagcgttttgcaaatggcgtgtactgtgctcaatgctttaaataaattatatctcatcagattcctgactcttggtaaaaaggcaagaagctggacaattatttcctcaaatgaaaaaacttgaacaagtaactttatcaaagttaccagtaagtaaatggcagaactgggatgaaaatccacctctactaacctccagattagtcaagagaaacagaatacaatccataggtcaaaagtatgcttattctcaccacccctacccaacacagttctgaaagtcccagtcagagcaatcaggcaagagaaagaaataaaaggaatccaagtaggaaaagaagtcaacttacctctctttgccaataatatgatcatacacctacaaaacaccaagaactctgccaaaatgtacctagacctgataaatgacttcagtaaagtctcaggatacaaaatcaatgtacaaaaatctgtagcattcctatacaccaataacgttcaagctgagagccaaatcaagaatgaaataacatttacaatagccacaaaacaaataaaatacctagaaataatctaactaagggggtgaaagatctctacaaggagaactacaaaatagtgctgaaataagtcacagatgacacaaacaaatggaaaaatattccatgctcatagattggaagggtcaatattgttaaaatggtcatattgccaaaagcaatctacaaattgaacactattcccataaaagtaccaatgtcatttttcacagaattagaaaaaatattctaaaattcatacgaaaccaaaaatgagcatgaatagctaaagcaatcctaagcaaaaaacaacaaagccagagtcatcacattacccgacttcaaactctcctataaggctacggtaaccaaaacagcatggtactggtacaaaaacagacacatagaccaatggagcagaatagaaaacccagaaataaagctgtacttctacaaccaaagtcgacaataataatcaatgggaaaataattctctaatcaataattggtgctgggataagtggctagccatttgaacaagaataaaattggtctcctgcctttgaccatatataagaattcactcaagatggattaaagatttaaacgtaagacgtcaaactataaaaatcctaaaagaaaatgtaggaaataccattctggacatcggccttagcaaataatctatgactaagtcctcaaaagcagttgcaacagaaacaaaaattgacaagtaagacgtaattaaactaaagagcttctgcacagaaaacagacaataaacaaacaaacaatcaacagagtacacagacaacctaaagaatgggaaaaaatattcacaaaccgtgcattcagcaaagatctaacactcataatctataaggaaattaaataatgcaacaaataaataaccaataactccaccaaaacatgggcaaataacatgaacaggcatttctcaaaatatttaaaaaatgctcaacaccactagtcatcagggaaatgcaaatccaaactataatgatataccatctcacattagtcagaatggttattattaaaaagttaaaaaataacagatatcgatgaggctgttgagaaaatggaacacctatatacagttggtgggaatgtaaattaggtcagccactatggaaaacagtttggagattttccaaagaacttaaaaatacctagataggcacagtggctcattcctgtaatttcaacactttgggaggccaaggcaggaggattgcttgagcctaggaatttgagactagcctgggcaacatgatgagactctgtctctacaaaaaaaaatctaaaaaactggactcagcatcttttgtagtgactgtgtctctacaaaatatttaaaatgaccacgactgtggtctcagctactcaagaggctgaagtgggaaaatgacttgagccaaggaggtcgaggctacagtggtcagtattcacaacactgcactcgagcctgagtgacagagtgagaccctatattaaaaaaaaaaaaaccaaccaataaacacaactaccatttgacccaggaatcccattactgggtatatacccaaaggaaaataaattgttctaccaaagagacacatgcattcatgttcatcacagtactattcacaacagcaaagatgtggaataacttaggtggtcatcaatggtggaccaaataaagaaaatgtattacttacacatcatgtaataatatgcagccataaaaagaaggaaatcatgtcctttgaagcaacatagatgcaactgtaggccgttatcctaagcaatttaatgtaggaggagaaaaccaaataccacatgttctcacttgtaaattggacctgagcagtgggtacacatggacagaaggatgggaacaaagaggaagagaagccagagctgaaaaactacctattgggtattatgtttagtacctggctgacagggttatttgtaccccaagcctcagtgtcaaacttaatatactcatgtaacaaatctgcacatgtagtcccaaatctaaaataagagttgaaattataaaaataagtaagtaaataaataaataaataaataaataaataaataaataaatcaaagcataatcaatgcctaagtcagggaaatttacagtgaaagattttcctagcatttttttttcaacgtgctcattttacagatgaggaaactgagacccaaagacatcaagtgacttgctcagtttcacagagcttcacatagctcttagattacacagcatgttgcctcagtgggaaaactgtctcatggcaattcctcaatcaactgtagatgatgcaagctgggatttaaaaaaaaaggaaggcataaattttatagttattttttgtctcatatttttgaaaatgctgctggaagttcagctgattaaaaaattaacacagcaaaattttttatttatcaatggtctagttttattcatataaaccacactagccctatactctgaccacctgagttctacactggaattatttggaagtacatccagacaacacataatttcctcagtaaatgtaaaacaaaatttggaagccggaaaaaaaatgtggaaaaggattatgtttgaaatattatagaagaaaaatgagcagtagagaactgaaagaaaatatctaattatatgctttataagtaggtaagaactatgaatgtggaccttatttttcaaacaggaaatccacagaaaattatagcagaaatcagcaaaaatgaagggagataacttggtaagttttagaatttagcaaataggtgtgaagggcaatcaccagacagaggaaacttagtagcagcagtttgtggaactcaggtttcattaattaactgcaataagcactgagtagaaataaatagttctatgaaatactattaagaaaacataaatgtgctttctgaagagaggggaagcttattatctaaagaaaataaatggaaaaaatacctgtttagtagtacaaaatatacttaaaatcatatttctaaaatgtcatatttcttaaaattaaccaacaagaaaacaaaatattgaaaagctataactattacatttcttgttgatacttacaaaaatgttatggtttagggtgggtcagatataattatctcttttttatagatgagatgtcagaaagaataaataacttacatgagattacacataaggtctataattaatactgaaagctagattatatagctataaattttgtccttttactgcagggtacatgttttaggtttgaacaaacatgtctagacacaaaccctcatgaaatatgattacaaactcaaacatgatgcaaagaaacccaaaagagctattaaagataaatacaaacattaacttatcagtcaaatatgaattataaaatggatgtgttcctgagaaattataggccaaattaaaattcaaatataaatctcttttacaaaactgatttatatgtcatgagataatattatgtgacattcattaatgttttctccctctacccacagaaccttggactttgcatccttcttcggataggattctaattctagtgcccctacctcattttagaagtaacagaagagaagacacagtcaaattcaagcttcaaaggggaggtgtgggcattaatattgaaaataattggacacatgcttggctagtcagatggagtttttcctctgccctatttattttgtaccaccaacaccctagatagaagtttccctgcatggggaatggagtgaagagaattcacaggcgagtgagagaactggattgttcagaaatagtaagcctgtacaattttatcaagaatttacagtctaaactgaattcttaaaaggtataatgctactagaatcctacagcatgctctgtgacccatatttcctgcagaatgatatttcagttaattctacggagaaatgtcttttaaagctcttatatgaaatgatacagttctcatatcacaaatttaaatgttcaagaaatgtaatttctcatcttatccagagttttatctaaatgtctaaaatgtagagaatgccaggccagagtaaagttgaggaatttaggagcagggaataggtgaagaggaactgggaagaggctaaaatgaagcatttaggcctcctcattcctttctaatctcaaagtgtcagtccagagtttgtggctccatactccttatcttggctgtaagataactcctggactagcttctcccagctgcatatgaatgtctaaatgcttaggactgtgtcaagattgatgcttacccacattttttccaagaatggaggagtgatcaactaagcaaacatttggttaatgattaagctaataccttggtaaataaatatggtaaataagtatctggaagaaacatagaaaatgtcctcctcacccaggataaaggattacttaattcattgattaattcaattgtttgcattttcagtaaatacatattgagatttgttttaatgtgcaaaaaattgtcaagctcttttattttttcaataataaaaaaatacaacctttgatcacaaagagatgacatattagcgcagtattttcattgagctgcaactttgtaaagacagtccccttcaaatacgtacacacacacacactcacacccacacacacacagagaaacagagatagagaaaatatccatattggcttattaaagacacttagcatccttagagaaaataagcctaaaatattttttaaaccccatgtttccaaattttgctggactttatgtccctgtcctctcacccagatatgttagtttaccctcccaaagtcttgggtaaagttggtttagtgaattctaaataaagaaatgtctctagagtagataagaacatttcttccagctgtagtagtttgaaataaacttttcattagtacatcacactacttcctggtatccttaaatgtcaataagcttgtgactataatttttaaagtaattatatgcttttgtccaaggagtagttatttccaccaacatgaagcgttctaggcaaaaggccaagactgccaagcttgccagatattctctcacaaaaagagttggaaattggtattgtgatttataaatcagtccctttgggtttgatgagtggaaaacaatgtgaacctgtctcctgaagtgtgaatactttctgaggtagctgacaacactgaatttctgaaactgcaaagctggtgattggacactgaattcatatctcaagtctagacatcaggaagggctttgacagcagttctcaaggtctttgtaatatcacttgctcctttctactcatgtgcctgctgccatcattagagaccatgaattacactagaatattgacatacacacatactcaggcacatacacagatctcactcatccctactatcttctacaaacaatgaatgcttcctcccttctccactgcctaaattaatcccctcattgtttctcatccatacctctgaaacaaccactctctccctgccacaaataatattaactaaaatgtccaacgggttttgttaatcccctgcaaaatagcttaattagttactatggtacaggagatacatttcaacctccttctcatccttcgattttcagcatactgcagttttcactcatctccctaatctaaatttgatcctcctgttatcctttctcattatactttgggttttttttcctcacccttcatgctcactagccaaatttgtgctcataattgtgtgtgtgttgtgtgtgtgtgtggggggggggggtttattcaattatgtttacaaggtaattctcaaaatatttaatcagtatgacgtgggtacagaagagtcaaaagtgttgctaggctggggaagggccagcggccagagaattatggagcaattttagagattggaaaagtggctatttgtcagtacatgtaaatgtttcaaaattctaacaactgaaaattgttgtgcccttaagtaccaggtgaatattatccctgggttatctgactactcaattagacaatatactaacaagaacaattaagcatttctgtttcattgggcattaggtagcctcagcctagcaaataattctctgaagcaaagtgagaacacaataagcatttgttgaattgatttaacatggcataccaggcacttcataatctggtctctgccttctttaccagtttcaagcatattagttcctgactagtactttgctcttcaactagagataaaaatatatagtccctttcagaaaacatatgccatatctctacatctttccttgtgttgttctttttggctggaatgtccttctccagctaacaattacacattcattaagacttaggtcatgtgccatctcatcagatcaatgtttctgtcacggttatccccatttctcaaatcagccaccagcctgccttagctgttcctcctctgtttacccatagcatgcttacaaacggtagtttcccacatcgtagtttatagcagtttccacattcttcctgaataaactgtttaattttctaattccttttcctgtgatctcctagagggcaggaaccattgtttacataacctgaacattcagattctagctcaaggctggatgtatacacacagtgtaaataaataattgagcaaattagtgaataattgccacttacaagcaatataatatagatctttacccacaatgaggttagaattatttatagcacatttctacaaatttagagatagtaaggagaagcaaaggggttaagtaaaagagaaagcagcatgaagtttccatacccctacactaagaacagcaaacatactagattgaaagtcaaattcaatctacagctgagttttatttagtccatactgtgttttaaatgttatagaattaaactaccttcaagaaggcatggattttttagttcaccactgcacccaccatcccatatgatctctgtccagatattgatttcatttatgttatctaccattgaatgaaagattttaatttgaattttaatgggcaaactctgttacaataaaataaatattatagaagattgaaaaacatttgttatataaaatattgctaaaataagcagtataatagatgaaactttgatagttagtctggtattttagtataaaccacagcttcagtgaatttggaaaatattccagttaaatctctgttcgagtttctgcttctcagcaaaagccgctaggttgaaatgttaagggtttataaagttataagagaatactattcaaatccctctaactcagagactggaatcacagatttttagtgtgtgatgtgcaccatatgtttgtataccaagcacaaaataagcactatcaatcttctaacctatttgaaatataatttattgagttttcaaatacattatttcaaaatgcaaatgttagcctttgttaagtctaaagtaggtaattaaatcatatgagtcaccaaaacagaaaaaaacaccaaacatgtgtgttttaattataatcagcattgcattgcagtgttaaacaattagagatcgttatactatcctaaaacatcagtgggatagtgtcagaaatgatgactattccttgtttacaaaagactccgcctgtggcatgctgtgtgcttttataaatcatttatcttctagctttaatctgtcatggtatgaaatattacaaatgtgattctgcatgacagaataatgaaatactaaaaaaggctgtatgtaatgacttctccataaaaagttttccagaaaaagtaatgcatctatattaatatatatgtataacttttttctttttattatttcaaatattttcccatatcaacatcttaaagagaagaccaacaattttatagtgaaactttgcaagaaatgtttactctctatatgaatattcaggctcattcaaggaattattttgtgcctaaataccagcagggaaacaaagtagaaagtcaattttctagcatttgtaatgaattgaaaaatgcaaagttatcttggaggtatttattacactttaatgataagagtgagaaagttaaaactgaccatcacggatattccgatgcattaaaaaagagaaaagaagaaagaaaattacagagaagaatgtagcatgccattgttatataactaatcttacttttgcagaataataaaagattcagaatttaggttaaatttatagttatctttggaatttaatgaaattatatgaatccatgtacttctgtaagcagatttttggtgcaactttcccatactttaattctctagcttccagtagcatactctttaaattcaaaagtagatttcacctattttttaaactaggaagtcccttggggacaaaagtttttattttatatatcaagaaaatgaggaccagaaagcttaagtaatttgcttaaagtcacatggccaattagaggcaaacgactgcaatccagacctttggatccccagttcaccttgtttcccactatttcgcagtaaccgctcaatcttctcttcagtttacaattgttaccatcattgactttatgacattgaacctcatgtcaaaataatcttcggcagctttatgccacctggtatgaaatagcctaacaggacaactgcagaacttatcacattggtaaaatgaagcaaaaactaaaaacaaccataaatggggaaagtactaatatgttgaaatgtcataaccactgtttaaacaaattgttgtaaaatgtctagcttcatgttcctgcactatatttttcagctttcttctgaattattaagcataacttattttctataactgccttacagcagcagaaatatgaaacataaacatcggcacttatacacaatgaatgtgaatagataaccatcatatgaatctaatcgattatttgacagttattttgaaaattcagctaatcccattctagagcatattatagtgaaattcttgcaagttgaaaggaaataactttgcttaaaatggaaagataatataataacaacagaaagatatatatgactatatatatgatacacacgtataaattacagcttatattaaaacatgtaaaatcatttttaatgtttaactgttgacaactttcaagccccaccactcctccttcccctctgcctcatatctgggcaagctgattaggtcacctgagtgctgcctctttgccaccagtggtaagtttaaatcatgcaagcactcacctgtacacagaaactctcaccccactgctactccataatcacaataaaactccacagtcaatctcccttctctgctctctcacgcattttgaaactgcttggcagtttgccttgctctccctagaaagtctcattttgtgagtaacacggcttttcatacttccttgtgcttgtgtggtatcagtcttgaaatccaaaccagggctgggcgcagtggctcccacctgtaatcccagcattttgggaggccaaggccaaggtgggcagatcacaaggtcaggagttcaagactagcctgatcaaagtggaaaaaccccatctctactaaaaatacaaaaattagctgggtgtggtggcacatacctgtaatcccagctactcagcaggctgagacaagagaatcacttgaacccaagaggcagaggttgcagtgagccgaggtcatgccactgcaatccagcctgggcaacagagtaagactctgtctcaaagaaagagaaaaaaagaagtccaaaccaactgcagagtgactacaacaatgaatgcaatgaggaagatgtctaagtgatgactacaaccactagaggtctttcttctcttgttttctcttggtaactggctctgctgtctgctggcaaacttgcacttagagctatgctgctttgtgctgcattttctgagtttttccaagttatcacagttttaaccaatctacatcagatcttttaataactggcatttagaaccaagggttgggtcctcatcaaagtgaccctgttgtatgttgtagcctggacttatctgtgtactttataatgaatcacatatcttgattccagcaaaaactgtgactaatgttaagttcagagaaacaactcttactgtgtggctattggttgtgtgtgtcaagcagtcaccggccccttttctagagaagacccagggaaaatattgataccctgtgcaatacatgggctcactggatggtggattgtgagaaagaagagctaccatatggtgtgctgagttctaacctcctaaaagaagatgactcactaaaaccctataaaatgcctttgctggctgggcgaggtggctcatgcctgtaatcccagcactttgggaggccgaggcgggcagatcacgaggtcaggagatcgagaccatcctggctaacacggtgaaacctcgtctctactaaaaatacaaaaaaaattaggtgggcgtggtggcaggcacctgtagtcccagctactcaggaggctgaggcagaagaatggagtgaacccaggaggcagagcttgcagtgagccgagatcttgccactgcactccagcctgggcgacagagcgagactctgtttcaaaaaaaaaaaaaaaaaaaattgcctttgctgatattgctatccaggtctctgttgtaacaaagaatctaatcctcaggctttagaggaaaacacatatggcacctatgtggaacaactgatgagttgatgaaaacttaaaataaacccagagttcttaaaccttataaagcaaccattgtttctaaccttgaagttactaatttgagatactttggaggaagaaatttattaattatgaaataattatgattaataattaatataagtagggtaaggagaccttccctcctctgaagttacatatagtaacccttaaagcagaaatgaaaacaacaataaactacatacaggttgaagaaatacaaaattaaaagagaaggatccacaatttgacccaactggaaatccaaaatttacacaaaaacttataatgtaaaaatatgaaatgtctctgattggtttttatgtctctacaatatgggttctaaattaagtgcaacatctactgagatgcaccacttagcaaaccttcatggccttaatctatacagaggctcagatacagttattcctggggatcccactaaatttcaataaggcacaccctataatctaaaggagatatgaaatataaaatggtgaacaaagaagtatgcctcattttaatcatcagcgttattgccttacctaaatatcccacagtggtcatggaagctctgaccaaaaaggtagtaaaattaaataaagtctttggcacttacaataggcttgacaaattaggactctatggacttttatcttcagttaaaagttagttaatatagcccagtgtaaaataacatagggcctttaaacattaaaacccattttagaaaaagtatttagagaaggggtgattatccccactgtgtctccatttagtagcctattttagctgcttttaagcctggaaaaaattaatgccccctcgtggtgaattactgcaactttcattctgtcgtctcacatattaaaggcctcaaaatcaatactattgaaattactgactccatccaattatcagatagtaaatattctattatcactgatttgaatcatatgttctgtttagtgcctgttttaacagcctctcagcctttgccttttatgggatagaatactgtggcccacagccttacctcgctacccatgggttttcaacagtctttgaaatgtaggtggggtgagaggcagatcatgttcaaccaaatggccaagccatggcttgagatctaattatataaattataccctccaaattaaataatataatcataagcacacatgataatcatatttcccttctctaaaatgataggcttaaaaaataggggtttcctttcttataggcacacaaataacatagtaatttctgctaatttacattaaaacaaccatcagttagaaaaaaagaggctgggtgtggcggttcacacatgtaatcccagcatgttggaaggcccaggtgggtagatcacctgaggtcaggagtttgagatcagcctggccaacatggtgaaacctcatctctactaaaaatacaaaaattagctggatgtggtggtgggcgcctataatcccagccacttgggaggctgaggcaggacaatcacttgaacccaggaggcgaaggttgcagtgagccgagatggcaccactgcactgcagcctgggaagcagagggagacaccatctcaaaaaaaaaaaaaaagagttccctgttcttttcgattgctccaaatctaaaaagtaatgacaaatagtaaacgcaagttttgaataaacacacatattgtgaatatgtgtcattgttagataaattcagtatttaaaaaagagtaataattggttttaatgcaattgtactgttaaaaagtgaagtgtcatatactttaagtaaaaaatacataaaagcctttattgatcttcttaagtattcattcattactgaaaatttcatactggggaaaataaaatgccaataaaatggtttactgattgaacaagcaaacaaaagtaatctaaaaacaatctgtccctaaaatatggagaaaattggtggcaataaatgattgaattaagcataaaaagaggtaaccacaacatagactgtgttgctgaattgttaaaaaaaactcacagacataagaccaaagagtaaatggtcaaatatatgtgtgaattttaaggaaaaatatacacaaaatgaactgctattatttttaacataaaagatgagaataattcattaatacatatccaagtcaaaactacattagcatgtatttaaaagtccagatgcccaatggaaaaacatatatgtatacatttagagatagtatgtatgcatcttattttcaatccattgttttacttttttcttctgaattacaagaatacctaaattctcagattaccatttacaggttaacaatttatgcagaaatgtgaaagatgtgatattgcaaaaacaaatcacacttaataaccactatgtaattacctaagtctatcagcccaaaataaaatacatttagtgaatataataaaaattaatgaaatagttgctacttatcactgttttaacataatactataatagagctatattttttaaaaaattataatcttataatgtgagtaatatcctaaggaaagatgtttctagattaactggaataaaaatacttcaatgagaaataagaaagatagtggttgtgaataagaaataaacaaaatacattaaagtagaaaagaagttcaaggcagtggcagctacttttttaaaaagcctctcctacagcaatatgcaaaagggtttggtaactctgtgtgccatttgcacatagtagactagattgacaattacttcagatgatttagggattcatacatttgaaacatgcaaccaagagactgtgccaataataaaagataggtgagaaggcagattactggggcaaatgtaaggtttttatgcccattttgaacataccaagtgtgaaaactagtcgggaaagaataagctctgtacactaacaaatatgtcttcggggtgtgtcttctaggaggtagagctatctggaatgctaaacatgaaattaagtcaccatcgactatactggatatcctcaggatgttttacatgttggaattttccaagaaatctgaatgtcagtttgcagtccacacagctgatgcgtgctttatacagcaacttatattaagattttctacataaaattatgtatatatatagttcaccctttatagtggattgaatagtgttccccaaaatttatgttcaccaagaagcccggaatgtcaccatatctggaaacagggattttgcagatgtgattagttaaggatcaagatgatatcatattggagtagagtgggccctaaatccaataggtggtgtcattataagagcaagaaaaaacagacagacacacagaaacagacagttaggagaaacggtcttgtgaagatgacgtcagagattggagtaaaccagctataagcccaggaacctcaaggcttgctgggagtcaccagaaactaggaagaagcaatgaaggatgcttctctagagccgccagaggaagtgtggcattactgacacattgatttcaggcatccagtctctagaactgtgagagaataaaatgaagccactaagcctgtgatactttgttatagtagccttaggacatgaatacatcctcttttacagataattcctagaaagtaagaagaggatgactgaagagagatagaggtgggagaataggaaggaatgataattccaacaatatttcatgtgaatatttcaatatttcatgtgaaattaatccagatattttgttgctaattgcaaattatttcttctgaattataaagaggtcttccctctgtttttaaaatttcatctcctccaattgcctaaagtattttttttttttttttttttttaccaattgatccacctcatatcttcagctttgtcttctctactgtgtctttctctttgggctttaaaataaataccccagtatctgctggagtaagagaaaataaacaaaaaccaaacattacctgctgatttatactctactttgactgtcatcctatatatttatgtttcttctcagccaggattgttaaaatagaaatctacacatttattcccaaattttactaattcctccctccccgaaatcttatttggactcctatactctaggtataatacatattaacaaaaaattttccctctgacaatgttaacagttctcttacattctaaagcatgttatctatacgaaatgaaaagtaaaataaaattggtcttccatgtttctgacacttaaatataattcataaagtcttaggcaactaaaccataagaaaaaacaactggtgattaagcattgaaaaatgaagaaaaattaaatatattttattgatagataagtaggattttttaaatccaaaaagccaaatgtattagtcttatatgtagaataaggagagtaaaatattaataaattctatctaattgatccagaactgttatttttctgagagtaataaaacaagtagaatcctgcaggatgaatatttccaaaatctgaccccaatacctgaattcaaatgaaattcagtgatgctcatgaaaacattatgaattgacatttgtcttatttataaaaactaaaagatggcaattgactgacaaagagtatttactcaatcaaccagtaaagcgaagtaatattatgcacatatttattaggttggtgtaaaagtaattgtggtttttgccattaaaagtaatggcaaaaataacttacaggcatttaattctacaccaggcaaaaaaaaaaaaaaaaaaaaaagtaatttggtaccacatgacctgtaagaaacacaagtagttcatgtggaattatctgaaaactgtcatctgttcttacattgaaggaataaaaatgttctgttagactatttcagagacaatatggcatatgtaaaatcatgtagatgatctttcatgggtgatttaatttattttcatgtgtaatgttggttatatgtgattttctttttacataaggatgttagagccttaacccctatgtaaaatgcaatccaatgaatgcactgagtgtatttgacagacgtgctaaatcagtggttcccaacctttttggcacgagggacaggttttgtgaaagacaatcttcccatgggatggtttcaggatgatccacttcagatcatcaggcattagttaggttctgataaggagcgcacaacctagatccctcacatgtacagttcacaacagggtttgcactcctatgggaatctaacgccacagcttatctgacaggaggtggagctcaggcagtaatgatagctcacctgccactcacttcctgctgtgcggcccagttcctaacaggccaaggaccagtaccagtccatagcccaggggttaggaatccctgtgctaaacgatgtaaaagtcatgttctaagagcatctgtatatgaaacatatagaagaaggaatgatcataatttgggataaatgacagaaaaagaaaaaaatgtgagaagtgatatgtgatgaagtaatactgaaaagtaataaatatagctcaacgtggcaacagaaaaaaattatggcaaagtgagaatgagaggaagcagaagcaaaatagaaatctgatttgtagagatccagtaactactgcttgaccatctgtcatcaaagaggtaaaggaaggtaatacgaagaagtcaacagtcagtatttgtttactaccattatcctactcccagaaaattgtacgggatcattagatgattgaatagtcactgggatataaaacccaaaatatttgttttcatgctttaactaaataacacaaataattgttttattttaaccatgctatttttaagaccttagttcaatccaataatgcatgtcatttaatttaacctttttcgggggtggaagaggggataggggaagttttatatgaatgtgaacataaagaagaatgtgtatatgtgtacttgtgtatgcatgtgacttactatgttattacgccaatcactcacatacatcaaattattataaaataaccacataaggtaggtatttatcattgctactttagagatgtgtagggttcaggctgacaatgggacttgtccaatgaaaatagcaagtaagttaagttgagcctgaacccagaaatctgacttgaaagctggcattcgttaacccaatgatattaagcatgaagtatgttagacatacttcacatgtatatatatgtatataatatatatatctcatttactgctcacatctctaatctataaacaaaatgataccaaatttacaaataaagaggcagtctcaaagagattacgtaacttgtccaagggcagatagctaacatgtgacaaggctgaaattagaatacaggtgcttaaatatatatgtaacttaaaatgaagaatgatgcaacatttgtaaaataaaattagttttttactaataaatcaaagtacactttgttttgtccacaaaaaaaacaagaagattcatttaaaaaaaacagttttaaaaaccaactattattggctcaacgtagcagtttttttatattaagaggattaaattcaacttatattaaccctacaaaactatagatttcattctttaggaatctgttaatttacttttatttcaattagtactttttctttctctttttgagcatacataggctacagtaatacatctccaggatgaccagcatgtctatttgtcaggacattaaatggctaattttcctctttctcattcatttggccacatggcctcccaagaacagagtataatacgataaattaatggcttccgaagaggactcagagagccatgaagttttctggataatcattgttaggattctgtcagcaaccatgtaacatttttttgcatctggggagcataaaactctctagcaaaggaaggactcaaaaggcaaaaaataaacacagttaagtgaatgatatttttctttctaaactgtcgttttcttcactatcaaagacctaacctttgattcaaccgatcaatatgttaggggaaagaaatactttgtagagtacaaaaacagacactttgctaatgctggcatcatcactctatttcaatgttaaaataaaaggtttagtactacatttctgatgacagtactctcaaataagttgaagatcttggacttgtttcagaaggatgaaaaggaggatatataggtagtatctggttataagaaattggactggaagcatcagcttattttatatctcagcagcagaaatgttaagtcaagatgctattcagctatctctaatgataaaatccatgtccttctgctgatatactgagtcatccaggcccagacattcctcatagttataacaaatcctttactatgtaacacaatgctgtaaatctaaattttagaagtctgtgaactttcagcctctctctcacactttactgctctctaaatttcccttgcctatccatctgtgaacagaacttaatctaggttagctccagctggatctcagaaccaaaacctttaaaagccagataagtgacttctaagacgtgtgatcagaaagatgtgaaggcagcaaaggacacattgtcttcttagtgccaatgcagaacagattgtcaggttgacaagatgagctgaaatgtcctttgctgtctttttatatttattgctgccccagaaactagatgcttaaaaccaaaaactcttctttctggaaatgtgttaataaactataaaattgatatgattgctttgtaaatacttttgttactattgtaatagttcaatatttgacttaatacatattttacagagcagccttggctttatgctctggtaatttcccattttataaaattccaatatgaaggcacttgcaaggttactgatatactcatttttaaaaattaaaaacaatcctgttttcatttttgtattgttgttcacctgtgtacttgactgtaaattcagattgagtaagatgacctcaaaattgtattattacaaaatcactatctaaaaagaattgcatagtaaaatactttatggatagcacgtattttcatttaaaatttttgaatagcatgtagtgaaaaataaagcatgtctggatgaaatactacataatgagtcgaatcttacttaccaaactcctttggaactgctatagaataaacacaattatgtcccacactgtaattttttggatagtttggtgatagaacagtgccttctgaacctgttgaacgacttccacagggcgctaggaaaaaatggcaaaaatatcatttttagaaaaaagttttaaaaaattcataccatggttatcttcttcatataaaaaatatatggctaatggaatttaaggtgtataatttatttgcatcttataataagatcctctagtgttaaatatttgaaaaataaaaaagtgtacaaacaaaactttataagtattcaaatttactgttctcagaaacaaagtatgtaatataatgttataatggtgttacctagaaatataatggtggcccacctttcatttgtgatgagtgtgaaattaatcatttttataataatgataaaatacatatgcaagtgggaaattgttttacttgctggcaggctttggaattctactcagattcaacactgattatgtgtgagacatggatggctgtacaaatacattcacccactcatctaagtattctattttctcatcaatctttatctgcatatataatttactttgaaatcacaggagttgttgattgtgccttgaggcagacttattggctacctcaggcccaatgtggtatgttaaaaaaaagatgagggtgaaaacaatgtttctgataaactgtatatgggggtcctgttattcacaagacaggggatgcattaggattcatagttctagaactcaagagagacctgagataaatggagatttagtaccgaaagcatacggatggtaactggtattctttaagcgaataagatcactctgaaaagtatgtagaatgagaaaagatgggcaaagaggaggttctaggagacaccaaaggtttaaaatcagataaagattgggtagctacagagaaattattatcctgggggtcaagggagaagagtttcaatgaaaaacaagtgttcaaagaggtaaatgttgcaaagtgattaataaatgcaaaagaagtctgggttgacttggcaatctggagtgtaagagtggagtttttctgccccaggtgtaagtttgcaggaagagggatttttttttttttttttttttaacaccttgccatctggccctgctccttcacccttggagtcagaatgagtttcctgattggtgagccctggacaggaacttgtaccttttttcagattaggagccatccttcttgcagagcacactgtctggtgtgctcttctacactgtaggttttttagggcgccttctgagggtagggctgagcctgttgccgacagctagtaggaagcctgttgtcactgccactcatatttcatcagtattaaagctgatcgtttgatttcctttgaagttttgcaggaaggacagagtacaatttattattcccctcaaacaccaaaaggaggttttttggtgctattaatagagtagtttcaactggagcagctctctgcaagttatagccagcaggccaaatccagcctgtggaccaagaaaggtttttatatttttaaagagttacaaacaaaacaaaaactacagaagaatattcaacaaagatatatgtggccagcaaagcccaaaatagtatctggtcctttacagaagaagtttgccaacccccgaactagagtggggagggggcaagtgggggaggctagattatagatggatggagagtaagtggtatataaacaaatacaaaagtaacaagaattatgactataaattggaggggaatgtataaagtagtttggagatgcaaagttgaatgagtgttctttgtcgatttaatagggaggaaggaatcattacacaaggaaaatcagcattgacctagaaataagatcaaaaacaaaagtggagtgattcccattagatatcagtagtggcttacctctgtgacttgagaaaaggagattagaaatagataggtgtaggttttatactgggaatttattgaagttaatgcctgattttccttttaaagagcactgcatgcagggatgaattaggtacctccagaagagttatgacagtttgaaaaagtaaaaatttgtaattaattattgatcaaagttttaaaatagagcaatacagtatagttaaaacacacacaacacaaacagtacgttgtattgcgttgagtgatgaatattctgccttttttctttaatgttctataaaaaggtaatagttagaattaaacacactaaaattagaattatctagaaaaaacaacaaattgacagtgattataataaccaaagatgcacccctctcatcactcattattgtctgagattagagcagtcaggtgttattcttatttcagcactgataacttcattcaactgataatgctactgatgagagaatcattcaagaatgggcagtatgtcttatgttaattttctttctgattttaaggtgctccagaattaaaattataatactttgaatgaatgtgacaaaaactattaaactcttatttttatatttgggaagtatgatagaaatggaaacttctaactcaagttcagttctgtaacttagtcatgaacattgtgccatcctacattaacacgtgtctgacagccagaatttgttttacatattttattttgtataactgacatttaggacagcttttattaaaaatcatatttagaaatatgaaggctcttttaaactacaaatatactatgaggttgtaatttaatcacatgtccttatggtaatattatgttagattctgttatttgtacttgtaaacataattttatgtttattctgatgagtgcctacagcgtggcctaatttatagtcaataacacagaatattatagtgagtgataattatgcagtgtgttattataaataagggaaaattaactatgctctgagatacacatctattgtaatttgttttaccttaggttggtgcaaaagtaattgcggttttgggcattactgttaatggcaaaaactgcaattacttttgcacgaacctaatatttatataaatggaataataagtcaggccaacttcacagattctcctaatattggtctccagaagctttttatattcttactttctgttttaatgtcatcttattggctaatggagaaaagggcagcttttatctttctggctcttaacaactggttgaagataaaagcaagtcagacctttgggttctattcttatttttgctatttgacatatgccacatatacctgtggaccttttgtcaaattggctgttgtttctcttaaaagcctatattctttgtaatgcattaaacataagaacccactgctcctgattataacttatgtagttaataaatccatatttgcattttttaatttatttttatttttattttttgagaccaagttttgcttttgttgcccaggctggagtgcaatgatatcatcttggcttgctgcaacctccacctcccaggttcaagagattctcctacctcagcctccagagtagctggaattacagccatgcactaccacgccaagctaatttttgtattattagtagggatggggttttaccatgtcagccaggctggtcttgaactcctgacctcaggttacccatctgccttggcctcttagagtgctgggattataggcgggagccaccacgcccggcctaaatctatatttttaatagcatgtttgtagaacatttgaatttaagaagacatggttctatcattaagtaagtgtgggaaatacaaatgaaggacttgagactttagtaagttttagggaatatcatgctatttctcacaaacttatttgaccatgaaaaatttttttacatgtaatatctcacaggacctgcctccttaagaacatactttgcaaaaggccaaagtgatgattctaaaatgtgggggttttttggtaataattttaatgtttatgtaattgataataattaattgtaattttgctgtaccaaagaactgtgttttatgtatgcctatagaacccaataatttagagactgaaaatgtcaaacttagcctacttataaattgccattattctagatttgctctccctgactcttggcgtccaacaaagaatcaatttgttgctcataaccttatgtgatttatcagcttctctatcacctctgcctctataactgtcacagtccagactcccatcaatttctgcatgtgctctttgactctcagctccactcatcaccacaagttcataccactggtagcaatttttctaaaacataagacttatcatatttctcttctcttctcttctcaggacagtgtctgtacatagtaggctctccataaatatctgttggattattaaatgaaccatatctgcaagaccaggctactataaaataatgttctgtagtcagcatataacataaacatttcatttggttgaaattatctcagaaaaaattacttaaatttagtacagaatccagatacaccctctttcaataaatccatataagcctattttttttctttctgcgatggaaattgcttgttctttgcttgattgctgtgctttacatttgggggcaatactatgtgaaagatatgtatctttaaacattagaaatatatccaatggtaagatgcttataatatgactgctatatggattctgggttctattgagggaatagcaaacccatgtctaataccaagcccatagtagcaaatccatgctgatatagtttgaatgttggtgccatgcccccctcaaatctcatattgaaatgtaatctccagtgttggtggtggggtctggtgggaagtctttgggtcatggggacagatccctcatgaatgtcttggtgctgtcctagcaatagtgagtgtgttctcctgagatctggtcatttaaaggtatatggcacctccccattctctctctcattctctatcttgccatgtaacatacctgctcccgctttgccttctgcaaggattgcaagctttctgaggccctcaccagaagcagatggtgaagccatgcttcttgtacatcctgaaaatccacgagccaattaaatttattttctttataaataacctagtctcgaatattcctttatagtaatacaaacagactaacaaattgaaagcaaaatttgactagaaaattcctatcaagctgatatggtttggctgtgtccccagccaaatctcatcttaaattcccatgtggtgtaaaaagaacctggtgggaggtcactgaatcatggggtcaaggctttcccgtgctgttcttgtgatagggaataagtctcacaggatctgatgattttaaaaagaggcgttcccctgcactagctctctctctctctttgcctgcagccctgcagccgtccacgtaaaatgtgacttgctcctccttaccttccaccatgatcgtgaggcctacccagccatgtggaactataagtccaataaacctctttcctttgtaaattgcccagtcttgggtatgtctttatcagcagtgtgaaaacgggctaatacacaaggagtggggtgttactataaggatacctggaaatgtagaaatggctttagaaatgggtaatgggcaaaggttcaaagagttttgaggcctcagaagatagaaagataaggaaaagtttggagtttcttagaaactacataaatggttgtgacaaaaatgctggtagaaatatggacagtgaagtctaagttgacaaggtctccgatggaaatgaggaagtcattgggaattggagcaaaggtcacctgtattattctctagcaaagaatttggctgcattgtgttcatgtcctagtacatgtcctagagatctgtgcaaacttaaagttaagagtgatgtctttgggtatctggcagaagaaatttctaagcagcaaaccgttcaagaggtggcctggctacttctaacaacctactgagagcggcaggaggcagccaaatgcccaagaagataggggtgggtccgtggtgaaaccccaccttcaagcaaaaaacagcttgaaggctgaaagaccagactgctggtcctggatgaaacccgcgacccagagtgagaacttctgttcctgttcgcctgccctttcctaattgattctttctaaataatgtcttttacccaatcgaatgctgccttttccaatagtacctacagcctgcccctcccctatgctgaggccataaaaagccccagacccagctatgcacagaggagagaactgcccgactgtgagattggggtaccacctcctgcatcccctctccactgagagctgttctgttgctcaataaaattcgtcttcaccctcctcacccttcaatgtccagaatatcctccttcttgggttcagtacaagagctagggaactaccaactgcgagtacaaactataacaaaggcaagctgggacacatcagcgtggcccagtgaggcccaggtggggtgtcgctggccagagattcacggctttcaaagtgttggagaagaaaatatcgtacatcactatagttagctacaggagcaaagacatgacttaaagttggagcttatatttagaagggaagtagagtgtaaacgtttgaaaaattcacagccaagccatgtggcaggaaagaaaaaatgcattttcaggagtgggatacaagcaggcttgtggagcaatcacttgctagagaaattagaatgagtaaaagggagccaagtgctaatatccaagacaatggggaaaaggttttgaaggtatttcagagatctttcaggcagcctctatcatcacaggcccagaggcttaggaaaaaataatagtttcctgtaccaggcccatggccctgctgcctgccttgggaggctgctccctgcatcccagccactctggcttcagccttggctcaaaggggtccaggtacagctcaggccacagctctgtaaagtgcaagccataatccttggcagttttcacatggtgttaggtctgcagatgctcataatgcaagtgtgaaggacgcttgtcaacttctgcctaaatgtcagagaatgtatagaaaatcccgggtgcccaggcagaagcctgctatagggttggagccccacagagaaactctactagtgcaatgccaaggggaaatgtgggattgtagaacccacacaaagtccccaccaaggcactaccttatggagttgtgggaagtaggccaccaccctccagaccctataatggcagaggcactagcagcttgcacctctgcctggaaaagctgcaagcactcaactcaaacctttgagagcagccacatgagctgcaccctgcaaagccatagaggcggggctgcccaaggccttgggagtccacccctcacacaagaatgtgggacatggagtgaaagaagattattttggaactttaagatttaatgattgctctgttgggtttcagacttgtgtggagaatattgaccctttctttgggccaatttatcacttttggaatgggaatgtttacccaatgcctgcactactattgtatcttgggagtaaataacttgttttgattttataggctgatgggtggaagtgcatgagtctcagatggaacttatgactttggatttcatgctggaatgatttaagacttttgagaactattagcaggggatgattgtatttttcaatgtgagaaggatataagatatgaggggccaggggcagaatgatagtgtttggatgtttgtccacttcaaatctcatgttggaatgtaatcctcaatattggaggtggggccaggtaggaggtgtttgggtcatgggggaaaatccctcatgaatggcttggtgctatccttgcgatagtgagtgagttctcccaagatatggttgtttaaccatgtagcaccttccccctctctctcttgcttcctctcttgccatgtgatgtgtctaatcccccttcaccttccaccatgattggaagccttctgagaccctcactagaagcatggcagaccacatttcctgtacagcctgcagaatgtgagccaattaaacctcttttcttcctaaattacccagtttcaggtactcctttatagtaatgcaaacagacaaatacacatgctaatatcttatcagtctaaggaatatgcttatttagtgagtgaagttttattcacacagtttcttagttttcttgttctttattcttctatttgtttaatttaaaaaaattatcttttggctgaatttgtttcatttgatttgtataagtaaaatgtgtccatgatccaactatattacatatattcttgttttacccatgaattatgtatgcaatgatacagtagacagatgtgatatttctggagaaatcagaccatcacaccaccaggttttaaggtatccaatcatccactgaaaataccactttgagcaggggtatgtatgtgggatgaaggagcaagacagaagaatagaagaagaaaagaagaaggaggaggaggaggagcagaagaagaaaagaagaaacttatcactgagtgaattagaagaaatttcaaaacatttatgtgggagaaatgctacttgaatgttcaggtatcttagagacattataatacaggcaacatagccttaagctacttgcaatttcacatctgtctcttcacttgtgtaatgcataatttattatcaaatatactctgtaatgaaaattattatataatgtataaattattcacagaaagcaagttaggtacttttaaaagtgatgacttcttgcaggtcacaaaagagcaatgtgatatattaaatcaataatttactagatgtggcctgtgactctttcagtttgaaagaactgctgtaccttacaaaactgctagtatatttctagtaaattacttatgcattgatatagcctgattgaatgtcacaaatcataaatcctagtatagaatatgtttgaaagctatatctctcatggagcattttttaagagaaggctttcctaacccttaaagtctgtgatatgaatttgaattcagacagctactattaccagtattgactttaaaattaaaattactactgtttgtttcttttgttcaaaaatttgatcttagtaaaaatacctaactatccagccattcccttcatgtctttttatgtctcccctataacaacacataattcattttgtttaactgccttaaatgataagcctccaataatgctccattacatgtgaattgactttgtttaaatttcacacttctttttaatactaaaaaaaaaaaattccatatcagtgtggtaatcagtggcttataaaccattttaatgactcaataagtcatgttaggatgtaagcttctacacctgtcatctcactgattgcctggattcattcattagatttccctggctaggaagccatcaccttcatccctcagtgctctgtgagctgttttctccatcagagagtgtgatcctacagaaagagtcattctatgacaaagtcctatgaacagctatatccttgaatagatcttccatgttaccacatacaaattctactactagtaatagttttggagggcatagacagttaatgtatgatactatgtgactcattttgtaccccaattaaaaaattgggatataatttacatacataaaattcactgttttaaagtgtacaattgaatgctttttagcatattcatgagttttaaaactaacaccattttctaattttagaacatttccttcactcccaaaataatttcagtacccattagtagtcgcacgctgttgtcactacccccaagttcctggaaacagctaactttttaggaaactgtatgggaagataatttcttaaaagatctgaattattggcagtttttgaaactaaaatagctttttatcacatagttgatgtcttactgctttttaatgatgaaaaccttttactatttaaagaaattacttaaagcaactaatatattagtttaaaatgactttaaagggaaaagcgctctttaataatttgttaacttctaccaaatcgcctcaaaaatgttgctttcttgggaatgttttctctaatttccagactttttcagaaaccaccattacttttaggacagtaaatgcagtttgtaattctgtatttattttgtatggctatttgattaatgtccatatctatctctagtctataagatctgtcaaatcaaagtttccatgtcttttctgcatactatttgtatctctggagcctagcatagtacctgtttttataataggtttccaataaatatatgctgtattaggaaaaatgacaaaatgtaaattattaatatcttgctattgactaaatacatggagtataaaactcatagatttaaaaaatccttccatttaggatagcatggtagagtacaacataaaactcagcacattggaatcaggtttaggtttaggctgggcgcggtggctcacgcacataatcctagagctctgggaggcagagtccagtggatcacttgaggtcaggagttcgagaccagactggccaacatggcagaattccatctctactaaaaatacaaaaaaattagtcaggcatggtggcaggtgcctataatcctagctactcaggaggcttaggcaagagaaccaggaggcagagattccagtgagccgagcttgcgccactgcactccaacctaggcaacagagtgagactccacctcgaaaaaaaaagaaaaataagagaaaggtttaggtttaaattccagcttcagtctttactgactgagtagccttaggacagagggaaatacaaacttgaactggaacaggaagtgtctgttagatctggtatgtagtgtgggtttaggaaaatgaattagggaactgccctgatctactccagaatcttctgctggcaatataatgaggcttttgtaaggccttaggaaaatgaactaacctcatcaatctcaggaggatacaaagcttagaggtaatagcagaagaaactttcttagtagtttgccaaactgctcccttgacagaggtaggaatgcctttaagtgatcctactttgagcactgtcactctctaggagaagttcatggcttgtattttcttctcttaatttttctctaaggatcaagagcagagtactccatcccaaagagaggaagccatgtcaattcagctgtttctcaatggttgaggtcactgcctggctgttgaaggtcaaggtggatgtggtcctctatttttctttaactctttatcttctagaagcctggggtgaaataagactactagtagcattggctgttattccacctcagacttctaaagaagagaatgtgactcatcttctcctttccgttatattcaggagctcctttccttcttccagaaatttagatgaagaagaaaaatgtctatattttctctagactttaaccgaatttttttctaactgaattttagcatttctcttaattacaaatgtaggcaacaaagcacatgaatagtaaaagttaactgggactttgtcaccagtagaaattatagattttttatactgcattataatcgtttcagatacctcaaaatggtgtataaggtaatgttactattaccttaataccatttgaatcttgccatgactactaacagttactgttatatactttattttcttcacttgtaagaagataattactaagttgattcaacacacccacacacacacacacacacacatatatatatatggtccagtaaaactgacaatacaccaggaaggtacatttgaggtctcacttaaatgtagactacatggtagttgagaatggggcacatcttcgtacaatgagaatccatatgactgtccatctggagatatggtttaaatatgaaccccaagtcaatggtaacaataaaatgcaggttgagcatccctaattcaaaacgcaaaatccaaaatgctccaaaatctgaaatttttgagcaccaacatgatattcaaagttcatgttcaaagaaaatgctcattggagcattttggatttgggattttcagattaggggtgttcaactggtaagtataaatgcaaatattccaatatccgaaaaaaatctgaaatcggaaaaactccagtccaagcattgtggattagggattctcaacctgtatactctgaattataggcattgatttgcaaattacttcttacattggctactccacatagtatgctccagaatccatagcagcagggatttgtttataacaatgttaatgattctctagactagcatccaggaggccaactggagacagagtgtatgtaagactgtcagaaaaatagcaagtgctcactaacattagcatctcttcttgtttccatttaaataataattttcccctatcgtatgaaaacaaaatatgctttggttttatcccaatgcaatgcaaaatacattaaaatacattacgcttctctattgaaaacctttccaacacataatctgtgtattttatccgtgaacaaaattcctgtgtgctgctgatgaaaagcagatatttgatgatacacagacataatttaccactaagcatttgttttatgaatcttttgtctgcatgctttaattatattacatatttaaatgatttcaaatgccaatggctcagtatattagattagataatctctatatgcattgataatggaatgagactctagacttatttcacacccccaaaaaattttgtaaacctcaaggacatttgacataaggatcttagcacaagacaagtcatgccatttaaacaaaatatctgaaataaaagtgtagttatttatttctgaattatatatacccaaacaatatgatttcattaaaagtaaggcatatgaataattggtaaattagagatgactttaaagttggaaagctgtaattataaaattgacttcttattttttggtttgtttcaaagctttctctttaattaacagggtaagagggctcttcttttaaaagcttgtatcattccacatatacttggaagttgaacagagaatggtgccagaagaccgctggatgtctaatcttaacatatttgtgtttaggcacttttgacagaccttagaggtcatcagtgattgagtgacttaaatctttttttttttttttgcataatccagatcttatatcagcatatgtgaaacaaaggtattgaaaagaacagagctagcgctggctaagtatatctatataggcctttgtatactgtccagagttgtatttcagatgaaatacaaaaatgcatttaagatgaaaaattctatcaggtttttttttttttggtaggaatttacattctcttaattctcatacttagcctggaggaagatttcaatctcaccacttattcttagtgccatacatcatttgtaaaacattaaaccaattaaaatattccaggcactctttggttctggagatataaaaaggtcaatacaaagtcctttgcagaattaaccagtctacctatagggcagtgattaagatcatggcttcataagaagactgctaaccatgtgtgactttgaactagtggatgaacctctctctgtgtcttggtttcctcatctataaaatgagaatattaatagtctctacttcatggcattatggtgaaacacaaaataatatgtaatattattattaccagcttgatacaggtaagctgtcatctgtcaacaatcctcctccttatgctcttgttctactgaattacttgaaattccaccagcatttcctatttgctctttacttctacatgtttatatatgctgaaccctagttgtgaaacacataatctctttatttcctgtggctcacctagtttcttcttacttatacttttaaaattctgtttacatatcactttcataaggaagccaccctgatctctcttcacagcaagatcagatgtatatccatgctgtgctcacagtactgtttttatttctagcaatggactttacctatctgtatctcatcagattataaactctctaagggcaaggacaaggttgaattcatgttgttatccccaattttaaatgcaggaccaggcataatggtacttttaacacctgactaaaaggaatcaacaaatgatataatcttttctttggaataattggtgagctagtagttcattaacagtctaaatatgtttattcttagggtcatatattataactgcctattaattggatgctcactgtacgttgtaacaatggaaaagattaagaatatttcatttgtacggtggtcagtactctctagtttaatgatttacatttgaaagttatgaggtcctgaaagtactttgggctttacatacatcaaataaatctttattcaggatatagagttgcaattttagaatagatattgattctgtcctgggagctctgaggagcacggggagggtaaataggaattttcttctagtaagaagacaagagattagatgcctgaagaaaacaagagagctagacagccagagagctggggtaaaaataatccaggctgaaagaacagcatgtgcaaaagatgtggggcagaagtctgatcagtgctttgaggaaatatcaaggagcctggtgtcactcaaagaatgtagcagagggaggaaacaataaagaggtcagggtgtgtatgagcagatgaagtagaactttggattataagatctttggcatttattctgatttgggaagccattggtggattttgagtaaatatgatataatctgaattatgctccaaagatcactctattgtgtttggaagatactatatggagaacaaaggaaggagaaaaactagttaggaaagaggaaaagaggtaagagacggcagatgctctggataaggttagacctgcgccattagataaaataagtcaaggcaacatgattaggtcagataaatcaagcaaataatattaaggggaaaatctggaatctgtcactatttttgttttattacctttacctaatattgagtgagattatggataagaatgatatatgacttctacttttattcagtatgactgtatataagtaaattactacagagttttaaaagatactttttaaagtaagaaaaataaacagggaagaaattattttctaaacaaatttttttaatcacaaaaggaattgtaggcacagatatgctgttctgctattatttaatatatatgacaatatcatcagctaaactgcaaagtttctcatcactgaacaggacttaccacaggatgcaatcattttggatttacttctgacaaatataatctcccagtgtccaacttaagctcttaaaaacattttcttcagatttaacatatacacttaatcctaaatcatggtaaaaatctatcttctaaaatagacaaactttataaattgatttggttcggtttgagtttacagatatttaacaagagcctatttatataaattaaggtgttacacgctaaacacgatattatagcctatgactgcatggagcttatgctcttctagggtgcgactaaggcaacattataagaaaaagcgaaatgtagttgtgttctaagagtctgcagaatatgatcatgttggtatttgcttctacactaaaaaaataaagaataaacaaagaaaaagttttgcttattttcactcctaggaatcacagttaacttcctacgtatgcactcaaaagcaatgcctaccagtcagtcacagtttcatcagagattttagtcaggatacctactgtgggatgggacctcggctgaaaagcagcaaagggccagtcacctaattctcaaacattgataaaattagaaatagaggcgtacacatattaatgtatagcaaaagcaatcactagaataaccccaaataatataacactgaaacattgaagagagggattgtgtctgttacatcatcttttgtatcagggaataataagatattattatctagaattggtaaataaagaaacagatcttcctatgttatatggagttttgggaggggccatcatagcaatcagaactagaaatcagaatcttcagcttctgaccaataagaggatagagagggataaggcagatgaccattgctttaaatatgagctacttttttattattttcttagttatcatatgcatatctcagataaaaataaaaaaattatcttaaaaaaataaaaaataatttgtttttacgaacaatgaaccctctggcttattacacatactttaaatactaaatttgacttttaagtattaagttaggccaggtgtggtggctcatgcctgtaatcccagcattgtgggaggccaaggcgggaggatcacttgaggccagtagttcgagaccagcctgggtaacatagtgagacactgtctctgcaaaaaaaataaaaataaaaaattagctgggtgtagtggcacatgcctgtagtcccagatacctgagaggctgaggtgggagaactgcttgaacctgggaagtacagactgcagtaagccacaattgcaccactatactccagcatgggtgacagagtgagaccctgtctgaaaaaataaaaaagatattaagttattacatctgaaagtcagccagtcctgtgtataagtgctgaagaaaaataatttgatatgtgacattgattaagaaacaaaaatatatcaaattctccttattgtgtgacagtgacagccacagaccaatgtttaaaataagttatttaatatgattttctcaacaaccttgcaaattacacaatatcttatgattagatatactaaataaattgaaaagtcacgcagaaactcagacttttttaaaaaattcattgtttagtattaaagatatctagctctaaaacaggattttttgttttactatactagaaattattggttgcaatcataaacttatcttgaacttcttttctattagcttaaagaattcactgaataaattttattcgatttccataatatcatgtccattttgattaaaagtctaatgatacttaactgatggtaacaattatctcttagggaaatttttaaatactcaacacctgtttttcaggagtgaatgaatgtgtgtattcacatcataatatagataaattatttttaattaatattaaaatgacagaagtatactagttaaccaaaacataacacctgatgcaagatgtgatgcatgtttatcagcactttgcttctcttggaactctgcgttggaaatcacaactcccatatatttatattccaacttttgtcagaaactttactagattctctatatgtgttgtgtttactaattgaatcttcacaataacttactgaattaataactattaatctagttttagagatttaaaagtcaagactcagcttgccttaggtcacaggtgtcagaagacatctatttgaattcaggtctgctgtatgctctaaattgtctgtagatatgaactattcaaccaacattaagtatacttaattgggccataagtgatcctataaaatggttttggctcaaaaggatttttaaaaaaatattatggcacatttcatgttgaaactgacatttctatgacctattggaaaggagtatgattatattaggtgggcatattcttagtgaaagcatactttagtctagtgttcctgactttttcacctgtcattgaaagccatctacttaatcatttatccctgcgattaacatctatcttaataatctatagttttttgtgtcctttgatatttctgcatcatgacttttagttattttgaatctggctcctggaaatttttcagaaattttctatagtttccaaatgatcattgacagtaaaatttgaaaagttattttctatgtttaatatttttttctagctaaattagatttttctaattctaaattacataatactaatttatatggttctaaattctaatatgatacagtgaccctttctcctaaatttcctataaacttccatgccatcaatcactttttctctctttggaacaattaatcccaaagtagttattactctatttattccttttgccttctgatagatgaaccataaatgcaagtcaaaaattaaccagctgttctggtaatgatggaccaatcagaagatgtctaccatttctttgtttcttataacaatattttgaagtaaaaaatgttaatcatctctatttcatagatgagacaaaataaatccagagaagggtaagtcagaaattgggcacatgtaattcttataagtgaatacattctacaactaggaaaaattactatgtgtattagatatcaaaaattgtcatttattttcactgaaattaatagtaaaaaatgcaatttatatcatagaccaattcaaacacttgaatgcatgcaggtaaatatatacacagaggtatatttattgtattttatttatttctttatatataacagagaaaagttccaaaagtaatatgtactctcggccgggtgcagtggctcactcctgtaatcccagcactttagaaagtggaggtggatggatttcttgaggccaggagtttgagaccagcctgagcaacattgcaaaaactctactaaaaatacaaaaattatctgggtgtggtggtgtgcacctgtaatcccagtcattagggagtctgaggcaggagaatcacttgattgcgggaggtggagttgcagtgagcccggatcacgccactgcactccagcctgagcagcagagccagactccacctcaaaaacaaagaaaaaaagtactctctctatgttccttaaagtatacttttttcctattattttattaacttttaatttaattttatttgattaacttctatgtctattataaaaatgctggtcacaacccaatgaattgattttatgattcactgttggtgacctatagctggggaaatctgtcctagatgatatcacttctgtgttaatttttgtacaatgcactaggatcattcaatggattagggagtctctagtaaccctaagcaatgatatcactgtttctctgtttttcctttcttatatagagagagttatatacaagtatatgatttttaaatatgcagtattatatctccttctagacaacctaattcctagaagaaatacatattcttctttatccttattacagataaagatttatcaccagttcttaataatatttaaattattaaatttatctacttgtgttgaaatgttagtttcagtgtgtttgttcctcatgtactcagccaatattttctgagcacctaacgttttcaggtgcaagtcctgaaggcacacaaattagcataacaggcagtaacccagttctcagaaagtttgcctattatagtacacatattgctttagagacacctgggaatataagcacttttccaaaaccaggtctttattgaattcaactttaaaatgtttgataaaatctctgcattgctagtacgacacttgtagattgtatgtggaatagttgatgttctgaaacacagaaatgtctttaaatattttttgattttttctaatcatgaaaattcagccaaaaaatatgttccttaccatgacaacttggcaaggctctattccatccaggtcttccatcatctcccatgatacaggtgagtgttgaataaccttgaagaacataaccagcatcacagtaataggtgactgttgaccctaatttataatccattccaagtctggtgccattcattatattgcctggatcaaagcaggactctcgcagttttgctgtaaaacagtgttagtataacattaattgctttaaaatacagttggcactccgtaatacatgggttctgcatctgtggattcagccaactgcagattgaaaatatttggaaaaaactgtatctgtactgaatatatacagactttttttgtcattactccctaaataacatagtataacaaccgtttacctagcatttacatcatatcctgtattattagtaatctagaatgatttaatgtatgtgggaggatgtatataagttatatattcacatctgtgaatgttagtatcagaaggtttggaaccagttacccagggataccaagggacagctgactgttttttatggacctttaagacatgttcatttctttttctaacccagaaggaaaagcagcagcatcatttctgtctttttgggggggctcaaagtacaaaggagcccttgtgcatatctgacaaattgctaatgcatatttattagtaagataataaataaattctaaagatcttcatagatcttctcattaaatttagtatccaatgcatatagtcaaacatagggttttagaatttattataaatattatgtgctaataatccatgtgtaggtactataaatgaattactttggaaaaaaagaaggagcccttataaaacgtctttatttaaaagatctccccacaagtaatgccatgttactgaacctagaagtggtttttcttcctatgttgagctcagttcatttcaccacctacagcaaaataaaaggccctatttgtctgccctgcaaccatttttcttaccctattttctccagtcattctccacatttttatcataggtctcccattgtaaaatagcaaaatccaaaccacagtattttttgacagattttctatccctatgcaaaacactttcaaaactagaggtaacagacagattaaaaaataaaatcctttcagagcagaggaattgttttcattgtacccagatattgaacaaagagactgacagaataatttgaaaatatgtagagaaatggaaagattagctcattcattttatggcaaaggtactagaacactttgttgttaacagatctggatgaggccttgagattatttccattttgtaattattgattacttaagaaataataaagaaatgtacaacgtaaaggccattacaataaatcaggataacaaatgtagtgattttctacatcagaatttgttttgtgctaataagaaatcagacagtgggtatatctctgaatatgagtcatggaatctttgaaatgtaagtcaacgatatcttggtgtttggctactacaaacatatttttatatcaaaatataattaactataccagtaagaatatgtttctttcattcataaaagtttgcaaggagtttaatgtactttagcatttttaagaaataatgagaaatctgtgctttaagaagaacactatatataatttctcccaattcaactaaagaggaagtggtagaaccacacatttaaataattttaatagaataacagataaatgaggaaggttgcctcccttctttccttccttccttcctctctctctcactttctttctttcttttactctctcctttctttcttcctttcttttgttctttcgttctttctttctacaaatacttaaaggctcacgaccctactattttctttttcttttcttttcttttctttctttctctctttctttctttgttttcttttgtttctttctctcctttctctttcttttcttttgtttctttctctcctttctttctttctttctttctttctttctttctttctttctttctttctttctttctttctttctttctttctttcttttctttctttctctctacaagtacttaaaggctcactaccctgctaactctggaaatgtagcagtggacaatcagaaaatgttctggcactcacggaaattacagtctcttaaagaaagcaattatattaaataaagacttgcgattttggcatgctgtataaagagaagcattcaggaacctcactaaaaagtggtatctaaagtgagcattgagagaataaggaacagattaggtaaaaaggcgatgggaaacctgttggggaggaggtgtgctgacatgtgcaaatagataaatgtgattcctgggtttcaaaccagagctaaatgacttgatcttctcccaagcacacatatacacacacacatggatacacttacacaaaatttgcactccatatattatactcaagctgctctgtaaaaattttgtcccaaaccatggaatatatttctttcacataaaatattcacacaactctttttatgaaagaaccagcagggtaactacttaatttggtcactaagaatgggcatttagtgatgcaagggttgatttgtttatttataaaaaataaaactttacattgtaccttcccttaaacaagcaggaaaacgcaatgtaatttttagacagaacagaaacctggcatttatagctgggcttcgtaaaattaaactaagtccctggagggtagaggaaggatttaaatttctgtttaaaaggattaatctcgttgacaagtctattctcctaatattcatcttttgaaaagtttgctttctccttctttgaagttttcctcaatgtttcaatataatgtcagtgaaactgtaatgcaagcatccggttttttgaggaaagggacacatgtttgacaaatttaaaaataatgcctctgcaacaattttacattgctagcctcaatttgagagaatgcccttatgttattattatgtttacatactgctttaaatccttggtgaatagttttctatgaataatactgtctttatttatatccacatatgccatagcaattacacctggaaattttgaaaacacctggagaatacttaaaaaaatgtctaggcagtagctggaaagtgattttagtttctgaataaaaattatgaggcagacaagttatcagcattatttttatgcataattaattttttctgcttaatagtgatttgcctactgaacagatactaggtaaaagagtattttgcctccttacagtctccaaataagatatatcagaagatatattttagatcgctgcatctaaaatattttagttttcttttaaaattatttctgctgaatataaatagatgtatatgtatatatatatatttatactatatatgttttattagagctagaagtgaacatacacaataaagcttacgtcttaattttttttgtagcccaggctggagtgtagtggtgcgatctcggctcactgcaagctccgcctctccggttcacaccgttctcctgcctcagcctcccgagtagctgggactacaggagcccgccaccacgcccggccaattttttgtatttttagtagagacggggtgtcaccaggttagccaggatggtcttgatctcctgacctcatgatccacccgcctcggcctcccaaagtgctggaaatataggcgtgagctaccacgtccagccacgtcttaatttttaattaaaggcaataacaaatactggtgagaatgaggagaaaagacaaacctcatatacagttgagggggatgtaaattagtacagccactatggagaacagtatcaacagtgtagaggttcctcaaaaaactaaatatagaactaccatatgatccagcaatcccactgctagtatatatccaaaagaaagaaatcagtatatcgaagagatatctgcactctcacatttattgtagtactattcagaatagtcaagatttggaagcaacctaaagtgtccacaacagacaaatgcataaaaaaaagtggcacatatatacaatgaagtactattcagccataaaaaagaatgaaatatttgcaacaacatggatggaactggaggacctaagtaaaataagtcaggcacagaaagacaaattttgcattttcttacttatttgtgggagctaaaaattaaaagcaattgaactcatggagttagagggtagaaggatggttaccagaggctgggaagggtagtagaggtgttggggggaaagtggggatagttaattggtacaaaaaaataattaaaaagaatgaataagatccagtatttgatagcacaacagggcaactatagtcaataataatttaattgtacatttaaaaataactaaaagagtatagtttgattgtttgtaacacaaaggataaatgcttgatattatggaaaccccgtttaccctcgtgtcagttattacacattgtatacctgtatcaaaatatctcacatactccctaaatgtatatacctactatgtacccacaaaaattaaaaataacaaaggaaaacttttcgtgtttttacttatttgtgggagataaaaattgaaacaattgaacttgtagagatagagagtagaatgatgcttaccagaggctgggaagagtaaggggtgggaagtggggacagttaatggtatgaaaacaaagttagatagaatgaatagggatctagtctttgatagcataacagggtgactacagttaacaataatttactgtatctttaaaagtaactaaaagcgtataattggaatgtttgtaacataaataaatgataaatgcttgatgtgatggataccccatttaccctgataatgattatgacacattgtgcacctgtatcaaaatatctcatgtactccataaatatatatatatatatatatatacctactatgaacctgtaaaaattaaaaattttaaaaaggaaaaagaccactaataactttactttttaagtgctatagaaaccaacatgcttaagtcaacatttgtgatatatgttacaaaagacaaagaaaaatatttttactatctagggcctcaatttatatgtccattcatttgggtgtgcatatttttatattgaaaataatgagatgtttgttttacaatgatcattataaacatcattacaagcattgttagccttaagaaactggacaattacagaggaaacatttaccaaaataagaataggaaataaggaagctgataagacagaccctgaagaccctgaagtgggcaatgaaattttcccataaacagcgggggtttgaggaccaggtagaaaattaatgagattggatctcgagaacattattgtaaagaaatatcatctggagtataaaaataagacctggtggaattgtgtctaaatgtgtactggtataataggtgaagacagtgggtggggaagaaggatgtagttaatgggataattatgtatttctctctacctatacttatatttttctttgcctttattctcaatgtaataataacttatgtagtcttgtgtaaatcattttaacaattcgattttcaattttttgctttgtaaaatggggatagcaatacttacaatgctgttctgtaatgtttttattgcatttatacatgcattatctctgtccttcccatacctactcatgaggtctaatcattgaatctagagtagagtaagtgcatagtaaacaacatctctttttaaaaaattacatttgtagttctttatctatgacagcatgaatcttaagtttttggaaatgatgaaaacattgaaattgattaagctggggaaatagggagggacatatattcagctgagataatggcaaataggttttatctcaattgcttaactactaggctttagtaagggctacatggtgtgttacctagagaaagcattataaggtcctgaccagtttccatgagaaataaagccataatcagttagtaccatctaccattggattgctagtgagatactcttgctgcaacttttatcgtagtgatatttggaaatgttttattaatactaatttacagtagaacctcactttatctctacagatttgttaaaaggtttctttctttctttcttctttctttcttttctttcttttttaaacaggtcatatgtataagcctttcagcttgcaggtataagtagctatttctaagccaagttctcatgtataaaatttagaacaggaatcagctccaaggtttctcacatttaaagaatgttattattctaatatttgaattatgacttgattttaaaacagaaaacacctctttacgatgctcaaaagcaatcaagtagcaaactgaataattactgtgtgtaggcactattcttggcacttagtgtatagtggtgaatgaacagataaaggctttcctcttaagaaacttgtattttagaatatgtgtagggggctactggagtgagggggatgcacatggtaagtaaacttaaaaataaataagcaaggaagtatcagatattgacattattaggtagcaagtggaagattttgaaattaggaatacagaaaaagcaaaacaaatatgaagcaaaaaataaaagaaaaaggctaataagtataaatatactaaatccaaggtatcaaaaaaccagaaaaaaatgcaacttatatgcacctgaaagcaggctttcataatatataaacaaagtggtaaagattttaagaaaaatggcaaattaagaatagtagattttacccaactatttcaataattgctagaccgagcaggtcaaaaaatggtgagaagatgaatatttaacaatataattagggagtttattggatgtatataaaaacttgcactcattagatgatacaaatttctctcctagtacacaaggaacataaatattaacgatataatagaccacaaaacaaatcctatgacaagccaaagaaccagaatcatacatatctgatcatgcaagtaaattagaaatttataatataataagttatagatttaaattttattttgatagtttgaaatacttttaagtagcacttcagcaaagaaaaatcataatgctatacttagaaccaatttagaataaaattatgataaatctgtacatatcaaaatgtttgcatagcagcttaagaggttcttaaatgaaaatgtgtagatccaagagaaaaaatgcgaattaataagcagtattggccaggcgtggtggcttacgcctgtaatcccagctcttgaggagggccggatcatgaggtcaggagtttgagaccagcctggtcaacatggtgaaaccccgtctctactaaagatacaaaaattagccaggcatggtggctcatgcctgtaatcccaactactcagggggctgagggacgagaattgcttgaatccgggatgcaaaggttgcggtgaaccgggatcgcaccactgcaccccagtctgggcaacacagcgatactctgtctccaaaaaaaaacaaaagcagtatttatctcaagaaatgagaaaaaggataagcaaatctagagaaaataaaacagaggaaataacatagataaaagcaatactaataaaaatattaaacagtgttaacaaaaatatgcagcagcaaataaagtaagaaacactgtgaatattttcatgtcaatatgtgtgaaatcatgaatgaaaggaactagtttttagaaaaagattttttaaaatctaagataaaaaagctaatctaaatatatttacaaccattaaaattccaccaccttaaatcactgggtccatagtttcagttctagaaaacattcaagaaatagatgatcctatcttatacaaactattctcgatactagaaaattaagaatgctcctaaatttaggcaggtagtgtaatcttgatatcaaaaccagacaaaaagagtacaaggactaaaaattatagcccaatcagatggtactaaatcaatgataatgatacaggagttaataagaaatcacttaggcagatagtaaggttttccttttaatgaaaaggagccatcatatcactttcttttctaacaaagagcagcctgcaaaatggagctgcagacatagccaagcaagccagaagcttgcacaggtgaatgcccacagttgtgcccataggaaaaggctacctgggactaggcatgtccaaaatgggggcttcatctgcccttctgtttgccaaaccatgagtacagtaaggagaagacaatatagcccctgccaggcaaagcctccttttgcataagattagggtggggtgaccagccttccccgcacactatgtaaatgtcatacctggtcaaaccagtctgtgggccctatgtaactcagacaccgcttcctcaagcctgcctataaaatctgacgcagtcaacagtgggctggctttccccttttggatgcccctctcttacgaaacagagagagctgtcctcctttgtcttttttttttgcctgttaaacctctgcccctaaactcactcttcatgtttgtccctgtccttaatcttcttggcgccaaatgacaaaccctgggcatttacctcagacaacatagatatatttttgtaatatagagtaataattcagtggcaatatacaccatagttaaaactcgggaccatagttaaaacaattaataataattgaatgaactcgggaggcggaggttgcagtgagctgagatcaccgctgcactccggcctgagtgacagagcaagattccatctcaaggaaaaaaaaaaaaaaagaaagaaaatctcagtatgcaaaataggaaaaagatgctcaacttaatagtaataagggaaaaggcaataaaaatgacaatgagatatcatttaatacaattagcaacttccaagtttaacaaaagcactggtttttaaaaactggaatttctgaagctctcatcctctgatttttgagtttacattggtacagcctctttagagaataattcggcaatacagagttacattgaagaggttcataccctttgacccagtaatcccactctttggtatacagatgtcctaaaaagaatctcacagatatgttcatgaggacatgtaaaagaatgttcatttcatcgtcattcatttctggtagtaataaaccagaacaacctaaatgtctatcagcagaaaaatttatatattaactttgatatagccatatggtggagtatcataaaggacttaataaattaaagctatatgtttctaattttgataaatctcaaaaacaatttaaggggccaaatcaattttcagaaggatacatacataataaaaatacaaaatttgtatgaaaataagaaatataaaaatatgtgcaagcataaatacatggaaaagataagtatcaacttcaggattaggggaatactagcatgaaaagagcaggaatatctgaaaaatgaccttgaatgctcattatggtttgcctacatggccagctagccaggtccccacaaatggtaagggaattatctaccaggtggttagagtggtgttgtggtcaagctcactctctctaaaagagtttcgaacccatattcccaaggtctaaacttcccccaagcatcttctgatacagagcaggtagcatttgcagaaaaccccaataaacagccaacaccccaaacctcactgtctgtgccaaatggccagtatattttcctactaacaaggccattttcctgctttttcttgtgaaatgagagacttacggagggatcaagctttccactggaatgaaaactatactgttaatgtccagcagatacccttgccctggcatacagttccaagtgatgacagagatatcggaggactccaagcctctgtttcttactgacttgtgagtttcatttccctaaaaacatctttcttacccatatcatgtgttgtgaaatttatcgtgacctcttacgatagccctgaagagactaacccctgttcctatggcaaatgcaaaaggagtttccattgtatatgtaatatttgattttttaaagtaagaataaagagatctgaagcaaatatagcacagtgttaatttttgtcaagttggctgatggatgctttggagttcattactctatataattttccattattgaaaatattaaacaaaaggtggtaacaaatcaaagcatgtgttttcagaaatcagttgataacttgaggtgaattattagtatgccattcatggactcagtaattgaaaaataaatttaaattttacacaacctaaatctaaatctgttcctatagacataaactataaaattttagaaaaatatatttataaatatccacaggcattctaacataattcatttaaacactagcagaagtattctaaaacattataactatatttcttctctttattatgaatattgacatatttaaatatctgtagacattttcttagagacacggtcttgctctcccaggctggcctgcagtggcatgatcatatctcactgcagccttcatctcctgggctcaagtgatcctcctgcctcagcttcttgagtagctgggactacagacgtatgacacccctcttgactaattaaaacaaaacaatgtagaaatctgctctcactatgtttcttaggctggtctcaaatttctgggctcaagtaatcctcctgccttggcctcccaaagtgctaggattacaggcatgactgatggcacccagcttacatattttctgaaatacagttatcgtctacgttgttccctttatcactgaaagtgttcatcaaattaaggtatttgactgaaacttcagcttctacaaaatgaggctttttttgtattttttattttttaatgttgtgtggctccagccaactcctccaatatactaattgttaatttgtttgcctgatacctttcctttggtagtaattagagaaatgctaatttccttcccactaataagaaaattctacagtgagaacgcttttatgagatgaactgtacataatctgcatttaaaaatacacataaaactaaccactaacaatgggccataccaaattattctcctgtataaaatatctataatttaaatcatgatactaacatggaatgttcatatttacctttgtattctagatgaaatccagtgtaactaacagatccatcactccgaaaagccaaatgcattgtatttgagctgctttctattctctctggtaacttgctgtcttgaaaacttccaatcagtgggctattactgtctggtccatcatagatatagaggaagtcatagtttggttctatgctaaaactgaaaaaaaaaaggaaagaacaaaagaaagaaagagaagtaggataattattattaggctgttaaccataatagttatataatcaaacattaattcagtgcttaaaaataataaaagacgctgtcaaaataagctaatataaaaaatcacctggcaacaacatatttaatataaatatcaaataagcaggggaaaaagaaaaaaacttgatatttttacatattttttaagttgacattgtatgcagaggaaatataagtgattgtaagacaaagagtttagttgatgaaaagatacaggatttggagtcagagaatgcaagttcaagccttgtttctgcccttattagtgacatattcttatgcaagttactttatgtggaggataatatgtatttttaaaactttttcatccatatattttgcatcatgaaaacacaaactacttttttcttcatcaatagtactcctaaaaatttaactctacaatcagatatggacaaaagctgaaatcaaaagttgaaatatattatttacatttaaataactcaaatgaagctttgcacattgtattaggcattctttttcctgaaagtaaatatattttcttcttttaaaacctaatgtaggagatatcaaaccaatacattatcagaattaggtaatgtgaaaaaggatattttagcatgtaaatgattcaaatcagttgtgttaatattgcaagatttgcataataaacttgccttaacaaccttcaaaagtataacaattgtcccacaatgatcatggaactcatacatttagaagacaggggacatgcaatcaatttctgtttttcctaactcatactgtggtagagaaatatggggtaaaggatagattcatttaggtcagcaagaaaagtcaaccagtttatgatataaaatgaaaccagtaaaacttgccattgttaaacattcatcagtagaaaaactattttggcaagttttatcatatttgcctgcatctaagcaatagatttgttacgtgaaaggcattatttccgaacccaaagaatttatagaagttaacgttccacaatctcatcctttacatatgcatgtacaagaaagaagagtccagctgctcagtttacttgtgcataagcagtggtaaagaaagaatgggatagtgcagaggttcccagacttttcttatatatgggcccctctaacgtgagaaaattgggagaccatcacactattatattttgttttaatttattcagtagcttcaacacttagttcaattaacttatcctgaaatttttcagtggatctgaggcctgtatttggtaactgttggtataataatatagcagaagtcagaagattaaactttatttcattacttattacccttgttctgagataaaacacaacttctgaatttcatctcttccaacattaaactttgatggtaattacaacttccttttctatatctgttgggagaatcactagaaacaagagctttgtaaatgacacagtagtatttattatgcacggaaggctgaaagcttatttaacaatggaacacagtacatttctttttaatttatagtttgggactaaatcaatacttcaagtattgtaacttctttgaaaatgaaattaaaacaaaaatattccttctaaggaaattttagagtcttagttattacgttttttttctgaaaaactgaaaaaacagtgcatgctaatattaccttatgttttacaaggtactttaataaatattaactcatcttgccaatagtcctgttgtataaggaagagattatgcttttcattttaccaatgtgtatgttaaggctctttaaaatcagtggtctacctaaggtcacataataaatgatagagctagaaatcaaatttaggtcatgcacttcatgtaatatgtccttctaccctcaagttatcaactagaataattttatatgtaaactaagccctgtatcatccattttgatatttctaatgtccgtattgatgtttcctcaattgagaaaatggggatagtaatagtacttagcttgggaatttgtcttacaacaggatcctggcataaaactaaaattatcattgttgttgctttggtattactaattagcaatgtaccactacaaatcacaaaaataaaattttatttatttacaattatgctaaatttttatgagttcaaattatctttacttaggaaaaacaaactggcctcagtacgttagaaaatattgtatatttaagcttaacatttcacataaaaactaaggagctttaacatactggtggcagaaaaaggaattgtgctactagagtcaacataactgattacatcaaccttagataataaagattggggacttttctacttggaaaatcactgagttgctattacctaacacttccaatgaaatcttcagggaaagaggctgggttttgtgatgccagctgttagcttcatgcgggaaaatggaggctcactcaaataaataacttgcccaaggtaacacaaatgacagtggcaaagctagaacaactattagcactgggataagtaaaaaataacaaaaaatgctatatacagaaataggaattagtctagtacaaatgctaaagcaaaatggcctaacaatatatttttttaacgtggaaataaatatataagaactcacctgatgaacgccaaggagataacatagtctgcattgacggtgatagtccagtcacagtctctgctatgcggatatggatgagggaagtttggtgaaagaataaagcctgaagatcctgttaaattgcctccacagggtgctttaatttaaacaaacaaataaaatctctttaaacattaatacaatttattagctatcaatatttttgaaatcacgtctctaaaagagcttatgaggctttgtacagacctgaattttatagtacttgatgcttggatacagcattatgtttcaagaaagaccattaaaatattgaatacatgcatacatacatggatacataaaatttagctgctttattggctttaagagaccaaaaagaatgcatatatacttttctgtctttctattattattttgtttcatgtcaaaagaaaagcattaaaaaagtgataaagatgattttcctctggttaccagaaaaaatcagatcaaagcaaaacaaaacctctaataataaatagaaaaataagacatgagacatatagcttattttcatgtctctcctggcacctttatttagtacagttattacagtttcaaacaaaggtttccataacacttaaatggagagcttcaaaaaattgtcagtgaaactcagagaatagattctttaggggattactgttgaagtttgctaaacagagcttgtgttcaagaaattatacattacacagaaattgacatcttcaaaaaaatagagaaatgaagaaagatatggaggtcttcgtggtgggatgggagagtgggaaatacaaataaatacacacacccaagtgagggacattaagattaggattctcacattctcacaatgtctcctacacataatcagtacatcggcattcttctctcaccttggtttcgaaattgtagttttctgagataaatatgagcattcagttataagggaaattaaatttttttgtcctataaaactggttttgtaaggaagagaattttgattctggcaacatttcagcatttctgttccttgcatgagttgagatatgtaatatcatcactacggtttggtaatttttccattgtcttttgtctggtactgccttcctccatgcacctctgctactcttgtctcagtacctgagtcactctcagaaaattgtctcagctcttactgcattgagaatatctagttgctcagacttaatatattcaccactactttcctgtcgcttatatgtttttgtggtacattataaaatgattagacataaactgcttcgatgttctgtagtcctccatctccaagcttaaatgcctcctgaatatttctctttacaatcccaggatagagtccctcctaatcaagatatcaccgtcaacctggtcacataatccctctcccttatccaaaacacttgttcaattatttgtctcccttacttttcctggctttctccactttgtccacaaacacgctcaggtttctttcatcttaaaaataaaacaaacttccctatgacctacttactttcactttttttaacagaaaattgtttactataaggaaacaccctgccccatataacttagataagactcacttatcatgacctagataagctgtctttgtcaccctcttgtttatggcaagaccagacacagaccctaccagttccgattctttgcttctagctgaactgcttggctcactgattaatctgaataaaattcttgtgaaacaaactttgattacgtttccctccttattctaggctcctgaactttgtcccactctcagctttaagacagcacaggatatttccggagaataggttggattcagagcacaacattctctcatctactattcaatcaggctgccctttcctctgacttcgtacctggttctctctagctttgtttagccttctctaaaaaaagaaaaaaaagccttttcatctaactcctgagataggtgcagatcttacagccttagtattccctgttgcaatagtcccttccctgctccttgcaataatcctgtctgaatcaaagtctcttcttactaaattctgattttttttttaatttggcataactaagctttttgaaggggacatctactctcactgtctctttctgcacccctgtgctgtatgtacctatgggacagattaagatgactaacaagtccaacaaagcagaaaactaaaggaggaaaatgtttcttatgttgtttctcaaagaaaagtgccaaagtattcaacatgacaaaaattatcgtaaggtttaaagttatttttattttaaattacatttagagagacacaataacctttctattacttagagagtctagattagatgtctttttttttttttttttcgatacagggtctcactctgtggcccaggctgctggagtgcagtggcacgaccacagctcactgcagccttgacctcccaggctcaggtgatcctcccacctcagcctccccagtaactgggactacagaggtgtgctgccacatgcagctaatctttgtatttttggagagacagagttttgccatgttgcccaggctggtcttgaactcctgagctcaagtgatgggcccacctcaagcctcccaaagtgctgggattacaggtgtgagccaccatgcttggcctctagatgtctttatatggtcctttctacctctcattctcttctcaaccattgccccaatacaaacatttcttagctagctcccaatacaaacatttcttagcttatacttaagtgacttctgcatttataataataatgaagactttgctgcctttatctttctcttcatatctgtagtcattcttaattgttgatctttatcttaaattcaccatcctagtttctggaatcttagaagccagtgtttctggggttttcttctagtgtctttatacagacttcagtcttattatcatacacttcttcctttacatctccttataactttggtgatctcctaagttccttacatggttctcttaatttctactggtacatttttccttgttgaccatatgtaaacttatgatttttatcttctaatttttataccctgataacacctttccctatctcctcctacagatttcttggctgaactctaaaccatatgccagagtgtttactgaatatctctctctgtagtctattggtacatcaaatatagaatagcctaaatactcaacctcaaattaaattggcttcttttcctaggttcctaaattgttagatgagcataccatccacctgtagtcccaagctagaggcctaagagtcttctctttttttcactgcatccttatatccaatctatcaagaagccctgccaggactccaccctgtagctattttcaaccggtccttcttttcttgcctactaccaataggtctaactcctctctttctcgaattattacaattgataattgaaacgattattccccatttttttcctcagtgaaaacatctaatcgtactatgtatatgcataaaattctgcaactgtttcacattgtctaaaatataatgtcccaattcccatacagccttcatgatctgacccatacagtctttccagtttcatcaaccatcagtgtatacacataaattatactcaaatattatcatactgcttatatttccttgttcttccatgactttactcattttgtttcttcttcctgaaatgcctgtttcccttctacatttatataactctaacttatgtttttagattcatcactgcctccaggaagttttcctgtagaccccagaatgggcactacttcatctctctctaaaccattatggtatccatagtaacctctgccaatctctgttgcttctcttattgtatttgtttttaatattccactcaggtgtcagtattcattactaatatgtaatattaaccctctggtatccatagtaacctctgcccatctcggtcatttctttgactgtattgactgtattttatttaatattccattcaggtgtcagcactcatcactaatatgtaagctagacactctgtctatattttatttattcctagaattcagtgcatactatatatttcataacgtttgttgaattgctagtggttctttatatttgattatgtaaatagtgaagatgactgtagagatggatgcacaatctaatttgtagctatgtgttttaataaaaatagcaacatattttacctttggggctctgaaaataatatgtgaatatgaaaaaaagtataatagcaaatgcgtatacaggcatacgttagggatattgcagtttcagtttcagacccccacaataaaccaaatatagcaataaagtgagtcacaaaacctttttggtttccaagtccatataaaagttatgtttacactatcttgtagtctattaagtgcataacagcattgtgtctaaaaaatgtacctaacgtaattaaaaatactttattgctaaaaaaatgctaatggtcatctgagtcttcagtgagtcatgatccttttgctagtggaggagggtcttgcctagatgttgatggctgctaactgatcagggtggtggttgttgaaatctggggtagctgtggcattttcttttctttttttttttttttttttttttgagatggagtctcgctctgttgcctaggctggagtgcagtggcgagatctcagctgactgcaagctccgtctcccgggttcacgccattctccttcctcagcctcctgagtagctgggactacaggcgcctgccaccatgcctggctaattttgttgtatttttagtagagacggggtttcaccgtgttagccaggatggtctcgatttcctgaccttgtgatccgctcgtctcggcctcccaaagtgctgggattacagacgtgagccaccacgcccggggtggcattttcgtaaaataagataataaagaagtctgccgtagtactggatttccgcgtagcatgtgatgctatttgattgcatttacccacagtagaacttcttggagacactcctctcaaattctgcctctgcttttatcaactaagttatgtaatatttgaagttctttgttgtcatttcaacaatgttcacagcatctttaccagaagtggattccatctcaacaaatcactttcttttcccatccataagaagcaactcctcattcgttcaagttttatcatgagattgtagcaatcctgtcccatattcaggctccacttatgattctagttctcctgctacttctaccacatctgcagtttcttcttccactgaagtcttaaacaccccctcatcacagtcatccatgagggttagaatcaacttctgccaaactcctgataatattgatatttcttctgcctctcatgaatcacaaatgttcttaatggcatctaaaattgtaaattctttccagaaggttttcaatttactttgctcagatgcatcagataaatcactgtctttggcagctatagtattgtaaaatatatttcttaaataatgccactttaaaattcaaaattactccttgatccatgggctgcaaaatggatgttgtgttattggcataaaaacattaatctctttgcatatctccattagagcttttgggtgaacaaaagctcatttgtacattttcaacaagcagttgaacaagcaatgggtacattttcaacgagcagtgatattttgaaaatcatctttttttctgaacagtaggtctcaacaatgggcttaaaatattcagtaaaccatagtgtaaacagatgtgccgttatccaagcttaattgttccatttatagatcacaggtataattcttaacaggcctaagattttcagaatggtaaatgagcactggttttattttaaagtcaccagctgcattagcccctataagagagtcagcctgtcctttgaagctttgaagccagacattgatttctcctctctagcaatgaaagttctagatgacactattcgaatagaatgctgtttcatctacattgaaaactgtttttaatgtagccactttcatcagtgatcttagctagatcttctgggtaactggctgcagcttctccttcagtacctacatattcacgttccactttaatgttacagagatagcttctttccttaaaccttacaaatcaacctatgcaagcttcaaagttttcttctgcagctttttcacccatctatgtctttatagaattaaagagttagggccttcctttggattaggttttggcttatgggaatgttgtggctggtttgatcttctattcagaccactgatttgcttcatatctgcaacaaagctgttttgttttcttatcattcctgtgttcactagagtagaattttcaatttctgtcaagaattttacttttgcattcagaacatgggtaactatttggtgcaagaggcctagctatcagcctatttgggctttcaactggccttcctcactaagcttcatcatttcaagcttttaatttacagtgacagatgtgcaactcttcctttcacttgaatgctcagaggccattggtctaattttaatactgtgtatcagagaataggtaggcccaaggaaagagagagacatggaggaacagtcagttaggggagcactcaaaacacatatttattggttaagttcactgtcctacatgggcatttgtttgtggcaccccaaaacaattacaatagtaacataaaagatcactgatcacagatcacaataacaacaaaatagcaatgaaaaagtttgaaatattgtgagaattaccaaaatataatacagggacatgaagtgagcagatgccattggaaaaaaagtctattaggacttgcttggcacagggttgacaaaaaccttcaatttgtaaaaaaacgtaatatctgtggcatgcaataaagtgaactgtaataaaatgaggtatgcttatatgtatgtatatatgcaaaaaagaccagaatgatagcaaaatgttctttgtgatttttttccacttggattatgtgtaattttggagagggtaggggagtaattttgtttcaattgtccttattttttagaaggaacattggtcttttttattgttagaaacagtatagagatgcatacatacatgtagatgttatatatgtatattccttatcacaaaatatttaagaaaatttattacatatagtaaagtatctattatttagatataagattctctaaaatgatttttattctattacttaaattattgtttttcttctagagacaaggtcttactatgttgcccagtctcatctcaaactcctgggctcaagcaatcctcccatcttagcctcctgagtagctgggaacacaggtgtgcatctatttaaattatttatcaaagatttctcaatatatttcaatgctgtggttgattttgaaaacctacgaaagccaacaagaaaagcagagacattatctgacgtttgtaaatcccaaactcttagtgagtaaagaaaattatctttaaatatactcaactttaaatagcatttagaaatgcatctctatttttgcccatctaaccataaagcattcaaaatataagtcagggattcatgaattaagttttcagtaatttgctctgaatgcagtgttttctgaggcagttatatgggcatcaactattgataactattttaaaatcttcttaatttgtttctcaaattcaattttatttgtgtcttctttctatctcaaaagcccactcacattaatgtctttcctatttaccttcatattgaatgcttctactttcccgggggcaatgtcaaagtaatttacacgctgtcaattttgttggaatgaattttattaactctcttaaagatgacgtccttctgtttggtacttgctataagactgactgtttctatatgcaagcaagcaaaacgctttatgcttcggggtcttagacatagaattatggagtttctaagaagttcagggtttaatctttggcatggtatttccaatcatgaagttctttcttatcagttttagaggtcaagcattctgcagccttagcaatttttcagactttttttttaaggttattttcttccccagagaagctctaatttatatcttcccctcaagctatcttttcctaccaaaaataatacacagtatcattatctatagaaaaacctcacacaacctgcttaacttaagtaagacttagtactcagcttttttttttctagaataggacttgctagctaaagcatattcttgtctaaaaatggaaatttgtaatagcagatctcagaagtttttcatcttttgcaccttggattttagtgttatctagaatttttgtataagccatttaatattttaggattttatgtaaaaacaattgtcatcagttggcccttctggtaattctaataagcaacatcctttagccaaatctaagaatcacaataaagcaagaagttctacagtaagattttggtgttttataatttattctttacataaatatgctcttcatgagatatgtggtcaaattccaattaattagaataagaagttttaatttagttgaaaattttttggttaattgagtagtaaacaaacttgaaaattttgaaacagatacgaaacattatttcaatctctttctttgcaaacatttcttaacagttgtttccccggatcgtatgagtgcacttacagtaaatgtaaattaattgatgtttgttgatttagaatcttgcagtggtacatgaagaacaatatgggtgtgaatagaaatagtgtaatgggagatacagctaaatctgaactgttcaagtgatgccattatttcatgctttataaaagggtctctaataaatttacttctttgtcatttgtcttattttttacagcagagatctagaactgtccgtctactgcctggctggtttgggcctttttatgttgtttggtgcatttagtgttttcttaaatccaactttataaaatagagaaaatgtgttgtaaaacttttttttttattatttcactgcaaagtaagttcataggaacagagtacttttctgtcttgttttattgctaatttcccactgtttagaacagtgcctgagacacagttaatgactaatgaatttgattttgtaattttgtgtgggagttacaagatggggtaaaataaatctgaataattgattgagtttgttcacttctaactgaagaactaacactcttttcctatttccatgggactttcaaaataagtcactgtgaagtttatgggttaggtgtaagtgaacaaaaataagattctccctctaaaacttgatacatttgcatgtaccaaatgctataagaaacacaatgatgaacaagttatggaatcttctcccaagttgcttacagtgtggtaagagagagtatgtaaataaataaaattttcagtagagaaaacatagtttgttcaaaatgtgtcgtaaattcaagatgacacaaatactaaagcacctgaacagaacaaaaaagtttaagattaaactagtttaatgatatagcatattttctaactatttttattccaaaagcgggacattcctctaagtctttctcagaccaaatcataatttgttttaattttctagagtctaacttggagattcaataacagagcacggagacaaaagacagctggaagtatgatccaggcgctacagcttcttagatcttccaaataaaaaccaatattcctttggattacatgaattaaatagaaagacaaagcttggaaattctgacataggttctgacaatattttctttcttaaatgaaataaccattttagagacaagatcaatatgacccattttaatatggggtctgaatccactctttaagcaatggataactatggctacatagtaaataaagggtgatataattttccaagagctttgattcataactgttttagaatcttagaagcattgaaaaaattaatgaaatcatcagcctttaccccatggaaaaataataatcattttacaattttgtacattctgcggaggttaataatcctctgaaatcttagactctcatatagaatctagtctagaatatggttcttaagaacaataccagtttttaaccattgttttatgtttatataaaattttaattgttctttaattcatacctatacagactggtgggctgggctgccagaagtaccgattttctacctgaatgcaggttattctttcctctccttgaagttcatatcctgggtcacattgaaaaacaacagtgtccccaggttctcttccatccccatttcgagtcccattcatggggacccctgggtcacgacacgcagtggcaacagaacctatcaaaagacagagacaaaattttagttttgataactaccaaaatcaatttcatatatccctgtgttttagaaaattaatttttaaaattttggggtcaatttttaaatgctatacaataaacactttctccatattttaaataatttatgtgctaacttatttgaaaaagtggcatagtattttagttaccaaatactagatttactcaacattattaaatgtattgtgaaagacactgaagattatgaaaagaaagcttcatactgggaaaatatatttgttaggaacatatccgcagaggacttgtagctagaatatataaacaactctcgaaactcaaaaaaaaaggaagaaaattagcaatcaatccagttacaaaatgagcaaagacattttaatgaaaacgatatcagaaaacacatgaaaagatgttgaacatcactaactaatagagaaatgcaaattaaaaccacaatgagatactactacatacatttcaaattggctcaattttttaaaaaatatatgataacaataaatgctggtaattatggagaaaacgggatcattcatgcattgctggtgggaatgtaaagtggtaaaaccactctggaaaggattatggcactttcttacgaaactaaccattcacttactatataccacagcaattgcactcttgaacatttatccaaaagaaaataaaacttatattcacatgaaagcctgcacacagatattcataacaactttatccataattgctaataactaggaacaacccaaatgtcattcaacaggtaaatgtttaaacgatggtaaatccatgcaatggaatattactcagtaataaaaaagaatgattcatatatatgacttggatgaatttgaaggaaattgtgctaagtgaaaacaatacaatatcaaaatattatatagtttcattcttttatataacattcttgaagtggcaacattttaaaattagaggccaggcatagtggctcacacctgtaatcccagcactttgggacatcaaggcaagaggatttctaaatcccaggagtttgagaccagcctgggcaactaagtgagactctgtctctagaaaaaattaaaaaaaaaaaaattagcccagcatggtggtgcatgcctgcagtcccagctacttgagaggctgagttgagaggacagcttgagcctaggaggtcaaggctacagtgagccatgactgtccgtctgcactaaatttataagtgaatttgttttgtaatatccatcagtgtttctcagcagagcactaaatggagcatcatgcatcaaagaatctgaggaattatagtcttccactatggatagagatcttttataaaaaatggtgtgtgtgtgtgtgtgtgtgtgagagagagagagagagagagagagagggaaacttactcattaaatttttcttgatttgctctggaatggtttctacccaaactaaaattgatatattgtattagtctgttaacacactgctataaataactacctgggaatgggtaatttatgaagaaaagaggtttaattgactcacagttctgtaggcttagtaggaagcatggctaggaggcctcaggaaacttacaatcatggcagaaggcaaaggggaggcaactacatcttaccatggcagagaaggagagagagagtgaaggggaaagtgccacacactttcaaataaccagatctcatgagaacacactctctatcaagagaagagcaagggagaagtccgctcctgtgattcaatcacctcccaccaagcccctccactgacatgtggggattacaattagagatgagatttgggtggtgacacagattacaattagagatgagatttgggtggtgacacagagccaaaccatatcacctatggattggttttataagtggagagtgatgttcgactaataaaacacatctttgttttattagattttaagtctgccattcatgcctccttttccttaacataaatatgcaaagtaagcagaaattccaacaaagataaagggtcttaacaaccttgttgtctcactcgtaataatatcataaaaggaacatacttgaaagtgaataataggcttatatgttataacatcaaaatataattcgagtttgacctgtaaaatcccatgaaattgtcaataaaagattacttccctttcttgttttctttgcctcaaaagtgctggccaatttcattttggttagtctaggaattatccagtgactagtctgttacacagatgtagactgtactccttaaattagcttaacactcattagaaataataatagtcacacagaaaaagtatacaaatagaagcatatgtcaatagctaataatgctaatatgtaatacttgttgagcactttctacatttaaaacaccatgctatgagctgcctctcgattcacaggaagtctgagtgctattattatccatatttttccattgagaaaatcgaggcttaaaaaggctaaggtgctttcccaacatcatacaattacttagggacagttaaagaacaaatgcaggtataagaccatatccaagggacatttttgaaataaaagtcataaagcctttgtaataaaatgtgcttaagtgttgaatagagcgtaaaactcaacgatatggttatttaaatggaagtctctgaaacatgctattaatctttaagtgtcattttaaaatcagacgagcagttatccacctattattttcactaaagtagtccaaaaacctacatatttataacatcttaaatgtattaatttctttaaaaatatttgcaccgatgtcaacattaaagccttattaaatagggttctattgttatatatcaaattgaataaagaccagctaagaaagagaaactttaaaaaggcaattaattcagaatagagaccaataaaataatgataatagcaataattactctctgtatttagagcatatagcatgcaaagcacttgactagcagctcagtttacactcaagctaaaacacagaatccttacaaagtggtattttcatccccatttttaaatgggtaaaatgagatcttaagatctcagagatcttaaatgcatgttcttagcagagctggaatttgaactcaaccagcagggctcttaaccattatagtgtgttgtctcagcacaaacctatcccattaccagaaataacataaagccatatcctactagtggaactctgacagctgtctattgatgaaagaattgaccaaaaaaaattcgaccaatttgaaatggaaaggcaagaaatatagaacaatttgtatccatttattacacataaaaatatgttgctgcctacatttttactataatggaaagcagaaaagaaagaggcaaggttatatttgtggttattaaaaataatagaaataaaatttattcatatacatatccaagtttagccatatatatgccaaatatatgtcaaataacattttaaagtaactacaatatgaagaacatttccactccaactgctttttcactgtttctccttctcatcccttattttgttttatttccttctttataattttttgagagggtaaagcaatagatagaagcactctcttcttaacaccatcaaatccatcacctcactggtatttacatccatattttgtttccttgtcttttaaaatggagaagttggccttgttctgtaaaaagccaaccctagttcttgtgttgctagtattaaacactgttaaggacttactcctaaatgttcttcatctcctctgcatcactagcacattggatcattctcagtcgcatgtacagtactatactggatcattctcaacagcatgtaattgtggcttctatcttccattttaaataaacaaacaaaactttataatatccccatcctctttcagctgctttcccatttctctgctttctttaatagaaaatctattaaatatatctcctgagagaagtttctatacaattgtctccagttttatcgtcagtctttcctctattccactgtttttaaatccaggctgccatatccagtggtaacttttatggtttctttcaaaaacctttcagcaacatttattaaagctgactattccttccttcttcaagcactgttttttattttgttgttttgttttttggcctccgattcatcagcctagtctggttttctttctggcttatttgctgctctcttttggtatcttttgcttttgttacttgataacctaatgactgagggctggagtaccttaggaattagtccttaatgctcttgtcccttctttccacaatttctcactaaataacttcataagtttaagtattatttttagcttgatgcccctgaaatttgtatatccagcctcaacttttttctgagctcttaaccattctcttcaagtgcctatttaacttctgtacttagatatctggtaggttccttaacttactatgtccaaaatattgtaaaattataaaaccttttaatcttctgatttagaaagtaaaaatgtaaaaaataagtataaaatttcacctatataaatttttcctagacaattgatgtcattgtaaatgtacttctaatttattataataaccatataaaaatatgttttagaaattgttcaaaatagaaggtaaaaatcgttgacataagaaatagagtgaacattagcaaaaatataaaatcttctaatttttacactactttttatgccagtgattttactttgtatgctaccatttatttctaataaaatgagtttttctatctggttgttataataaattagaaatacatttgctatgacaaatttttactttcaaaatagaactgtttctattccactaaaaacaaataactgtacccatggctaaaattctcattaccccgaatgtgaaaaaagatagacatgtaaaagtaatgcaattttctaactgcttatacgtagaagaaacaatttttcaagatatgttgttttattctaattatatataaggaatctctttgaattcattgtaaaagaatgtatgcttatctgagaaagcatatattacttagaaattgtttttacaatgccatcaatcttcttcactgatctaaatccactgaaagagttcatagcattcgtcattaagtaacacgtccttatcaaatctagctttgctatgccctaggaagaaataaattgtccatcagtacaagaatttgaagagaacttcttattatagttaaaaacaaatgaatgaatgaatgaataaatgaatgaacaaaactgtcatttgtcatttcagtgtatgctgaaggtttatttataatatgatattattttgaagccaggagatgtttatttcaagtgtgccataacaatatttacattacattttaatcgctttactctgttatgaataacctagggtttgttcagaaaataaccagatggctctaactactgcaaaatataactgagttctcattattgctactgtcaatatacttctcacttattttatctttgcttccatctagttgggagtataatttcactggaaatatgcacttcacttaatatagatttcacaagccgagctggtgcatatgtagttttcaactgaaatatggatgattacttgaagtcagagataagttgaattaccattgtggtgacaagagcaaaagaaaacacgccggttttcttactgctttgcttggtataacaaagaataaatacactgaaatcactcttaagttcttatgtgtcctttatgttcagaaaatcgactttttggtataaacttgtttatttcaagacctttcaaagaagaaaaatcttggatctcatacagttggatgagtaatgatatcagaagcaggagacttagacttagtgtaccgtattaagaaaagatattaatcccttgtattagttccctgaatctttcctgccttatctgtaaaactggcctaggaatatttcatctgctttatttagaatcagacaaaatattaaatttttattctaacaattatattcataatcctatgaaaatacaattctgaaatgaaaaaacacaagtacactttaatatgctctgtataggttttctaagcagtaattttatattttttgccatgtgtcaggagacttagcaaggtcatgggccaaatttggtattcacagtttctcacatccctctctttcagctttattgccttatatttttgtattggctaaaaaatgacactgtattctccacttccctatctataagaaaatcaagatgggtaatgggaatacttaacctgtgagaaaaatctcatccagagtcaaatcaattagaaaatatttgaaatgcagatggtaacctagaggtggatttcaccctggagaattttgcccttgattgagcccttgctttgtacatgatccatcaattttataaagaatgttcaacatcattattaggcccacactctgccagctactcagaaatgtggctatctttagaatttcattatgttactaaggatacatctaatgatatggcaagtcaggttaaagttgatggcagcatgacagacacattctaaacaacctaggaaagaaacaaagctgcttaatgcatggtatggaaaagaaacctcaaagccagtgttgtaatatacttccaagtatatagaaatctcttttttaaaaatgcatatgcatttattacaccaaataattattgagccaggtattatgcttgatgttggagatattaacagaaacaacacagccctgctttcatagattcttatgctccagtatgcctacaaaagttgttggcattgtatcatatcatatcatatcatatacagtcaatgatataatttttgtggaatcaaaggcttgttaggttgaagactatcaaaaggatctgtacaagaaactcattttacatccaaagattacagaaaatatgagttgatttgaaatagaattctagtatatggggatgaccagtattagtaagtaaaaaaaaaaaagaaataaaaattatgtaaaaatggtttcacattacttctgactgacactatacagtatttgtatgtttttagttttacattattagaagatttacccattcaatcagattcgttaaatatttactaagtaccaagtaccaggtaccgtgccaagttatggggacacaaatatcaacaggatgatatccttacccttcaaggaacacaggctaagaggaatagtagatgtgaacatagttttaaaataataacatgtgtatcaaaatctgatgactttgttattgaaactgaaaaaattattaagcatgaaacaagaagctaaaagtaaataaaattatataattaaaatatgtattgagtaacataattgatattatattgatgtatgtctcacaatagttatacaaaatctattttaaaaataaaataatttctaaaaaattaaaatgacatctgtgtacaaaaagcatcttctttatatgaattatctgaatattaaaataacgtgcaaaataatcatttctgttacacatgttcattctttaattggtttcttagccacatttaatgccctttttactattttttctaaagaatgtgttttttcaatatattcttatttttattagtattgccagaaacatttttatatattttaaactgtcggtagctcgactgatatcatcataagccatactatttttaattgagaaaatttcctctttgtaagtgttagctacctggtaagctcaggtttaattctttgaaatgaagaaaaatttcaattttatttttattttcattaagcagtacgtaaacatttcagctcaaatattttcacatgtactgaattttaacttcttttcagaatacatttttgacacacttttataatatgaaacttgtcaaacaagttttcttaaattatgttttgaaatatttatctacaagctgtataattatatacaaaataaattttatatataaaattttatttatatatgatttatattaaatatacattttcttaactttattctatcccagaataaagtagaagtttaatccaattaaaaataactatcaaaaggccgggagcagtggctcacgcctgtaatcccagcactatggtggaccgaggcgggcggatcacgaggtcaggaaatcgagaccatcctggctaacatggtgaaaccccgtctctactaaaaatacaaaaaaattagccaggcgtggtggcgggcacctgtagtcccagctacttgggaggctgaggcaggagaatggcgtgaacccaggaggtggaacatgcctggagccaagatctcgccactgcactccagcctgagcgacagagcgagactccgtcctcccaaaaaaaccccaaaaaccatatatatacatatatatatatatatatatttatatgtgtgtgtatatatatatgtatatatatatatacacacacatataaaaaatatatatatatatatacagggtctttatatatatagtttttgttttttatatatataaatatatatattttatatatgtatatatattttatatatataaatatatatataaagaccctttaacaagtcaaggcatactaaaatactaaagtttcaaattttaatattgtacagtgtttgaactttcattcttctaaagaaatcacacttaagtgtcttcctgtttattgttttcaataattgctttcaattattgttattgtttcaatttcagttattgttttcaataattgctatttacttaaaattgtaaaaactgaagatttttagcactgtactaactgaatattttaagatattcagtggattttaatgaatagctatcaaaatgtaaacgttttattttcaaaatcattcaatatcatagtagggcattttagtttatttgcaaaatagtacttcaaaaacccaaacctttctaggacttattgacaatgatctggaaaaagagaacatggtactggcatactatgttcttttatttattttttgaatcagctttactttgtctctctctctctctcacacaaccacacccacaacccacaaacacacaccacttagttcaattatttcaactgcatataaaaatatttgtatattttaacaacagttttattgtgatgggtaattattacaattttattggttgcaattatgaattttgtgtatacaacaaccaattcctagtacatttctgttttttaattttataagagctttgcttttattataaggttatgtaccaccaaaatttacatttgtattttatcacaaaataaataattttatctttaatattaaattttaatttgtggcctttgctcactttaaatatttaaaagataatttttttgcttaaagtttttttaaaagggttgtgatgtttataacatatgtaaaagtaagataaatgaaaacatgccccaaagaactgaagaaggaaatggaaatacactattagagggttcttacattatatgtgaggtggtataatattatttaatgataggtttgtctatttgacataatgacaggttttcataagccaaagatacacgttacaagagttagagcaaatgctttctttcctcccaaaagaggtatagctaataagctaatagaagagaaaaaaatgatggtaagaaaaaagtaacaattaacaggtggattcaataaaaaaaatagcaatatggtagacaaactttaaccaagtgaataattatattaaatataagtagtctaatggttaaaagactccaactaagggagagagattttcaaacaataaaaaatcaagatgcaaccataagctatttactagtagtctactttaaatataaagacactgataacttaaaagtaaaaagatgctaaaaggcatcatatgatatatatatagaaaaagtaaactttaacacaaggaaaattaccagagaaaaagagacagatttcatatcaataaaagggtcaaaaaagggtcaaaaaaaacccatagcatccaaaatgtatgcagctcataacatatcttcaaaacacatgaggcaaaaaataaaagtaagagataaaaagaataaatagacaaatgtgaaactgcagtggggcattttaacacttttcttgagtagttgataaaataagtgaagtaatgatattgaataattaacactatcaacaaaattgatatttataaaacacttcaaaaacaatggtaatatacttttttttaggtaggtgcacaaggtattttttttaaaaaaacatgttgggctatggttttctcagtaaaacaagtctcagtaaatttaaaactaataaaatattaatttttaactgaatgtataatatatgtttatctttaacacaatcaactttcaaagactttattttgacttcatgaaatgaatacaaaaataaaacttgcattggaatttaagtatttgaggcaatcaatgttactgattatttgaagcaattgatgtgactcacataaaaatagatttattcaactatttgtgaagttctgctaagggagctggcatattaacactcttcatactttctcagaagagaatttagaatacaaagtgatgaaattcgtatagtattcatctgacctaaatacaaggtcctgctttttaaaacatatttgtgtcttctggttttcacatcatcagtgataacactatggtcctcatgtacattaactaatacactgtatgcaagttgcaagttcatcaccactttttaaaaaaattttaattgagtttttttgtaattagtgtgcagatattattagcagtttatacatactccttaatataagtactaaaaatttaaaaatcatgtagccaatccaaacatctattctaatgatttatcatcttaaagattgtaggcaatttattcattaaaaaaaaccaagtaataatatcttaaaataactagttatacactcttaggtctaaagtcccaacatataccaggatttaaacacagtaaaccaggattcaaacacagtaaattctcaatcaaaatatcccattcttcataacatgctagcaagtaattaggaaaaaaaaacctgttactaacaaagatgtcgtgatgccagtgataaattgaataccaaggagcactttaatttaggaaataattccaataaaaagaacatgacaagtgacatcagcacaatggcaaagtagaaagtcctgtacactctaccccaaaaaaacacaaattcaggaacaaatcatcgacaaatttcctttatgagaaatccagaaactaagtgaaaggctcctgcagcccaggtgaatgtgaaaccagactgaccaaaactagcagagagatccagaacaccctctcgccagactcctcaccactggcacagtgacatataatcaggaagcgattcactcctagctcccagcttctcccagaggagaaaggccttggtttgcacatgtagcaccccaaccattccaagaggactccacaaaggtctggcttctgtcttgccagtcttggatctctgatgggaccagcgcagtacaccagctggggaaaacagagatggaagctaggggcaattgatgcccctagcttcaagcttccctgctgctcagatgtcccaagtcttctttgctgctcagcataacatgagcaacaacagcaaccacaaaaaaacaacaaataaacaaacaaaatcagctctcagcttctctctgagaagaaaaagagttgatctaagcatccaatgccccaactttgccgggattgcctaaagaactggcaactatttgccagtcttagaactctaactggtctgccacaaataagggataatggaaatagtggtttggactggtagtgtcatagtttcccccagtgggtcagcacagagcaaatacacaaaaagcacagttaatgcggtacagtggctcacacctataatcctagcactttgaatatttgaaaggccgagttcaggagtttgagaccagcctgaacatcatggcaaaaccacaaccctacaaaaagtacaaaaattagccagcagagtggtgcatgtctgtagtctcagctactcagaaggctgaggcagaaggatcagtttgagcctgggaggttcagactgccgtgagctgtaagcatgccgctgcactccagcctggatgacagagcaagactctgcctcaaaaaaacaaaccaacaaaaatccagctgtctgtttctccttgtaaagggaaagagttgttggtagagactctagaatctctggccaggctggttgatggtggtcttctctggtacaagcagagtctgggaagacgggatgcagtgtgtataattggataatacacatatgccaatgcagagcatcaaggaaaattaagaatcagaaaaaaataattcaaacaaaggaataagataaatctccagacagcagccttaataaaatgaagctatataatttatctgacagacaaataaaaataactatcataaagatgctcagaaagctcaagagaatcatgcatgaacaaaatgagaattccaacaaacagatagaaaatataagaaagtaccaaacagaaatcatgcggctgaagaacacaataactaaagtgaaaaataactagcgaggtccagcagcagactagatcaagctaataaaaggaccagcaactcaaggacacatcattaaaaataattcagtcaaaagagcaaaaagaacaaaataatgaaaaaagtgaagaaaccttaaggctcacaatttagggaccaatatttacattatgagagtgtcagaaggataagagaaaaagaaaaacaggacagtttactcaaataaataatagctaaaattttcccaaacctggagaatgaaatgaacatccagacccaagaagtccaaagaacaccaaataagagtaacctaaataaatccatactgagacacattacaagcaaattgtcaatagtcatcaaagacaaagaaaacattttgaaagcagaaagagaagaacaacttgtcacatataagggaagctccataagagtagctatttcagcagaaactttgcagaccataaaggagagtgatggtatatttaaaatgtggaaagaaaaaatagcctgccaccatacacggtcaaactgtctttcaaaaatgaaggttggaaaaagactcccaaacaaaagctgaaggagctcatcaccattagacatgccttaggagaaatgccaagaaagttcttcaatttgaaatgaaaggattctacacagcaaacgtacaacacaagaatatataaaactcagttgggactttgcattagaagtccgtgttgatcctaccacaatgtaacacagcattgggcagaattccaaagcccttgactccgagccaatacccacagagggaatacttattcttacaccaggcaagatagaaatctgtagccacagccacggcagaagggcttaagccctagctgactgaaatggtcttgggcctcaaataaatttcagtggcagcaattctgtagtgaccatggtctttgggtgagccccagtgctgcaatgacctggaaggctgtgggcttatgatgcaacccagtgtgacatcagctgcgggggccacagaagtgcctatgtcacccctcccctaacacagttacccctcccctagcacagtgcagagacaaacagagagacatcttccacttgagggaaggagagggaagagtacgggggactttgccttggaaactagtacagtgccaccacagcacaacacagcatgcggcagatccccaaagcccctgatttcaggccactgctcccatcaattcttctagatccaccccatgctagaaggaaatctgctaccctggcaggatggaacaaacccaaatctgagctggcttcactaccagctgcttaaagaggcctgaggctatcaataaacatcagcagcagtcaggccatgattatgggcattgggtgagcctcagtgctgtgctggtctggaaggttgcaggctttgggtgccagttacaacagccacaggaatggccatgtaaccccttcccaaactccaggcagctgagtatgaagagactcctgtttgaggtaaagagacgaaagtgagtgaaggatcatcctggcaacccaagaaattttccatgatctcccaaaagtccatcagaaataagtacatagaagtccactagatggttgcagtgcagttggacttagaatactctctagtactaaaacagctgcagtgactacaagcttggggaactcaataataaatcctatttgaatttttgaaatgttctctgaagaaggatgggtactaacaaggccagattgtgaaaactggaataaataactaactctgaaatgcccagacattgattgacacatgtccacaagcctcaagaacattcaagaaaatatgatctaagcaaacagactaactaaggcgccagtgattaaccttggagtgcccgagatatgcaaccttttggtgcattcaaaatagctaatttgaggaagctcagtgaacttcaagaaactcagataatcagtttagaagtttattagataaattatatatataaatataaataatttaaaaaatcaaacagaaacctagagatgaaaaatacaattgatgaactgatgaatgcaaaaatgcattagagtgtctcaacagcagaattgattaagcagaagaaagaattcatgacatggaagataggttatttgaaaatacacagtcaaaggattaagaagaataaagaaggcttacgagatttagaaaatggcttcaagaaggcaaatctaagtgtcattggacttaaagaaggagtgagaggtagggatacaaaatatattcaaagaaatgataacagagaacattccaaatttagagaaaaatatgaatatccaggtataaaaaggtcaaagatcacaaagcagagtcaatcaaaataacactatcccagggcatttaataatcaaactctcaaatgtcaaggacaaagaggattctacaaacagcaaaagcaaagcaaataacatatcaatgagctatgatacatttggcagtagacttctcagcaagctatgagagagtgtcatggaatattcaaagtgctaaaggcaaaaaaatttctaaccaagaatatagtagtgagaaaaactgcctttcaaacatgaaggagaaataaaaactttcacaaacaaagttaagagtcttcatcatcataactgttttacaagaaatgctaataagagtccttccatctgaaaaaaaaaggatgttaatatacagcaagaaatcatctgaaagtataaaactcactggtaaaattaagttcacagacaaattcagaatattctaatactgtaattgtggtgtgtaacacttgtgtctttagtctgaagaagaaaagacacatctatcaaaaataacaactataacagtttcttaggagatagacaatatggaaagatataagttgatacaacaaaaagcctaaatatggggaggagtatgaaatcaaaatgcagggctttatagatatttctttgtttgtttctgtgcttttctctgccactaaccttaagtagccattagtttaaaataacttgtacaactaaaagattttctttgtaagccatacagtaatcacaaaacatagacttataatagagaaagtaaaaataaaaagcaagggattcaaacatactaactttgtggttaagaaaatcacttaaccacaaaggaagtgaagaagaaagaaaaagaggagttataaaataaccagaaaaaaaagtaacaaaatgacatttgtaagtccttatctatcaataatggcattgaatgtaaattgactcaattttcaattgaaaaacaaagtggctgaatgaacgaaaaaataagacccaaatatatgctgcttacaaggaacatactcatctataaggacatgcatatactgaatgtgaaggaatgaaacatgtattttatgcaaacggaaaccaaaaaaagagcaagagtagctatacttagataaaatagatggcaagtcaaaaaactgaaaagatacaaaggaattcattatgtaataatgaaggggtccatttatcaagaggatataacaatcataaatatatatatatgtacccaatatcaaagcatccaaatatttacagcagatattaatacagctaaagggagagagaaagaacagtacaataatagtgggggacttcaacactccacaatcagcaatagatagatcatccagacagaaaatcagcaaagaaacattggaataaaactacactgcacaccaaatggacctacttgacatttacaaaagattgtatccagctgctgcagagtatacatacttctcattagcaccaggaacattctctgagatagagcataggttatgccacaaaacaagtcttgacaaattccacaatatttgaatcatcttttctgactataatggaataaaaccagaaatcaaagacaaaagaaacattagaaattgtacaaataacatggaaattaaatgacatgctcctgaacaaccaatgggtcagtgaagaaattaagaaggaaattaaaagatttcttgaaagagaaagcaggaaagataaaaaattgacaccctaacatcacaattaaaagaactagaaaagcaagagtgaacacattcaaaagctagcagaaggcaagaaataactaaaatcagagcacaactgaaggaaatagagacacaaaaaagtcttcaaaaaattaatgaatccaggagctggttttttgaaaggatcaacaaaattgatagaccactagcaagactaataaagaagaaaagagagaagaatcaaacagacacaataaaaaatgataaaggggatatcaccaccaatcccacagaaatacaaactaccatcagagaatactacaaacacctaaataaactagcaaataaactagaaaatctagaagaaatggataaattcctcgacacatacactctcccaagactaaaccaggaagaagttgaatctctgaatagaccaattacaggctctgaaattgtggcaaaaatcaatagcttaccaactaaaaagagtccaggaccagatggattcacagctaaattctaccagaggtacaaggaggaattggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaaccgaatccagcagcacatcaaaaagtttatccaccatgatcaagtgggcttcatccctgggatgcaaggctggttcaatatatgcaaatcaataaatgtaatccagcatataaacggaaccaaagaaaaaaaccacatgattatctcaatagatgcagaaaaggcctttgacaaaattcaacaacccttcatgctaaaaactctcaataaattaggtattgatgggacatatctcaaaataataagagctgtctatgacaaacccacagccaatatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagccccaaatctccttaagctgataagcaacttcggcaaagtctcaggatacaaaatcagtgtacaaaaatcacgagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaataaatattgtgaaaatggccatagtgcccaaggtaatttatagattcaatgccatccccatcaagctaccaatgactttcttcacagaattggaaaaaactactttaaagttcatatggaaccaaaaaagagcccgcatcgccaagtcgatcctaagccaaaagaacaaagctggaggtatcatgctacttgacttcaaactatactacaaggctacagtgaccaaaacagcatggtactggtaacaaaacagagatatagatcaatggaacagaacagagccctcagaaataatgccacatacctacaactatctgatctttgacaaacctgagaaaaacaagcaatggggaaaggattccctatttaataaatggtgctgggaaaactggctagccatatgtcgaaagctgaaactggatcccttccttacaccttatacaaaaattaattcaagatggattaaagacttaaatgttagacctaaaaccataaaaaccctagaagaaaacttaggcattagcattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaactaaacaaccccatcaaaaagtgggcaaaggacatgagcagatacttctcaaaagaggacacttatgcagccaaaaaccacatgaaaaaatgctcaccatcactggccatcagagaaatgcaaatcaaaaccacaatgagataccatctcacaccagttagaatggcaatcattaaaaagtcaggaaacaagtgctggagaggatgtggagaaataggaacacttttacactgttggtgggactgtaaactagttcaaccattgtggaagtcagtgtagcaattcctcagggatctagaactagaaataccacttgacccagccatcccattactgggtatatacccaaaggactataattcatgctgctataaagacacacgcatgcgtatgtttattgcggcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcgtaggtgggaattgaacaatgagaacacttggacacaggaaggggaacatcacattctagggaccattttggggtagggggaagggggagggatagcattaggagatatacctaatgctaaatgacgagataatgggtgcagcacaccagcatggcacatgtatacatacgtaactaacctgcacattgtgcacatgtaccctaaaacttaaagtataataataataaaataaaaaaaaagatttcttgaaaaaaggaaatgtaaacaaaacaccccaaataaaacctaaaatatacaacaacagcagtactaatttatagcaggaaacacctatacaaagaagtagaacgtcttcaaattaacaatctgatgctcctcaaagaactagaaaacaatgacaaatcaaaccccaaattagtagaaggaaagaaattataaagatcagaacaggaaaaaaaattgagagtgaaaaaagatacaaaggataaaatgaaaactctctttttgaaaagataaactaaattaacaattttttcttagctagattaagagaaaagagagaagcctcaggtaaaaatcacagccaaaaaatgagacattaaaactgataccacagaaacacaaggaattattagagactattatgaagaagaatatacaaaccaatgggaaaacttagaagtacatgaatttctagacacataaatctaccaaaattgatccatgaagaaatagaaaacttgagcagaccaataacaagtaatgagttcaaagtagtaaaaaaaaaaagtcccccatcaataaaaaactcaggaacgaatggattcactgatgaattctaccaaacatttagagaagacctaataccaattctaatcacactatttcaaaaaactgaaaaggaagtacccttccaaactcattctatgaggccaatttactctgataccaaaaccaaagacacagcatgaaaagaaaacaaagagcctcaaccaaatactagcaaattgaacacaataacacattaaaaagatcatttactgtgatcaagtgggatacatccctgggatgcaactatcattcaacatattcaaatcagtgaacaggatacatctcattagcagaatcatggacataaactatatgaagcattgcaacaaatgctaaaaaaaaagcagtcaacaaaattcagcatcccttaatgataacaactctcaacaaactggttatggaaggaatatatctaaaaataacaaaggccatatacaacaaacccacagctaacatcatcctaaacagggaaatgtcgacagccttttttctaagatctggaacaagacaaggccaagaatgaccacttttataacttttattcatcatagtactaaaagtcctgcccagatcaattaaatgagagaaagaaacaaaaaggcatcgaaattaggaagaagtaatattgtccttgtgtgcagatgacatgatcttatatttagagaaacctaaaagattcaaccaaaatgttgttagaacttataaataaactcagtaatgtggcaggatacaaaatcaacatacaaaactcagtagcatttttatatacgaataacaaaccatctgaaaaaaaatcatgaaataaatcccatttacaatagctacaaaatatataaaatacctagaaataaatttaactaaaggagtgaaatctctctacaatgaaatttataaaacactattaaaacaataggacacaagaaaaatggaaagacatttaagtgttcatagattggaagaattaatatttttataaggtccttactacccaaagtcatttacaaattcagagtaatttcttccaaagtaccaatgccattttcttgctccttggccatcttggtgggtgctcttgagtggggcctgtcctgcacctaaggcaggaagatgggggccacaaagaagatgaaaacctcactggagtcaattaactctggagtccaactcattatgaaaagtggaaagtataggccaatatctcagatgaacatagatgcaaagagcctcaaccaaatactagcaaactgaacacaacaacatattaaaaatatgctaaggtacaagccaactctgaagatgatcagacaaggcaaagcaaaattcatcatcctttttagaaactgcctgactttgaagaaatctgaattagagtactaagtattgttggccaaaactgctatccaccactacagtggcaataacactgaattgggtacagcatgtgaaatatactacatacaatgcatactggctatcattaatccgggtgattctgatatcattagaagcatgccagaatagtctggtgaaaagtaaacaatgcaaaatttttatttagtaaaacttgccagagttcatttttttatttaaaaaaaagtaccaatgccactcttcagagaaaattttttaaaaattctaaaattcctataggatcagaaaagaacgtgaataactaaagcaatttgggagcaaaaagaataaagatagcttagtggcatcaagctatctggctttaaaatatactgcaaagctacagtaatcaagacagtgtgatactgacataaaaatagacacacagacgaatggaagaggaaaaataactcagaaataaatccatacatctacagccaactcatttttaacagatacactgtgaaaggacttcaataaattgtgctgcagaaattggatatccatacgtagaagaataaaactagacccctatctctcaccatacacaaaactaaaatcaaaataggttaagacctaaatgtaagtccttaatctatgaaactaccagaagaaaacattgggaaatacttcaggacattagttctggcaaatattttttgcataagacctcaaaatacaggcaacacaagcaaaactaaacgaatgtgattatatcaaactaaacagcttctgtaaagcaaagtaaacaatcaacagagtgaagagataacctacagaatgggagaaaatatttgctaactgcccatctgacaagggactaataaccagaatatataaggaactaaaacaactcaatagcaaaaaaacacaacaaaacaaactaaaacaaaaagaaacccacaaataatccaattaataatgagcaaatgctttgaataggcatttttcaaaataagacatacaaatggctaccaggtaaatgaaaaaaatgcttaacattactaataatcagggaaatgcgaatcaaaaccacaacgagatattatctcacgccagttaaaatggctatcagaaagacagaaaataacatgctgagaaagatgcaaaaaaaagagggaatgctcatgcactgttggtgtgaatgttaattaatgcagcaactatataaaatagtatggagtttcccttaaaagctaaaaatacaactaccatatgatccagcattaccattgccgggtatttatccaaaagaaagaaaattagtatatcaaagagatagctgcacgtgcatgtttattgcagccctattcacaataacgaaggtattcaatcaaccatcatttgatgagtggataaagaaaatgtgctatatatacacaatggaatgttattcagccacggggaggaaaaacataaaatcatgtcatttacagtaacattggtggagctagaggacattatgttacgtgaaataagccaaccacagaaagacaaatattgcaagttttcacttatatatgggggctaacaaaaaattgatctcatggaggtagtgagtcaaatggtagttactagatactgggaattgcagcattccaatgggatgaagagggtacaaaaatacagttatacagaaggcacaaattctattgttcaatagcacagtagagtgatgatagttaataagaatttattttatatttcaaaatagctagaagagaatatttaaaatgtactacacaaagaaatgacaaatgtttgatataatgaatattccagttactcttatttgataattacatattgtatgcgtgtatcaaaatatcccttgtactccataaatatgtacaactattacataccaataaaaaagagaaatagaaaacacctcaagatgaaacaaaaacacgatatgccaaaatgcatgggaaacagaaaaaacaggactatgtaagaagttcatagcaataaacacctacataaaaaggaaaaatgtctcaagtaaataacctaactttctccttcaacgaactagaagaacaaagaagctcacagttagcagaaggaaggaaataagattaaagaaaatataaaaacataatagaaaatagaaaaacaattaaaaaataaaactagagttggtttcttgaaaatctcaacacaattgagattcccttagctattccaagaaaaatgagataagactaaaataaataaaatcagaaaagaaagaataatgctacagaaataagagacataagagactatattgaacaattatatgattacaagctggataacttaggaaaaaaagtggacacatttatagaaatatacagtctaccaagactaaatcatgagaaatagaaagcctgaacagactcattattaatatggccatttaagcagtattttaaaatctcccaacaaagaaaagcccatgaccagatgacttcactggtgaattctaccaaacgtttaaataagaattaatttctatccttctcaaactcttcccaccaacccccgcaaattgaaacaaaacaaaacaaaaccaaaaacaaacaaaaaaatttccaaattaattttgtaaaggcaatattccctgataccaaagccagaaaaatacatcacaagaaaaaaaactagagatcaatatttctgatgaatacatgtacaaaaatcctcaacaaaatactagcaaactaaatccaacagcacattaaaatgttaaaaggatcacacacaatgtccaagtcggatttattcctgggacagaaagatagttcaatatacaaaaatcaattattttgatacaccacattaacagaataatggattaagatcacatgatcacatgataatttcagtagatgcagaaaaagcatttgacaaaattaaatgccttttcttaaaaaaaaatcctcaatatattaggaatagaagaagaaaaatgtttcaacattataaaggccatatatcaaaagaccacagctaacatcatactgtctggaaaaaaaaaaaaactgagaacttttcctccaagatcaggaataagccaaggatgttcacttcccactcctattcagcatagtactgctagtcctggccagagcagtttaggaaagaaaaacaaaaggcctccaaaatgaaaaaaaaaaaaaaaataggtaaaatagtgtctgctggcagatgacacaatctcatatatagaaaatcctaaagactttatcaaaaaaactgttggaactaataaattcaataaagtttcaggatacaaaatcaacatacaaaaatcaattgtgtttctatatacactaacaacgaactatctgaaaaggatactcagaaaacaatctaatttaaaataatctcataaagaataaaatacttagaaataatttaactaaggaggtgacagacttgtatactgaaaactataaaacaataatgaaagaaattaaagatacaaacaaatggaagaacagcctctgttcatggattgtaaatagaaaaaaaaatttctactattcacatgaaaccaaaaataacttgaatagtcaaatcagttttgcaaaagaataaaaaactgaaggcatcagacctcctcatttcaaatatatattaccaaagtacaataatcaaaactgtatggtactggcacaaacagagacatatagaacaatggaagagaatagagagaccagaaataaatctatgaaacggtaacaggtccacaccataagacagggcaacaaaaaggtgtggacagtggtggaggggtaccaggaatgcacaaaggggagaggatagtctccttgacaaacggtatttagaaaattggatatccagaagcaaaaaatgaaattagacccttatcttacagcctacacaaaaatcaactcaaaatggattaaaagcttaaacgccagacctgaaactgtaaaacttccagaaggaaataaaaaaaagagaagaaagctttataacgttggtattcacaatgatttcatggacatgacaccaaaggcataggtgacgaaagcaaaaataaacaagcaggaatacatccaacttaaaagcttctgtacaatcaacagggtgaaatggcaagctatggaatgggagaaaatattttcaagccatacatctaataatagatcaatatccaaaagacatagggaacctctacacctcaatagcaaatgactgataaaaaacagtcaaaggtcttgaataggcatttctataaaaaaggcatacaaatggacaacaggtatataaagaaatggttaacataactaatcttcaaggaaatgcaaataaaaatctcaataatatattacttcatacctgtcaggagggttattatttattaaaaaaaggtgttggcaagaatatggagaaatagaaactcttacatgctattggtgggaacgcaaaatggtgccagccactatggaaaatattatgaaggttcctcaaaaaatctaaaaatgaaactactttacgatccaacaatcccatttctagatatttatcctaaataataaaaatgaggatctcgaggaggtattagtattcctaagttcattgcagtattattcactatagccaagatgttggaaacaacttaattgtctaatgacagattaagaaaatatgggaaagacacacagtggaatacgatttggtctctaaaagaaggattctgcaatagtcagcaacatgagcgaaccttgaggacactatgctaaataaaataagccagtcacagaaacacaactactgcatgacttcacttatatgaggtatctaaaatagccaaattaatagaatcagagcctgaaatggttttttccaggggcttaggggagatgggatatgagagttactaatcaactggcataatatttcagtttagcaatataaataagctttagggacctgctatatagtgttgtacctataaccaaaataatgtaccctacacctaaaaatttgcttaaaaagtagatctcgtgttaattgttcttaccacagtaaaataaattgaaataaaaataatgtggctgttgaagataggtactgtaaaatgattaacacatatttaatatatcaggtactttaaaatgatgaggatgtatttaatgcattattatggcttcaaataaccattcaatctgatccatattttggcatatattaataaaactgccctcttcactagcctataaaatgtaaacatgatacacaaaataatagtgtttcatttaattcaatgttttactaatttctgttcacacagctaaataaatgatcagtgcatgattttccctcttaaaaaagttttatcacttatctaaataagttttattgaaatgggattatgtgctactctctgctttttaaaaaaatttgtttctggatgtatgaaattcttggatttacaaatagtgattaaaaaactattctggatcattttctgttatctttttggtttcgtttcaattttcacaaggattggtttttgtagaatccttgctgatctctgcttgggtgtttcttgacagccccttcagcagaactgactttccttttggacatcttagtggatatcagctttcttaagaaatgaatgttcagtacaaactttttcattaaacatttaatttttaaaatctcattgctgccataaaggtctattgcaagataataaagcatatttcaatgataaagtaattagttccaaatttacacaataaaataaacagcatatatactcgtggcatgagtattcaggctatattttgtaggtctgtaaatcaactgctcagtctctatttctacacatacttcaagaacacatatttcccatatttccccctaatcctgccaattcatggcctggcagtcttacgtatcattcaaaccacaatacatgctgtagcataactatctgttatacaaaatatctgtcagggcaacaatgtcaaatgctcctcctggccaggcacagtggttcatgcctgtaatcccagcacttgggggtgctgaggcgggcggatcacaaggtcaggagatcgagaccatcttggctaacatggtgaaaccccgtctctactaaaaatatagaaaattatctgggcctggtggcacgcgcctgtaatcccagctattcgggaggctgaggcaggagaattgcttgagcccgggaggtgtaggttgcagtgacccaagatcgtgccactgcactccagcctgggcgacagagcgagactccatctcaaaaaaaaaaaaaaaaaaaaataataataataataataataataaatgctcttcccaccaccatctagggtcagaatgggtgacctgttcatatctaagaatgcttcattttatctctaagtgtcctatgttctatccttgaaaggtaagtgttaatcacctggcatctggaaaaagttgagaaatagatacaagttattatggcaaaaaccacaattacttttgcaccaacctaatagtatttgtctttcagatgtaaccatgcattataattactgagcactgcaaacttatgtcacaaagcggggatctaataaatacactgtggcttattttaatgaactactaatagtgatactttgttaaaaagggaaaatacaggataaatgtcaacacagtcagaatgccaggacaacaggcataaataaggactgtccttagtaaaccagggaagagcagtacatatgtggaaatggaaataagtaattctgtctagtagttcattgctactagaagtagcatttagcctatgtcctggaaaatgactaaaattgtacaaattttgaatgtaggtacaagtgtttcaggaatatggaagagagtttgcaaagcagtagaaacgtgcgacgatattgtcctttcaggacaatttaattagacctctggatgtatataaatgaatagtgaggagtgaagctggcaggtaggttgggacatattctggaggctttaaatgtcatgccaaagtgttgagtttagatttgtgtggccattaaataattttcaacagagaagtgatgtccaattttgtatttcggaaagatcagtcaggtagaaatgtggagaaaagttttgctggagggataaagaagtgagtggctagtcgactgttagagcagtgcagggaacaataataaggatgagaacaaaggcaggggcaccatgcaattggttaaagctggggaacttcaacctctcatggctaagggatatatttccttgagatttttcaacagtattagctacgggcctcagcattttgtattacccagcaggggaagattctcaacagagaggtcaaagagtgaagagcatagaaaatgctctgtcagaatctactattctgtgggcaaatgacagcatgatacccaatgatatcttccctggggaactaaagtggaatgagacaggcagattaaaatgtaagcagaggatatagaagctgactactgagaagtgaggacagcacataggacagcgtgaagtggcaatgttagacttaagtagctctgattaagcaaaagtgccttgcagacaataacaccaagagataaagcaacagactctacaaaggatgaatggatcatgaaataaaagtcatgaggctgccgacagtggcttgatgattatcaagttggtctgtggcctacatttctgttaaatttactttgcaccaagtttggggaaacacgtatcacctgttacattcattggtgaagactgttctgctactattgcctgatttattatttttaattaattattttgactttcaatggacagctatttgctcaaaagaagaatggaattaaattgtactaatcggggaaggggggctcaaataaaatctgacaattaaaacgacaatacttcctgattttgtaggagcatcctggtttgtgcctattgctgagcttaatttttattagcacttgcttttaatctccaaaataccttaagtttggatagtaaattatattatcaccctgtacaaaatatgtgttttatatagacattttaagagacaaaggtatccatgatattaatatatttgggggcgcaaaggcaccataattaaaataccattaccagcctggccgacgtaatgagacctcatctgtacaaaaaaaaaataaaaattagtgaagtgtggtgcacacctgtagtcctagctacatggggggctgaggtgggaagatcgcttgaacttaggaggttgaggttgcagtgagctgtgattgtgccactgcactgcaccctgggtgacagagcaagacattgactctaaaaaaacaaaaaacaaccaaaaaacttctagaacaatgaattgctacgccttttatactggtctttatttggggaaaaagaaatacaactactggaaggagcatgagctagaatagtaagaaaatattttactgaaaagggatcttggcacagagtctggaagaatgagcagaatttaagcacatgggagcagaactaacactaaagaaaaaagaaggtttggtgatggaaagcagcagagagagagagagtgtatgaaattaagagttgcttgagttaatgaaaagatgagtttgagaattaattagtgataaatatgtttaatacctggttcttactagactctcctaggatgaatgagtgaatgaattagcggatgaacatatgaatgaatgggtaggatgaaatagatttatctagggaagaataatttaggtaaagcactgaagtggcaaacatgatcccacgagccaagtttgacccacggtagttgtttagtggcctatagtccatttacattctctttaataccacttgtatactttagaaactagatgactttagataaaatttcttatttcaaattccactttaaaattttcctgtcttcctatagggcaaaatgcttagaaccagagagggcatctgtccctttcagatgggcatgtatgtactccggctttcctccatttcttctcacggtttcactcatatttcatctccttttttagattgggacctttgatgtggtgcttggaattataatcaggaaaccaaattgattaaaatgtagaactccattgcagctaataatatataactgaaagctttctattccccctggcatattaatgcatgtatctagaataataatactgtaataataactactaagcatttagtatgtacaaagcatgacattaatctcctttcagacatgtgagtttcagttatcactccaggcatctgctagttgtatgatcttgaacaaattaactgactttctgaacattaatgtatttctttgggcaatgagaatgataaccatatcttatatggcttttgtgagaattaaatgagattatgtatataaagcatttaacttgattcttggcacccatcaagacttcattcatgaaaagaatattttcccatttcaaatctgaacacttgaaaagctgtgtaagcacatgttttagaaaagatctctagccaagaggttaatttttcattcacaatgtagtaaccatcaatgtaactttatttcaataggttgattttaaggctcagatcaaatttctattcatcttaaaaaaaacttatgaaggcagagttattaaagctctagtatgaaatatattgtttctataactttaatgtgccctacaaatataataaatataaaaatgtactgctattttcacagattatctacaataaaaattcccagaaatgcatctaaaatagtgtgtttccacttaaccagataaggttgagtgtaaagtgtaagttgcatttgcaaacactgagcttgagacacctttccatattactgtatgcagatatttaattgcaataacaatttaagtggaaaacactatgtattactaatctaaagtaaaagcaagaattgtttattgctaaactacaatagaaataactaaaattaagccgctctctgacaaattgttcccacttaaaaaaataaacagtagagagtagaatatacaaatatgaagaatatttcattggtaaatgttttctaattcggagccatttatattcacctattatatgattattttcttattttattccattttctcaaaatatatatttaaagtgcaaatttagagatattgacttttcagtttatacctctctttcacatgaacttgggtcatatagtacaaaataatttgtttgtgttagtagggagaataattgtgttccataaacaaaaagtcagccaagacaattgtttaactgtataattgtttacttaaaacggtatattttgttggcactgatttcaaaagtccttccttcatacttttttaaactatttgtattatttattttcaagacatttcaatgttacatttatttatgtaaaaataatagttcattaggtaccagttatctactcaataccaaatactgtgcacacatgattctgttagatttaataacttatttatgagatgagcattgttattcctacgtcaattagaaaacccagtatcgggtcactaggtaacgtgcccaaaattagcagttagtaaacagccagaatttgaattccgacacatttgaagagtactggttttcactcatagttgatcatagaaacattgacacatttctgttaataggactttttaagactatacagataaaaaatctattagataattttctcaaagagataatgtgcattaacaagttaaaacagcatttaaacattttaagtttttattcattttatccatcaactaaactaaaatttcttttacagaacaacatatatttagccacttagcagtgccatgagaagaaaaaaattagcaagacaagaacactggtaattacttacaaggaatgctatttcattgtcatattattgttatagaaaatctttaatttaaaagccatctgaaatattttgtcaaagatgtctgtgaatacataattaagatatttagataatttttaaaaaacaggaaaaatgtagggttgtattttttgtaatagcaagtagtcatttccttcctcatctgcaaaacttcatattttaaaacttctacttttatactatttccagattataagcttttgtgatgtaattttttttttagctgagtaatttaacaccacttttactttaagaataaatgattttacaggtggagagaagtctcaacaatcaatattcaaagttagttgtattacctttttcccatgtatattttacctttgctgcagaaatataggaagactagaaacacgaatatttaaaatcattaaaattttaaaattaaaattttgaacagtaaagttaacatgactatttacatcaccttcctattttgcattgaagaaattttttgaaaaaacttacttgaaaactgaattgcaaatccagatttgctaatataaaaatccgtgtcaaactggatggttactatattgagggtgctatgaattccttcaggaataagagatccactaatttcctttaaaagcatatcattttctggtggaccgtcccagactcggagtatatcatgtgatgcttccgtatcaaaagcaagaaactgcaagctgtgggagaaccatatttctctgattattttaaacaaggattcaactttaaagaaaaaatagaacaaatgtgcattatgccttttactagatagttcttttttgctatgtgttaaaaatgaattacataaacagcatatattcttaatatatttttcttgagacatataatttgtttttttagaatattattaaatacaatattacatcacctttgcaaattgtagaaacttcaggcatacattctttcccgtgttcatggatttaactagggcaacagcaggggacatttatagataatcttctacatgctaggcactgtgcaaaatgcgttacatatattttatttgtttaattgttataatgacccaatgaaatatgaataatttttatcttaattttacaaatatggcaaatggagtttagataaatgaaataatttcccaaagagtggcatagtcaaaaattgaactcaagttttctgactctacagtacatgcttttgccacgtttcatgttaaatctattctgttttaagtttaagctagacaaaattagaatcgggtgctttttgtgcttggtgcaaaatttagaaatctaattatattgacatgctcaactctacatacaatacatttatgtttgatacatgaatcgttacagctttaaatttaagttgcaatttaacatcaaataatgtttaatttttagaaattgcagaaatctggtgaatttattactttcaagtttaataatatttatataaaacaatgcacgacttagactaaagaaaaataaactggggatgatatagtgtagtctattttcagtttgcacattgccttgcaaaagtaatgtaccaactcacactgcatccatcaatgcatagtagtataccacctagaagcctgtctgaaattccattgtatataaatggaatttatattactactttatataagtagtaattcttaagttttaaagttattgtttgttattgaaaacacaccaagtagctcatatgtcaaggatgattctagccaaagctgcatagtaaggctgggactgagagcctgtgatagctttggaagtcagactggtgttgatttgagataatgactctgtacttatctaaggggtagtaacaatgtgaggaactctgcggaaaagggaaatctaacatgattacatgggcagagagcaagtgtttcacaaatgtgtttagggacaaggacaacaggaaatggtattcagtccccttctattcttatttctcctaattgttaatgaggatgcactagggtaataatttgcaaaactctgtatatcagtcaaaatgggccaggtgtagtggctcacacctgtaatcccagcactttgggaggcagaattgcttgagcccaacattttgagaccagcctggtcaatatagtgagacctcgtttctacaaaatatttaaaaattagcctagcctggtagcacatgcctgtattcccacctactggggaggctgaggtgggaagatcatttgagcctatgaggaggaggttgcagtgagccgagatcgagccctgccttccggtctggatgtcagagcaagactctgcctcaagaaaaacaaacaaacaaaaaatgaaataaatggatattaattttatataggggttggttaggcacttcagattccctagtaatgttgagaaaatgaaattcatttacctgacaatatttccaggatctacctcaatcatccacatgcaacgcaggttattgtcatatggaaaaggatagccaggagataagattcttcctgatgattctcctttaaaacgacctccacattcagctgataaaaaataatagaaatttaagccacaatttaatgccaatcttttcaaaacaatctacaaatttctcatgagtagacaaaagaatactgattttcttgtttctttaaagtatacatttgtataaacttttaaagtatcaattgaagcaagaatatataatacaatcaaataatagagtctcaagttagagcacaaaaaagacaacaaaactgaaacctacttaaagaattaaaacaagacacactcaaaacctctgagttaggattccaaacattttaagatgtgttgttaaataacgataattttaaaagggaaacagatggcaagttgctcactgctaacaaattgcaggctgaataattcatcatcttgctaccccgcctttgagaaaaactaatctttactgcagtccctcaggccttctaaatttcattgtccttttatttcccctttaaatcattttaaaccctttcccttgtactctcccaaaagtcaaaatggcattttttattagattccttacttcagtaaaatctagttaggttttgatttaatgtggtctctaatttttataaaaattatcaaactaagaatgtgagtatcgtcatgcaatataattaaaattttatattttaggggattccttctccattttaatactatttaatactgttgtgataactggagtgattttacgtcagtgaacaacctagaaagagtctctgtactggaaaagagagaaactaagtattttagttagcatattgctctacgtctttaaaccctagaaacaaggaaaacactgtggaatgccttacacatttgaatcttttgtgatagttcttgttatcaggcacttgtgcatgagaaccctccccttatggctttcccagctctgtttgtcagagtttttaaaacaagtgactccattttgattctgacaactttcctattatcttagattaaataactgaattaaactttttatttttgattattattattattagaccaaagaaggtcaaagcaggaaagttttagcatttggaagagacctgataacactagaatctaatggctcaaatttgtaggctgcatatatgttaacttgttttaaaaattttagatactatattgcaccaaactgtgatggatagttttatgtgtcaacttggctgggctattagtgccagttatttaattaactattttataggtatggataacatctacactcagttgacttgtaggcctcatccaataaatttgaagaccttaagagcacaactaagtttcctggggggaaaaaaaagaaattctttctcaaaacttcagcaactcctgcctcagtttctaagctattaacttgccctatggactttggacttatcagcccccaccattgcatgattcagttccttaaattaaataaagctctatagatagatagatggataaggaagacagagagagagagacaaaagagagagacagagacagagagaaagagagatatcctattggtgctgtttctctggagaaccctgactgatatacccatggagggctaagggaatattaccttttattgcaacattaatttaatctaatttacaataacacactcgggagatttttaaattaaaaagatattagtatttaagatgttatcaccatttatggtttttcatttttttctaacaaaaattcttttggacaatctgtaaacataattgtattaattcatttttcatcatttatttatgatttatcactatttgattacatttaatttgagaacagagttgatacttattcttcttgattaatttatagtcaattagagaattttgcactatattgcatcttgaacttaaacatagctgtttccccccatatttctttgttataaaatattacctggcatttttgacctcaaatgagccagtgtcatatgctgtagtactggagttcatattctatataaaacttatgtttgcagaataaaatgaaatttagtgtttaaagaagagatacaggttaaatccttccagctatggtgcctcaaaaactaatttttgtttcatcaatgaataagattcagaaatataattacctataagtaatctaaataattaagaaaagtttccttatttgactgaggctaaaacatagctgtagaagatatttaaggttaatgagcacaggctattataatcataggccaagtgttaaagctattaatcattgcgagtagagaacaccatctaaaatagaatttcatcttctgttatcatcaaattattcagtatcactcaccatatgtccaactgtttatagctgctaaatttatttgatcatccatcattagaattttaataaagaagattaccctacctgtgaaatcttgtgcaatatcaagtcaacatgttttgattttgagtacttgtaaacataaaatgcattgatttgctgcgaacataattaaaaccttctgatctcatactaaatatccttccatttgtataaaacctttccaaaaagtagagaatatcttcagcttgtttcaacacacataaaaatatatatgcttttaatgtatttgtttgtggttttaattttaaaaacagcatggcaagtcaatatttatacatttatggtattgtgctattaaactcttaaagcttttctgaacatatttcataatcacatcagagagaattagtcagtggtacatttttctcataaccaatgccaatgggctgattattgatcatattccagcttttggcaatttaatttgattattattttaggtatcaccctcacaatctctccaaaattcagatgccgtctgaaaagtaagaactgtgattgcattttagttagataaaaccatgttgttttctgcatgaatcaatgttttaataaaccaacagaggtctcatagcatcaaaaccactacgcaattagttgcaaggcctataataactagaatttcatattttctatttgtattctagcaagttttatggcaattcctatgctgaccacatcaaaaaacgacagaaatattctacttttgtcaaaaggtccaggtcttaaaaggtaagtcaaattgcacattaaatatgtgtagttttttgtatatcaattatacctcagtacaccttctaaaaataaaagatttgagtcaattttatccatataggcctgacacagaatggatttctgcctctataaatgccatcaaaaaaagaaaggctgaagaatcactgcatatatgttctctgctggagagttagtgttttgctacaaagttgttttcctttgttgtcctagtattccaatctgacacctacttggtctttagagcagaaaagaaaaagagaaaaagagagatctctatccacacctgtcaatatttgtctatctaccttcccacccccacctacccatctatgcattaactaatctacaagatggtaggaataaaatggtaccccagctatgcaaagaagacagaaaatgatcattctctagcttcacgaaagcaatatatcttatgtcactctcacattccttttcctactgaaattgagtgctatgctgtaacatgcatgagaaaagagaataggttactgttttctctaatccaccttgattccacaataggtaataattttgtaaattaaaaaaatctggccaatgcaattcaataaatgtgtataattaaaagtcttaacattttagtaatgagttccattttatgtcgaggtagcagaaataaaatgacttcaaagagaccatattgtcccccacaaactagaagattatgggaggaataatgaataaagttatgaaaaggaccttttcattttccattaattttcttttgacaaattcaagctatgagttcattaatttctcgatataaagtgttagttctatgaggacagaaagaatttcttaaaaatgcaaagaatttgataaagttttcacagaaatattcaatgaaaatctatgacagtatcctaccaatacaggaaggcagaggatagtcccatgcccttctctcccctgtcatgcacttgagaaggctacttccgtggagagtgtagcctggattgcatccataaatgatggtgctaccagcaaagtggccttggtcactgatcttgtatccaaattgtggaatgccaggatcttcacagtgtgagagttcaaaacctgggacaaaaatataaattgattaaaggcaaaatttaggaggaggatttaaatctatacaaatcattcctttcctttactatttttgatgattacatacttattcttagtcatattgcccttaccatatttaattttcgtatcatacaacaaccatgcagacctttttttttcttgaaaattaaaatgtgttgtgtttttgaagtttatcaatgataccccatggtctatataattaccatggcttgtggtactaagcttcctgtctgcttcaagtgatttagagttaatagtagattctgagtgataccatgatataacaacaagtatatatttgttctttgtccctgattcctggcacagagctcctaaaagtcttggaatttcttgagtgataagagtgagagtacagtttttgttacttatcataagccatccatacctaagtttctataatgaagttgttcctggaggatgggggcttatcgccagagaaaccaaccatatgattagaaggttgtgttggaactttcagtgccgtccccatggccgggtcatatacatacatctccgtggaggggagaaggactgaaggttgagtcaattactgaggagcaatgatttaatcaattatgcctatgtaataaaatctccataataatcttagacagaggggttctgagagttttcagattcatgaacacctccacatgctagaagggtgatataccccaaatccccactccatggggacagaagctcctgcacttgggacccttctggacctcagctatgtacctcttcctttggtagctcttcgtttgtatcctttataataaaccaataaaggtgagtaaatgtttccctgagttttgtgagcattctagcaaattatcaaactcaaggaggaagttatgggaaaccccaatttatagctcgtcagtcagaaatacaagaggcctagattttcaattggcatctgaagtgtgggcattcttgtcggattgagcccctaaactgtggggtctatattaactgcaagtagtgttagaattgaattgaattaccagacatcaagtcggtttcaagtgttggcgctcagaacaatatactccaaagtatggcactttggcatgctgagtgctttgaatgaaaagtgattagaaggcctcagaagcaaggtctctctgcccttcttctgcccttctgccactttctctctcccaaagctagtcatacaagccagaattcttcttccccaagatgcatcataaaaactagaaaacctctcccccaaagcgagccacagaacctagaaaggtcattttcttccttctcccttgaaaaccctcattccataggggtcctgccccataccctggaaaggaaagctccataaagaggtcaagaagaatttgaacaaacaggcttgctgggtttcccattctcaatctattactgatagattataccttttatgtccaattacatttctacgtagctgaccattcatcactgaaccgcagcataaaaacagacagtttttacgggttctttgggtctttatttctgaaggctcccatgtcatataaaaccatgatccaataaatttattatgcttttctcttgtcaaataggaatatcagcatgacacatatgagggtgacgaaaggtatcacatctttctatccctacaccagagagctggataattggtcggtgcgaggaagaaacatacatatatggcgtcagaaggggtgtgagcagagaattgggttttgcattactgatcaacataactattaagatcatatcatcaacattttaaaattaagacaaaatatgtgaaataataactagccaaatgacaaataatgtcaattgcaaatataactggactgctttagttgtataaccttagaagaaagtgaatactctcatatttaaaatatactttatcaagctaatatactaatcagcttgatgaactctaaatttttatattctactttctccggaaaaagcacagttcttagaaattctcacaggaaaaaaaatagaggcttcccacgtgttgtcattctgagatgtagagataatatttctgtgtttctacagggttggggctttctgaatgaatttgctaaaaactgagatcctgggctaagagcgacacttgagaagttaatttacaactgtatgaatagtgagaaaactccagagaaatttatgtaactgtgaggaaggtttatgtttacatttcaatgaagaatgaggcccagaaatttacagaaatctctaggttataaaagtttgagatatgggagattaatatgtcccttaaatagatatatttacattacaaaaggttagagtaagaacacatgatcctttccatccaatctccaaggagcataggtttttctcccaccttccaggagaggagagagagaaagcagcagaataagctcatttgtttttcttcctttgtctatgaagcccctggccacttctgtagaagattttttcattaggtattcatggtgttgcccccaggagtaaggactaggtgaaaggagagctgacacagacatcatcatcatcattatattacttaataagaatctatctgcatcctgaatacctcatttgcatattcaaagtaaagttaataaaggtgaatgctaaaaatcccaacagtcttaacacaacacaattaagattctgaaggaactggaaaaggacacttcaaaagataaaccaaacctgatatgaacaaatcaaaatctaagctgccgtagctatatagtttcttctgtttttaatattttgcaaaatataaaaatgtagggtaaatgatgtaataaatacaccaaggacaattaggtgaaaacttatattaattacagcttctgaggatagaaaacctttaagaatattctagatagttttatgaataaggaaaatcacttaagacaaaaatgctggagaaaaaaaacttttacttgtgtcctaaattatatggtgatcaaaaagagatctacataacttttataggcatagattcttgaccaaattaatctagatttgaattagaaagcaaaaaagtgtatattagctcacttgtgtcaaatcactaatttgcatcattgactttctagattgtcacaacatacataaagtcacaagaacttgtatagttctaagtactaagtttatcctattatttctgtgagttgagataaacattatctctcagagaacattaggagtctttcctagtctctattaaggggtcttaatcacttcctcctctgttaaatcatagaattatttgtacctttgaattcatttgcaatgattgtttcttttccttgtttttgtatagctgaaattctttccttttttcccctccctctttctcacagtacctatctagcacaaatcctgagacaggctagatgctcagtaatgctcagtaatgttcatgattgaatgtggattcttagaaacaattatttctaggagacaactgaaaaataaagtaatgctgataagaaactgaaatttgagagaccatttttaaaaatagtttcaagaatttcctgaatatctcaatttatgataaccccatttgggtgaacatgcaaacagcatcagagacatagccataaagaggttagcagtcattaactcaaatcatgacatatataatgaaatgcaatgaaaaaatagtcaaacaggtcagtctctcaaacacagaagaaacagcagaagtagtactttaaaatttcagaacatattactttgcatggatctgcatacttaatactacatttaaacgtctttgctcaaaaattacaagtttgcatttcttccagcagatataatattcagtttatcattcaagatgcaatgtattttgagttttaccatatatcatttctcaaaataaaaatggaaatcaagctctgttttcaaggtttattgccaaattcatccttccttaatttgaattttctgtaaatgtggttgggcattgctggtgatgaggtaaaatggatatattctttgtaaattaagacaatttataatattttgcattgtagctgaaaatgcacatggacaatagtatataagctacaaagcacaacataattttgtccaaattggtggaattattgttgcttattcataaatatgcagaaatgtcttatctttatggaaacgttcagctgctagtcttttcattgaaaagctcaaatacttgaaactgacaattaaataaagatgtgtatgaaaaaccgtatatgctataaatattcaacactgcttgtgaaattttatacgctggtgaaatgaaaatttctagaacaaaaatgaactgataatccccattacctagatgtttttgattttctgaataccttaaactgagatttcattcctttcctgccaccgtgtagcatatttctccaaagatatctaatatatttgtaagttatttgaaatctacaaaaaaatataaaggatgacaacaaattcaaccactagctctatcagattctagttttgtatcatagttgtgtcagactcaaatcaatgttaattcagattaatattcagattaccattcatattaattcatcttcacgttaatattattattacaaaacaagttaaagattcttttgtactcctccccagtctttctctgtttcttccctgagagctagcaaatattctaattcagtttattattcttgcacatattttttattacatatctatacatcaatgagcaatatatagtgttttgcaagtgttcatacattttataaattatataatggttttaaaaattctgtggcttcatttattgcctggtattgcgttttatctttataattatatacccaggcatgcacacatgcgcacactcacacacacacaaacacattgtattcattttaactactctgtggtattccgttggtgacatattcccaaactaattgattttgcagcatttatattgtttccaattttttactgctatgaaaatgctatacttctatgtctccttttgcacatgtacacgtgtttttatagggcatgcactatttaaagatataaagttcactttgtcctcaagattcaaccaaaatctcctaatcaattacttaacttctgtcttggcttactaaaagataaatagtaaaattttgacctcaacataatttctctcaatttgtttatgagtaactatgtattcacatagggtaatgtcataccttactagcaaaacactaccagtaatacaaataatttacatcatttaaaaataaaagtgacatgtgaaaattcatttttaaatgtaataaaatatattttaagtaacttaaaaagactcttacttgctttatttttttaattcagttaaaacataaatatatactttataagttaaattccagagtatttaacggtcaatgaagatatgttagtttcatgtgctaatagtaaaaacttccagattgctaaataaaaaaagaaatagattgttaaaaaggaaattgggaaagtatgttagctaaatacattagagaaatatgcttgccaaaaccatatatattaataaaagttgatataatgcaaggagacatgaatattatattattatgcaataattttaacctctatagaattgttggtgaacttaattcataatattaggcagaataatttgggggaactatatttaatatttggtgattaaattccattttggccatgagtcttgcaagaaaacatcctattttaaaattctttatatttaagtgaagacctcttcatttatatcaacttttatatcaacttcattatatcaacttttattaacatatatggcaagcatatttctctaacgtatttagctaacatactttcccaatttcctttttaacaatctatttctttttgtatttagcaatttggaagtttttactattgccacataaaactaacatatcttcattgaccattaaatactctggaatttaactataaagcagaatgtcaactgtgccacctcagaattcacgaacagggaatacttcaagataacaaacaacagctgcaataatcctctgtgattgagatataataaagaatataaagggaataaagaaaaaaagaaaatggtgaagaagagttatactctttttctcattaatagaactaataaaaacaaatttgacacaacatgtatttctcactaatcaaactatacaaaaatcaaactttaaagctacaactttagaagaatgctttaagaagacaatcccttccagtttttagtttatggaaattaagaatttaagcaaaaaaagcttgtggaaattattactatgcatttccaattgctttcaggagttaagataaaaggatcttttttttttttaatggcagatgctttcattcctacatataaagttcttactagaaaatacattactgacagactttcctaaattttaatctgttagacataatctagtaagtaatattaaacgggctaagtttgtatcctgtacatcatagatttgtaccacattctaggttggtgatgttcatctttgactgaatattaacttggtcaaaaccaatcagcattgggcatttggcctaaatgtatagttggtgtaatctaaatatatccagaaattgaattttattagatattgccaaattaatcttctaggtgactaccaatttacattccccaaagtttataagtttcaatttctgcaaattgtcatcagtacttggtgttgtacagctttctaacttgtatttactctgtgagggtgtcatagcatcttatttgggtttccattttcatttcttttttctttccatgtccgatgggtaatgtgcagacgttgtaacaaggtttgaggaaggcacatctcacacaagtgtgaaaacctaatcatcacacttttaaactaaaaaagaattgaggaaggcacagctcacacgagtgtgaaaacctaatcaccacacttttaaactaaaaaagaatttttcatttcttaatacctatcaagttaagcatttttttattctgctgaacttccctctactgtgaaattggttttggcccatgtttttgttttaggttattttttttttttcttattgacttgtaggatttcttttttctagagagtgcatgttttccattatataaatacctccttttaaaatgtttcacttctgtttacagtgtccctttctatagggaggttttcttggccctttcctttccttcttcctttccttcttcctctccttccttcttcccttccttctcccctcccttctcccctcctttctcccctcccttctcccttcccctccccttccctctcttctcctctcctctcctctcctttccattcctttctttttttccgggacttggtcgggaaaacagaagcctcttatgtactgtgtgtagctaagattcaaaacaagaaatttgaggccttgatgattttggaaatgcaaagtgtgtgaaagtcagaagaccactgctggctttcaggaaattcagcagttcagggaaactgctgccacatccaacaacctgacagcaccatactcctgcctgtagctgctggtggaaaataatggcttctccatcgatctcacctttcagctctcacaggtctgcctttaattggcagaatctaagcagagatatttgttggcaagagaatctgaaaaatgtagttgccagatttttggtttctacacttcaaggagtgcttagaaggtcagaaatgctactgattattgatgaatttttgcttgtgtatcttatttcagaaatcttcttctaccttaaagacacagcttttctaagccacacttttattttctaaacattttaaagttttgatatttacatttaggtcttcaacttgccagaaattaattgtatgtaacatgtaaattagcaggtccttagatatgtaagtttaaatttactaaacttctatgatgtgaaggctatgaaaataatgatacttttattattctagtatgaagaaatttaatattgtctatgtaaatgacagttaattaagaaatttttctttagtatttcagttagaatactttggactatatcacgcagcattgatcaatacctcccttatcacccagtttattttgatattttaaaaatgtaagaaatgtcaaatgtatctgctaactggtttgtaggacatagaaccacatggaggggctttgttgctcccttgtaatttacttattttctacttgcatttgcattaaatgagttatatagtaagaataaaggtagagttaataagtcatctgataattttttacgatttacattgccaacaacaaaccggtaactaaattaaagactaatttattgtatattcacaaggctagtatgcaagaaaaagcatcacaaattagttaatgcccatctttaatttgaatataaaatttgaaatggccatgctccatgtagattattaaatgatttcaagcaacaaaactggaaggctgagaacatccaaatatatttacagttttctcttgggataatgaacatttctccagtgggattttttgtaaattaaatgtgcagaggagataataagaaaacatctgagcccagagtactgactaatggctgggcaacatgcatatttagcaggtcagcttttgataagacaatagtataatccatcaataagttgcaatttggctctgtaatagatggctgttaaaaatactcaattcctttttacaaaataaaagtagtataactacaagtatatagggctaaaagaatctgtaattaaataatcttcaacaaatagagtttagagatttcatgaacaatatgaatgatagcaggaataagtctttccccgatagtaaatgtaacaaaaataaaaaaaaattcagattctcaaaaataaaatgacaaaagtttctttgggaagaattgcactaacattatttctctctctctcttttttttttttttactcttacctggacagttttaaaaatacattaaatctataaaacttgaaatatatataaatatataacacttcaaatctataaaacttgaaaaactcaaatcttgagttcagagctagtatagcatagtggttagagacatggattctagaggcaaagactctcagttcaatttccatgtctgcacttgttagctatgtgaccttgggtgagtaaggtaactttgctatgctttttatttcctcattttctccctgggaataataatattatctccctctttgggttatgccttgcatctggtaggtggtagataaatgttagctgttgttatttgtaattcttatattgaacattatgataatgaccaaagtctctatgtgccttttaaataaaatccaagcccgtactatactccaccttgcccctaatgatataggagttaagaaattatttaggcagatagtgagggtatgggaattcttggtaagtttttccttttaatgaaaagcggccaccaaatcattttcttttctaacaaagagcagcttataaaatcaagctgcaaacatagacaagcaagctggacacttacatgggtgaatgctggcagttgtgccaatagaaaaaggctatttgggactaggcatgttcaaaatggtggctccttcttctcttctctttgccagccatgcatacagtaaggagaaggcaacatggtgcaggccaggcaaagaccccatttgcaaaataagattagggtggggcagccagcttctggtgtgttatgtaaatgtcatacctggttcaactaatcttttggacctatgaaaatcagacaccacctcataagcctgtctataaaatctggtgtactctgctatgggctggaagtcccatttgggaacccctctctctcacaagaaagagagctgttctctttgctctttcttttggctattaaacctctgctcctaaacccacttcttgtgtctttgacctagattcccttggcatgagatgatgaaccccggttatttgctactgctagtttccaactttatcactcattttgtctcattctccttgctcatttagctacaggcatataactcaagctcagacttcttttaggccttcgcacttgctactccctctgcctagaaccctttgcctgtatgtgattattctttcttatcactcaggtatcaactcagataacatctcctttaagatggagtctgaacaaattagctaaagtggtctcatctgtactatctatcccattgccctgttttaaattacttctaaatgtagttctcttaccttttgttcataactttcttttatgtcttgccccactaaaaagttagtttgttatgggcaggaactttctcttattaattgttctctatattttcaatatataatattccactgggaaaagacaaaatttaagcctatgaccagattaataatttcaataataaataaattagtaaatttcaatagaagagtaaaagggaagatatgccaggtgaccaagtagaaatgatatctctataacttagcctttagagagagagtaaaatacaccagatttagaaatcattcttgaaatgtgtgttgagaggttgaagggatctgggcagaataacctactgggttttgctgaattctgctataggattatggagaacagagtgatgttttaggaaggatactgtattgtgatctcaatttctgatctgtttcccaactctagaaggaagtagtaattttctcttaccctactccctgttctctctcagaagaacaggtatgcctttattggttcctcctcacagggaaattaacaagtaacttgtgtcgcgtaaagtacctgacattatgtctcattcggatatttatttgggatgagtttcagatttctcaaaagcaagagtaaatgacagtaattgttttgagaataatgaggaagattagcctgactcaataagggagttggattctgggaggtttgagggatggaagagcagtgaaatcccctagaggtcataaatatctaagtgtatctcacacatgttttatattcaacagtatagctgtccacactttaattgtcagatcaaaccagagttgactgagaaatttatttgggagaagaatatttccccaaaaagactacatgagatttttcttgacaacgctaaagatgaagactgaacagatttaatttgctttagaaaaaggaatggggctggcatggtggctcacacctgtaatcccagcattttgggaggccaaggcaggtggatcattggaggtcaggagttcgagaccagcctggccaatatggcaaaaccctgtctctattaaaaatacaaaaaaattagccaggcatggtggtgggcgcctgtaatcctagctacttaagaggctgaggcaggagaattgctcgaacccagaagacagagattccagcctgggcgacagagcaaggcactgaaaaaaaaaaaagaaaagaaaagaaaaaagaaaaagaaaaaggaatgggatattttctccctgtctagtgtggtatggtattttcatactaggtatgcatataatttatttgttggtggaagaaggtgagagaagctcacagtcttcttagcatagtagagctaaaaatattaatcatgagtcagccaaatacttttcctttataaacacccaagagtttctgggcttccatgacaccattaatcatagaagcagatattagttcagtatctttaacctaatttttttaatattcgtgacagctgtacattgtagtaaatactgtaagttgtcttctcaatatctcccttcttccttgctaacaactctgattttgttcccagctataatctaacgatatacagcagtgaatcatgatggtctaaagttaaaccaattatttagtcttccacatactgaatattccaggctgctttgctggaaaattaaggcagaaccatatggtccagtttaggatagagacataagagggtatcttacagggattcccaggaaagattttgtatttctgataaaaggagtatatgcggttggcactgcccattttttcctttcttcatgccttaaacatgcccatagttacagtagccaacttgtgaccatgtcaccacaaacatgaaaataaaaagtgaaccctctaggcatgccacagcagaaagacaggagcaaaatccttgttgatcttgttaagtagttgaatcaagatctacctactttctcactcttcactttttcttatatgaacaaaataaaccctgattgtttaggccatggtaaggttttccattagttaaagccaaaagcaacatttaagtcactgtgtctaccaggccatttactatacttagcaattacataataaatggaccaataagataattgaaataaaacgcactttaaaggtctgttctaacatacttttttcattttatctcagccaaatgcagttttatctacccaaaactgaaaataatcagacaatggcaagtgttgctaactcaacaaaatagataatggaatacagggtgactatcattaaatagggcaggtatcatttgataggatggccaaaaacagcctgcttgttctcccactagaaattgtgagaagcatcaagatacgtgggattaatctgaattagattattttccttgaatgttcttcctaatctctgtgtctttcctcattcctttctctttgcctgtaatacttcccacaattatttttctgtgaaccaccaacctgacctttaatacgccctcctttatgaagtcttacctgatcctccctagacaaatgttctcgctcctgttctgattctgtcaatgtgagtactgtgacctcctctgcaatacctatgattctctctgttagatatttcagaaatgaaactggaatcattgtaagggaaatgtaccacagaatggacagggttagagttggccttaggaataactggatatgaggatttaaacacgaaatcctgatgcacattctatcacgttcaggaattgaataattactgcttccaagaattttgtgaatatttaaaatatgtggcttagtagaactgttttactatcatgaaagcattttataaaattcatattcagatgacatcttaattcatcaagagtatgtaaaaagatacaattgaactaaatggactaaagatgctatgaaggaaaatagcgtgttgaagaacgatgcacatatgttcgcaaacaagtataaccacaatgcaatgtgataacggttatattagttgcatatataaactaccacaaaagaaacattgaaacgtctgttaattccagctgatagaatcaggataagcattcatgaataaatatttgagatggatcttgaaggttaattggtatccaaagtcagtaggacatgcacaaaatagaaagtagcctgggcacaggtgctatggttggaaaacaaatagtatatacttggaggatgggaacaaacttcttttaaagctaggaaatctgtgggtaactatttagatagttgcagatatgcagaagaattgccactgtaaaaataagaagtaatatttaggaacaaatacacttaaaaacagatgcatcactatttctaaagccctttccgagagaatacagctcagaacccagctgttggttcacaaaattgtctactgatatgccaagataccttggaagtaggctataaacattttgtttacagatatgatatggaaatttttagttttatctctaagactaaaaaatatttataaatgtatgttttccctttttaagaatgacagctttatactctcttcccacttctgtagtttccagtctccataaacatacatttcctttaatggacaattattaatttttattttattttatttattattttgagacggagtttcactcttgttgcctaggctggagtgcaatggcgcaatcttggctcactgcaacctctccctcccaggttcaagcggttctcctgcctcaccctccctagtagctgggattacaggcatgtgccaccacgcccagctaattttgtatttttagtagagacggggtttcttcatgttggtcaggctggtctcagactcccgacctcaggtgatctgcctgcctcagcctcccaaagtgctgggattacaggcgtgagccaccaagcccagccaattaattgttaattaagaaaagaaatgtgacttcaaatatttgctaattaaaatatctttttaaaaaaattctacagttcacactaatgacaataaagtcaatgatcttactcattccagtcacctgagcaccccataaaatttcaaatataggtatgccctacaatggctactattttgcatcagtaacctcaagttacatagatattatgtatcaaaacaaaaaaatccaggtttcttctgtgaaacccacaaatatttcagacaagcagaaatgcaggctgggcatggtggctaatgcctgtaatcccagcactttgcgaggcctaggtgggaggatcgcctgaggtcaggagttcaacaccagactggccaacatggtgaaacaccatctctactaaaaatacaaaaattagccaggcatggtggcgggtgcctgtaatcccagctactagggaggctgaagcaggagaattgcttgaacctgggagggagaggttgcagtaagcaaagatcgcgccattgcactccggcctgggcaacaagactgaaactctgtctcaaataaaaaaaaaaaaaagaaagaaagaaagaaagaaaataaaagaaatgcaacatgatgcagaacaaaaaccattacgtaaacattgtgtcatgcatttcaatattacttcaaaatcatcagtggcccttttagaaaacagagaaagagaaagaggacagcatatttaaaaaaaaaaaagtttgcccatctgagcagatcacaccaattatatttgagcaatagtatattgctcaatatcattactcaatatcattactcaatatcattacaatattgatattgctcaatatcattacttttagtccatcacataacaatacttgtaaacacaatttgtctggactattatttttccttaggaagactcataagaaatcacattgtacacacagttctgagaatttaaaaatatgtattcagcattcattttgttaatttatgtttagttaatgttagtgatgtaaaaattttaacaggtagaaagaaaagcactgaaataaatagataatctcagtattatggacaaaaatgttttcatacaatgagtcattgtattctcttgtctactatttcttataccattaagatagactctttacacaaattataatttgattcaaattccctttaagatcctatatgattatctttgatactgtaacctttttaacttcttagtttctataataatttccattcatctgacttcttgagaaaatttataggagtcagtaaattttgtcaagcattctagcaataaagatttctgagtattgctacttattttactatacaacattaatgagtgctctgaccttccaagaatcaatttgatctgacagattgtaaatttatcaaatacataggaagtaacacctgttttactcgcactttaatttattagcaaagaatcctgaacggagtagaaaatcaagaaatatattatttgaatagaatttatttttcattggtgtaactagtctgtttcttatataacggtactagtaaaacacatccatttaattcatataacaattgatgaaacccaccctacccctggttcttagtgtttgaacttcaacttatttaaatagtcaaaatagctgactttaacataatgagataatagaactgtgagaaagtatttgttataaaacaagtcaacacaaaagcagaacaaactaaaagctttagttactctttagtgtgaaacaacctgaagtcttttagttatcatttataactgaccaataataatcattgcatctttgcagttcaagatgagagttcaaacattggatttccatctaacaaaagtttcattgtatttcttaaatactggatgaatagaatcctgctacttaaaactacctaagtaaataaacccgaagtcaaaaattacttaacctctgtaaaacaaactgagtcgtttcaactgtaaaatggcaatagctaaaatacctgtaacttaccgggctgttgttagggtcaaataaaattatatatgtagaaaggagctgtaaattaataatcaaatattggatatcatttcaatttgtgcaatgtaattatttaatatacatgcagcaccccagtgtttggccattttactcttctaaaatacttactggtatacacaagttgaaagccttcatctgtcccttcagtatcggaattaaattctagccagagttgatttgaagtactactaagtgtcagtccgcgcatagatgcaccagtaaaagcacctagtagatgagtcgttttatcttttccatcataaatctgcaaaatatatttataattaaaatgtaaatgtgccaataataatcaattcagagcatgtatttgtatctatgaaaaagagaaaagtgtactttttctaaatcagatcagtacatttccaaagggcaactaaatatattggtttctatgaacacaaggttaaggaagttagaattcacatgtataattttaaaattccaagcttagtgtactttaagtaatacttgaatcaggtgatatagcttcttttcttattattttaaaaatgctttttctgggagacaatttaaaattaagaatacctacctaaagattggtttctaaagttggttacttggttacttggctgtttctctgcaactttctcaagatcaaacatttacttttccaacaacatgactaacataaaatatatttgtgtctggtgcaattgtaacttttccatgctctttaacttgtttcatatttgacatttttaaaatattaaattaaaggaggtctaaatgcttttagaaactaatttaataaagcaaaaatacacaaaaatgaaactgataagctcccacacatcattctcatttttctgaaagtataactgcttattgcactctaatttgtttttcttttatcattatagacatctcttcaggtcagtaatatagattcttctgtttgagagatgtatggtgactccatcataacttgctctaccgttcccgtattaatgaactcaagtttttgccactacaagtaatgctgatataaacactcttttacgtgtaacctcatgttttttggtacttgtacttcagcaaaaaagttctagaaatatgagatatctagaaatacgggatatgaaatatgggacatgttcatatatttctagatagtttcctaaaaagtgtgtagtaattaaatccagggtttaccaacaatgcatattaccattccttttcctgtaaggcatgcattctcaacataatcattatgacccccaaaggtgtaaaaattggttcttgggagcaataatattttaggtatcacaatgatttgtggtttcccaaagatcaactctccctgacagactttattccatactattttgtttcatggagtttcatgggcttcttaggtgaacaataacaacaagaaaaattggagaatactgcttgaagttactgatctcttagctcagattgccttacttactcatggcctggtattagagtaaaaattatgttgttggattctacatctagggatcttgccatagcataaatgttcctccataattacattgatgtcacctaagagatgatgttttaggtggtacacaatggaatgttttattattattatattaatctgaataatatattttttcttatactagattgttggttttaaaccgatgatttatttagaacgtttcaatatgatctataaataaaaacttgtgaataattaacctttctttcaaagtaactttattagaatttaatgttaaggttatgccaaatttttttccacggctcctaaatgttctcttctaaccacattaacctaaacattttctacacagaaattctaagtctccactgacaaggcctttcttgcacgctccatttgtaattgatggaatctatagactcacgtgtaccctctaggcttctacagtttgtttacttgttctttacagcagagagagaaggtagaaataagagaaagtaaggaattgagaatcttaagttcaaggcgacatggtcattgaattcctaacagcaaacattacttggtctctctctttttatacactctgtcaagtttttaaaaaatgtacattcactcttgagagtatttggatactagagggctgtatacacaaatttcctaatattataagggaatatcttgaatccctggaggaatctaatttatcatgcaaataagtttctgttttagttatcagcaagaatgtatctgtcttcaacaaaaccaaaccaaatgttgaggttggtagctcaggcatgcatgatttttgtttgattacataacattcaacttttcatttcttaagaatagtagtcattgggataatgcagaggtaagaaaaccttgcttgtggcaaaatataacttgtatgtctgtgagtctgaaatgttcaatattctcaaaagtatgcttctgaatacattcattttatgattctatattacatagtaaataaattctttgtttagagctacacattcacaatcaaatcatttaaccactagatccagtggatcttatttgtggtaatattatcaaggtatccccaaataatattttccttgtgttccccttaacttctcaccaacatataatttaattgctatgaaaaatataaatataaataaaatacaatcaattgtttcttggataaaactatttctctatttatgtgtggatacattgtaagaactttcagtttgccaaaaatagtcaaataaagggagaatataaatggaacaagtaattaatgtaactggggaaataaaaattggatgttgaaatttgtttctaatttctttaaaaagtctttcctaatttttaaaaaatcttcaggagtaatgaaaagcaaaaattaatgatagtagaaactattacttgatacatataaatttttcctatatataacaatgtaaaaactaacaaaataagtcaacatttagttatttagttctaagcctttgttaggtgctgtaactaaaattaaaaaaataacatagtaagacatcattcttaacctgaagatcaaaaacaaattaacacaaaattgtctgtatattagattagaagcacacagcatacattttttttccttttgttttcttttttatttattcatttttttgacagggtgtctgttgcccatgctggagtgcaatggtgtgattatgactcactgcagcctcaacatcccccagttcaggtgaccctcccatctcagactcccaagtagcttgcactacaggcacaccccaccaagcctggctaatttttgtattttttatacaaatgggttttgccatgctgcccaggctggccttgaactcctggactaaaactatctccacaccttggcctcccaaagtgctgggattacaggcatgagccactgcaccaggcagcatacatatatatatatatatatatatgaaagaagctttttataagacacattaaaaaaataatcatttaaagaaagggcatgataaaagagctagtactttcaggaaagaaaaattattttaagtacagctgggtgaatataattcagtaacaaaatctgctaactacaatttatttaacactgttgagtcaaaaggtagaaaacaaatactgctgaagctccactataatcatcaaaataaaatgaaactggatcattcaactgttaaattttggaagcatgcataaaattgcttaatcaacatgaaaggcaagtattaattaggaagcccttaaaaagagaagatttttatagtaatgatcaagtcaatgctatttaactcataaataaaatccttcaaatttagtcaaatatatgaaaacataaaggcaacaaagggagaaagcagtgtaaccaaagataaattacttttaaagtggtcatgaatacaagcatacaaataagaaaacaaaacaaacaaaatatgccttttgttcaaaagtaaataaacagtacagagtgattaaattgggtctgactagagccgtaggacttttatttgagactcttagtgctcatatttctgttctaattaaaatcaagacctttaagtatgtttttgtttatttaagcataatatcccctttctttttgtttaatatgtattattattattaagttgacttaaggattaatatcatgaaagttattgatggcttttataatgttaatgaaattctttgctgagactttaatttgttaaaaggttgcaattgtctgattacttacaccagaacaaactaaaacttaacattgccatgttttaattgccaaaactttttgtaataaatctaggcctgaaattagttatggtgtacagactctcctgaatccagtaggttgaaccgtattacaacaaactacttatcaacactcaaaactcttgctgttgtgaatgatatgataaatatataaatagaaggcatattctaactcatttatctaatgaattagcaattaaggtgttaacatcaatccaagagcaaaaagtaaatataaaagtaaaatgtgaagacagaaattacacatgaacatatgtataatcatataaatctccaatttattcctcctcttggatcctagcatttttacttttggtcatttgttttataggttgatttggaaattaaatacattttctaaaaaggtgaattagatgtcaagtttgcatataaaataaagaacaatttttataatggtcaatcaaaaaagtctctattctaaaacttttaatattctctccaaagataatataaaatagagtagagaacttttgtttgcattcaattatttaggtttctaaaacagctacataatgtattctcaattatacgagctagtatgttttagtgaaggagaaggggcacaacgaaggaccaactttacaggggcattcggttttttgttatataatagagttgaacttccaactctacattaaagttctgcagcttattacaaatcattttattttccttatccttaatggaagaggatgaagggttttatgaggcctaacatagcagtctctacaaattggcactttgagagtgcttttgaagggagagttaatacagaattccaatgaacagcaagcagaattggcagatatgtgtgctggacatataagatcaccggtgtgctggaaaatgtttaacaaccaactctcaaacaaacaacaaacaaaaaactgctaaatgtgtatacttgtacataaggtttttaaaataacatttattgcaatacagagatattgacaaactttttctaagaagggttagataataaaatttgaggctttgagaagcataccatttctgtcacaactactcagtcctgacattgtggcacaggagcagccatagacaatatgcaaatgaatggacatggctttctcccaataaaattttacttacaaaaacaagtgtcaggcctaatttggctcacacactgttgttttccaatccctgattttagggaggtgtcgagcaatgtacaaatagtaataaaatatacaatattcatgaccatacatttcatataactaattgatttttacagaatgcttttattgtttttgccagacttttgtgtatgcaatttatgattgcaactgacaaacaagagtatttcctaaataaatactgcttgatcatctttaatgttaacaaataaaaggaaagtgaaaaatcaaaaacaggattatgtcagaacttcattagtttgtaaatgatatgagcaactaatttggttaattaaataatagttttcaaatactgaaaaaaatatttcttcaatatatagtgctactcataatgtaatgggcacagacacaacccatttccacttaaatctatgtaataagcaaacaacaagttaagccatgttttgtagcatttgccaatttctacagtgtaaatactcccattggctgacatcaagctatcattgaatgtgaatgtgatgtcattgaatgtggagttggttagagaccacagtgtggcatggtatttctaccatagggatacaatatacataaataacctcaaaagcacagataatagtaaaagtattccaataattagaaaattttaaaaattatatgtattgctcttgtttttaatataatttaagttaatttaattgtagtttaattacaatctaattgtaatataacttaatttttggcactggctatgttcaacaatcagctctcaaaattactgaaaatttaacaatagcctgtcataagtgctattcccaaagactcacacatagataggaaagaaacttgaaaataatacactttagaaaacaacaggttaataactttatcatgtctctacaagaatgttattaatcaagtcctttgagtatctaatttttcataaatgtgacatcattcctcctaaccttttctttcccagtttcaaaagcaattttgcgttactttactggcttttctccataatcatccatagtctacattttgcataagaaataaatctttagactacacaattgtaaccgtggtaaaaagattgccttgaattttggaatagaataaattcttttccaaagaataaaggaatgccctgctacattcctttattctgaacattgtccttagtttttatttgaaaataacaacaaacacagcaacaatgaaaacagaaaatagtatttctcattggtattcaattttcattctaccaggctgacaatgggagctatttgatgttaattgcacagagcctacatataataaacccctcttatgaatgttaattgaaagaattaattagattacatatttacaagtaagggtgagggaagaagttcagtatttctgcaatatcctatgccactttgaaaaaaataaaacaatcagaccccaaacaaactagagaaacattccctagatgagttaagcggagaacaaattagttaggttctgatttaggtttcttagacaggaccttgcatcttaccctttttgtaggaggaataatagaatgccaataattagacaatagagggaacatgtacctggctttctatctggagcccagaaaggtggcaaacatgcttgcagaaaagaggtaggaaaaaaaaaaaaaaagatactgggggttggtcaggcaattgatcctgagccagccacatggaattctggtgtaactcagtgtcatatacagagtaattgaaaaatgcttcttatgagcagagcagaatatactacagagagctggtagatgcaaagaggttttgcagttgggataactaggatccagcagtggatgcccaattgtactgctgacttcagaccaagtagcaaatgagagagctcagcagctgttgccacaaacagataatgccctaggacaaaatgcactttttatttttgacaacttgaagtcttgatgccaaaatatgtgcagacgttgaattggcaaatacagaattgactgagtttatcctgaattgacctagattaattttcccactgcccagcaaaaaggttgttgaaaataaaaattaggtcatttatacaaaaatcttttgctacatttcttgcaaattttgatccagactctgaaatgtattcctattacatgaatattcactgaatatttttgcaggggcaggcattgtgctgagtgctttataaacatcatttaatttaaaaacattatctaatttagtcattacagcaatcctgaatttaagtttttattattatcagaatgtttcaggggaggaaggtgagatttagaaatctggagtaattttttcaataattgtgtgactattaagtgacaggtttgagatttgaacctaggtttacctgtccctaaagcccattcttaatgacaaaataggtgtgtagaaaaataatccaaagcacaatatgttttcaaaggttagaataaatttgtgtaatgttgattgagtgggcatgtttatctaataatatatcaccaaatataaccctaaattttattagctatatttggacaaaataacatggcaatgggggaaatatttaaaagtaactatgttttataaaaatatattcacttttattagattagaaacaataacaattgaacttaattagaaaggaaatatgtttctcttgctttacatagaaagtagctgaaattatatagtaaatttgtcctttctagaagaaaagaatgtttatggagcatttactatacgacaagcattgttcctagatgctggagttaaagtggagttaaatagttcctgctgtcttatagcatgcgttctattggagaagacaaaaattaaaggaattaactatgaatgcataatatttcaggttgtagatcagtgctatgaagaagaataaatcagattaataatggaaagagatgatggaggtgagtttaccagtttataggagggcccattgaagactctgatcatatgacatttgagtagagacctgaaggaaatgagggacacagccatgtggttatcctgaggaagaatatgtaagcagaagaaatagcctgagcaaacggcttggtgttagagcatgtgatatggtttgaatgtttgtgccttccaaatctcatgtcggaatgtgattccactgttggaattggggcctggtggaatgtgatggcatcatgggggcagaaccttcgtgaatggtttagcaccatcccattgatataagtgattctctctcagttagttcacgtgagatctgctggattaaaagcgtggaacctgttgtccctttgctctcttgctccctttctcaccacgtaaaacaccagcttctcccttcaccttctgccacaattgtgagcttcctgaggtcctcaccagaagtccagctgatgttggtgccatgtttgtagagcctgcagaactgtgagcccatttaacctcttttccttatatattatacagcttcaggtatttctttatagcaatgtaaaaaaaaaagagggaggcctaatatagcatgcttggtatatttgagatactgcagggaggccattatgcctggagtggagtgagctaaaggaagagtggcaggagaaaatgtcaggcacagtaaaattacgccaaatcatagggctatctaagccatggttagggctttagattttacttataatgagatgaggaacaaaaaaaggtttagagccaaagcataacatgaaaaagggtcacttttgttgttgatttggaaacagtctatagagtatgctatggtctcaatatttgtgtccccccaaatttgtatgttaaaatcctaaccctcaaggtgatggtattaggaagtgaggcctttgggaggctaactggtcatgagggcagagttcgtaaatggaataagtgcccttgtaaaagatacctcaaaaaacttattcatccctttcaccatggagttcacaatatgaaaatgactctttgaggaaggtggccatcatcagacataatctgctagtgccttagtcttgaacttaccagccttcagaacttcaaaaaataaatttatgtcgtttataaaccacctggtctatgttattctgttataacagctcacatgatctaagatggtggaaatagggtgatcagttagaaacaatgtcagttatccaagcaagagataataatttagaccaaggtaatttacaaaggtgagaaatgattggttccggaagtgtgaagaaaagaaccatagaatttgctgaggaataatatacaaagtgtgaaagaaacaaggaagcaagaatgaactctacttcgtccttgagtaactagtttctatctactgaaatagagaaaaatgaggagagaggagatgtgtgttttggactggtgaactttgaaatacacattagtcattcaagtggaaatagttgagagatcatttagatagaaactggatcttatcacaggtcagagcagattttgcactggttgtgctgttctgtcaatgtactttaaggcatatatgtttcaaagttttttttaatgtgaacattaaaggattttttataaacaaaatatagttcatatatctttttatattccttaaagctgcagtgtcaagtgaaatccaaacctacctgtggtgtgtcattaaaattttccaaaaataagtaagtagcacacaagaaaattgtcacttaacccacttactattcctatatgtaaacattaatagcagaaggcatctaaagtgtgagtttcctatacattaatggatagaagggtatatatttgttctatcaccattataaaaacacataatcagccaaggttggtcatagtgaacaggttaaaatacccattaagtaagcaaattgaaaagaaaagatacattcctaaatgatcattttgtaccagttttgttcaattcagaatggatgcagtgaaatttcctttccactttaagtaagaatcacacgggaatttttatttcatttattattactattattattattgctttttcatggctagaaaatgttctgtttgcctaaataggattttctcagatgttattaaaattatttatccacctttgacaaatgacacaaatgaacaaaaatgttttacaaaaaaaaagtttcaatctggtataaagttaatgactcaaaattatctagtaatattgagatcaatttttattatttagagtaacagtgtgctaccttggaagcactacagtaaaatattttgatgtataaactttcttcattttaacactagagccaaagaaggatataatcataattactacattgatggtcatcagataatctggagagctttataaaaatccaaattcccacatgtagaggaactgaatcagaaaacctgggaggcgtgccagtaatcaaaacttaaaaaaaatctagaggagtcatatgatggcttacacttggaactcactggtgtaaactctactggtatggttttaaataaagttgtttatagaaagaaaggaggagagaagaaaaaagacagcagataagtgagcaagtgagtgccatcctggacactgaactctgagataaaagttgtacacgaatgtttgcatggaaatagatgtagatacacacatatattattgttgttattgttatttttgttttggtcagaatccaatatagttatgtcatacagtaaacgaaaccagaaaaaaatctctcctcctaaacttgattctcatataaggattacaagacagtgtcattccaaaaaatataatcaatgctaccacataaaagaaaaagcaatgattttaaattctctcagtcaaggggcagcagattttataatgggctatttgtttttattccttattatatgctagtttaaatatagggatctaactgactccactatgttcgatattgtaaagtactggagatggggattaactttcatggattagttttcagttaggcaaataactttccaccctaagatgactttaggctctacaatttttgagaattaatcatatgtctttttgagggttcatctttctgcttgtatataactaaatgtttccatgtcaaagggtatctttcagctaatggtttctcgttggattaatgggaagaatgaggtaacattaagcatcttacctcttattctggcagagagaccatgaagaagacaaataaggaatctaaaagttcaccctaaattgtctctatagagtggcttgctgaaattgttttaaagtaataattcagaataaatctcaggcaagcctatgaatagaaggataattgaattggtgtgtttctattataatatttagtatataatattttcaactttggggaaaatatattcttggaaaattacagaattcttaaaagttcttgaggacataaattttttaactttttaaacatataagagaaatctgtatttgaagaaatcatttaaagggccttacattgagtctttttttttttctgccttcttttgttgttccctattacatccccttgtgttgtcacttatgactgaagctccacccttctcaaggtagcacatatcagaaatgcatgtggctttactccaaataagtaagaccttttagaaagttttattttattactgaaaagaatcatttgttatcccaaataaattacccaaataataccagtataggaaagaaatgaatgaattttaagcatcacaaagaaatattttaggtagaacaataataggcatgagtgaagatgtgaagaaacatttcctgaattttagctcaccaatgcatgtttattattgttgcttctgcattacagagtagtagctagattagcttacagatcttatctatgcattgatacattttccccccataatttgcttgaaaataaaaagcactgcctcagttctatatacaagcatcctattaatctcaatgttggctccaattgaaaaaacataacttactttaacagaaacacccaaacaatgaactagaggtgggagagttttacatagtgaattttgttgccagttggagaaaaatgcagaaaataagaatgcatatattgatcctagattaatgttgaaattgtatacatctagatacattgtgagaaattttccccaaagcctatacaaatcttataagcatatcatgttattgtgttagagagccatcaattaccatgaaataatatttttttaaaaagaaactaaccaataacattaaaatcaatcattaaaaaagaattctcctgctgcagccaatttggaataacataattttttttcaagatttgtgaaaacagaagtataatgaatttttcacctggctttagaaaaacttaacaattagaaaaaagctacataactattttaaaaacatttaaatgtgatttttggaagtgtttacttttactctaatgataaatataaactatatttaccaaaatatttatattcaaaatataaatcagcaactatgaaaatatttatttgccaaaatgttatctttttagaaaagtagatatttgattatttcaaagtgtttaaataaataatgtttacaccgatagtcattatcaacaaagtatattttttcttaattgatagacattgacttgttaggtttatatattcataaaatgtatccatagtcataaatgcaaaagattcttcacgtattaacaaaaataaataagttacattatagacaatagaatacaaatagaaacaagtcactattatatttcttaaagaaatgactatcacattacatgacggtcatttgatgatgttttatatataataatttattagacaagatatttgacattaaagttttcttattttggtattattaagacattaaaatttatgtatcataaaacaaaaatttaccttttattataaaaaaattggaaacaaaacatactatttcaatgaaaacaataatagaaaatgagaattaatgtataatttgaatgtgtgaatggtagaatcaacttacggttaatactatatacatacacatatatatatagatgtatatatttatctattgatgtatatttaatgactaaaaatgaacaatatacaagtatgtctgagttcacctaccttaagaacatctccttgtgctaaatgaaatgttctggctgaaatattgattccctttcctgcttgaacctgaatactataaatgcattcatggttgttttcatagttgagtggataatttggagacagcaaaattccttcattattcgttgcagatgcaccacattcagctgcaggtaaaacagaatattgaagtacagtttaatagatagcagtatcattttcaagcaatatcatgtatggaagtgttatgcattttattttacctaaagcctagtagaaaaataatatacagaatggctttatgttgtaaatgattaattccctcctcaaataacatatgggtggaagagactacagcccatggagaggacactgtgtacaaatgaaaatatacaatagttgtagtaattttccccctggattaaaggatagcataggaaagggtgagagcatgaacttaagaatgtattttacatttgtgatttctgataaatgtaatacatttaaatttataatttagctcttttaaatgaaagggttttgaataattctaacttcatcttttaaaacatttttacctttttaattaatttgacccttcttttttctcctaatactcagtattccgctgacacaagaatttcaataataaaaagggaatcaaatattacattatctttgaaaactgatataatagttaaacccccctggtaataacaattaaacaataattgtaacaaattagggatctttagaaattatatcacctttctcagtatagaaaattagactagattaaggcattcttataatagataaaatggtactgctaaaccttcaggactaattttgcaaaatttgaggaactgtctaaacatttaggaaaatgtgagaatttctcaacaaatttagttcgaacttaattttaatgtatttaaatataaaaagcttgtggcaatattgcaaaagaaaacaataagtccttcaaattcttaaatatgtttcagaaattcaataaactaagttttctatcttatctaataaattacttcatattaccaaaccatagggcagaaatatttacattttcaaatatttaactgaaaaggaaaaaaaaaacaagttgttattttctagaaataagattttaaaaataatgatttatgggaacagtcagagaaagacaacaaggtgaataatgaattgctttaccttttaaatgcttaaacattaacaaaaataaggcaaaggaaacaaaagcctaatgaaataaaaatgatcaaaaagaagcactcagtataatatcaacattgtgtgaaataataataaaaactaatgttatggtactaatagccagtattacacaataaaagttacccctaaattccttttaaagaaaaaaaaaaatcaaagttccaatattgatttaaattactttattttaatgttacttaagcatgttcaaaaaatagatatgtccttatgcttttagctgcgtacaattataataccaaaaccagtttacaaatacaggaacaaaatgacaaaaacaataaaataaaaaatagcaacatgtatctaataaggcataagattttgttttcctaaaattaaatcgcctttggcaatgtggatcaggtaacagctgctccagtgtaggcttttgaagtttgttatacctttaattactctatgctgtgtaacaacttgattctcattcatactatgcctctgtgaactgctgagaaactttcatccatatagtgcaacataatgccaggcgtccatcacttagtggaaatcatttacattttaattctcctttatttttttctactaggtttttggaatacaggtatgtttgtggaggcatgaagacaaatgtaatctggattacacaggtgatctaaaatgcacatatatttttgtcaattagattatttagaagagaatgcaaattattttgaattattttacagagacatgaagttttgaaaatacaaatggttttagttcttctctgtaataaactgacacaatatttttcaattgcacgtctaatcttgcactttctggttaaaatacactgatgatcagcaagtcaaaatccagagaatgtcatacaaggccatttacaatgcgatcccagtgtgcctgtccagctattacctacccttctctgccatggaccttgcaatttagctgccctgagctactactggcccttggccacagtctcacaatctgagcctttgaatgtgctattttctccgcatatgaacaccacctctggtcccaagagatgtgaataaagaaaattaccacccataaggaaaattacttgatatgaaattaaattattatggttcttttcagtatccggtggctgtgatggtatattaaattgaaaaaagcaacaacccattaaaatattacggataattctcacgaataatagtcatggttccatgcttatgaatgcccagcaaaaatatcataacttcaagattttcattatatataacatgattagcacagcaagttttcataaagcttatttaaactgagaagataagtgttggcaaactgtgactgaatattcttaagatatgttaaaattgagaaaaggaactagcagcagaacagctaaccacaagagagaagcatggttagttgatacaaggaagacaagggcatatatgaaaacgtcaactacatgagaaaggagtttgagtaaagcaagtcctaacgatccaaccggtaaaggcgagttgaaaaagttatctgtcagccatagtgacatttatggagagtataccgctatcactgaacagtaacaaatgtatgactcagaagattatgtcaatgttaaggttttcagtcaggtgctataaggaatagcatatgtaaaataaaacatgcatgtgaaaaatatgttacaataaaaaagctacaaggtcactgtaatacaaacaatttatttgcttggttgagaatgtactgtaagatatttgaagtggctagaggcaaatgatagaatgctctgatttggaaaaaataaatttataggttgattccatagataattatgaaatatttattatgtactgggtggtgaggggaatagttgaagctcctatgggacctactttccagtggaaaggatggatgtctatcatacaatcactcaaataaaaatatagtatgtgaaagcatataactgagagccctgacctgtcctgaatagccaggaaagactctctgaagtactgcaacttgaaaatggatgagtaaattaaaggtgaagggagaagacaagtggggtaaaagaatattccaaacagaaggaacattatatctaaaaacattattggagggggtgggagacaaaggagataatgacaggttctaggaactgaaagacctgatatgaaaaagctttctttgtgcaaggttgatctagaggtagatctccgaggatgtttatctggtgtgatagcagaagaaatgttctttcttaggtgtgtatgaatggagaagtcattaggtgtgagctgcttgttcttgtgatggggaaatacttttgtctttaaggcttggaatgttggttgcagaatttgaagaggaaaagaggagactgaatgaggtacatttataaaattttttgagattttgggtcagaaaaccactgcttcagggtttaggggttgcaatgttttctggaggtgaggtaagcacacttcttcctaccttaacataagcccaggatcttgtttctctcatgtcttgatccagagtgagttttaagttcttgataactgatgctactaactgataaagcctatgtttgataataaggatttcctacaaaataataaatgtaaagctattaataggtagtaatgtttcctctctctaatttgaactagggggtggtgtcatctttaaatcataaaaattaataatatgaaaacattacataatttagcagtgttaggaaaatgtttggagaataagtacttagtgctctttttagcatataaatattttctgtgcaatttccagtgtacacattgtatatgatgacttttctgaaaaacaagtcctattcatataaaatatttttttatttaaatgtacagattaagatatctattcgagttaccaatatgaaactctttgctgaatatgaaaataatatgatgataaatgtggctttagttggattgaagtgggaaagaaatgtgtactgaaatttgatgataagagtcactgatacagtgaagaattcactagagcagggatacccaaaaacagacaagacatgcatcattaatctccattactgggataagaaaatctggtagcatctattgtacacatacagtcatatagttttagataaactgaaaaaatgcttttcagcaatttgactggatatctgaaaaatgtctagatcagtaaacttcatagttacttttttaaaaatgtgcattacaactgagtctttttatttttaaactgttttgtgaaagcaggcaaaatatacttgatttagattgttcaaaaaacttagaatgtttttaaacataaacatatggtatgcaagtcaaataaggagtagcattaagcagaaatatatttttccatatgtttaattattaccagaagaaaaataataatacatgattttgctcatagaggatcataggaggatcaaatccaaatcaatcatttcttttctgcatgtgaattcagattttttttcatttttatcagctattttagcccattatgttccaaatataatttagatttcatttcattaagttaggacaccattgattataaaaggcatctttatgtgtccctaaaaaagcaaaaatgttgccaatacactataatagtcattgattgtgagatacacacatatttcacagctgttagttttttaaaatggggcatctaaaaattgtgaaatatggtaaaatgtgttaataagattaatttgtgtgtgttttttttagcacttctcctaagatgccttctcaacttggcagtattaataacactttgttcttcagaaatttttagtcaaaaatattttattttcttaaataggcatttcaataatacttggattttcagaagtgggtagaaattgtagggtagaaagatacattaatttccttatgcccctactgagaatatgagaatccattggtattacttgcatacagtcttattttttctttcttttgttcttcttaggcaataatagtacttaactggctttctccttttagcctctctaaatacaatacatgtatgtatccaagggcaaactagtgctactgaaagttattttaaaaaaagagtttaaacattttttgaagaatttcaaaaaagtttcatagctactttttccccttaaacatttgtttttaatgcattttctataatcattttttaccatacagaattagggtaatctttattaccatgtggaattatatttttgtgtgtgaattgcagtcataattgaaacgcttaaattcaaaactttttaaaatcaattatatcattttctgtcaaaaatattgactatttcccataatctgacattgtcttttcattttttcttctttccatgaacagctactgaaggtctactgtgctcagttatttattaaaaataatgttcttaataaaaataactatggatatgcctgataccgtattaggtcttggggataggtcctcttcctcatgtgatatgtactccaaaaaagaggcagacatggaaactggtacatgcactaacatgtagtctctagtatgatacaagttcatgtaataggctgagatggcacaaatgaagaagtagtatattttaaagaagccacaagagaattacattaaggcagacttcatgactgtgtttttcttgatttgagaaagaaatgtggttccaaacgtaatcaaattgtacaaagaagggattccaggcagagtgaaatacttgaatgaaagtataaataggtaaaccaaattgatactagttagaagaaccagtgattcatacgccattctaagacatttgaactttatcttgtaggcaatggagattcatagaagagttttaaaaagagaaaaacatgaccaactttgagaaatccattagggcagctctatgaggaatgaattgtagtcttgggttactagaggatgaaaaccctagagaagattgttgtagtgctacagacagaagatgagagcttcaactaaagcaatggaggaagaggagatgccaaagtaaaagttagaacttggagacaagttcgatgtgggggcatgaaagagaggaaaaggtagagaagacaatgagtggctttgattataatgctgatgaatgtatttttgcacaagataaatttggtatgcctgttggacgtcaagtaaagtactccaagcagctagacatatttgtacccatgagattgatcttttaaagccacagacaaaaaggtttatccagagaatacacacatatatatgtacacatattgagaagagaagcaaaataagaccaaggtacactcagcaagagaatttaacaggtagacaaaagggacattcaaagaaggtagtatcatggaatagtaaagagaagatagttttaagaaaataattgtcatcagtgttaaatcagagttcaattaaaatgaatactgagagtacattgatttgggcaattaagagtttgggaagaaaggaactataatattgtctgtaaagggtcaggggtgatacaggtttgaaggaagggtctttttgttttttgatgtttttgtctttggttttgttttgttttttggttagttttgaattaaaaacatttcagtacatttatattttaagtgaaaggaatagtacaggggaggagccaagatggccgaataggaacagctccggtctacagctcccagtgtgagcgacgcagaacacgggtgatttctgcatttccatctgaggtaccgggttcatctcactagggagtgccagacagtgggcacaggtcagtgggtgcacgcaccgtgtgcgagccgaagcagggcgaggcattgcctcacttgggaagcccaaggggtcagggagttccctttccgagtcaaagaaaggggcgatggacgcacctggaaaatcgggtcactcccactcgaatattgcgcttttcggaccggcttaaaaaacggcgcaccacgagattatatcccgcacccggctcggagggtcctacgcccacagagtctcgctgattgctagcacagcagtctgagatcaaactgcaaggcggcagccaggctgggggaggggcgcccgccattgcccaggcttgcttaggtaaacaaagcagcctggaagctcgaactgggtgtagcccaccacagctcaaggaggcctgcctgcctctgtaggctccacctctgggggcagggcacaaacaaaaagacagcagtaacctctgcagacttaaatgtccccgtctgacagctttgaagagagtagtggttctcccagcacgcagctggagatctgagaacgggcagactgcctcctcaagtgggtccctaacccctgaccccccgagcagcctaactgggaggcaccccccagtaggggcacactgacacctcacacggcagggtactccaacagacctgcagctgagggtcctgtctgttagaaagaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaatggaacaaagctgaatggagaatgactttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagtcgatgcgatcaactggaagaaagggtatcagcaatggaagatgaaacgaatgaaatgaagcgagaagggaagtttagagaaaaaagaataacaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccataaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagacaagaattttcaacccagaatttcatatccagccaaactaagcttcataagtgaaggagaaataaaatactttacagacaagcaaatgctgaccgattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcaatgtgctgtattcaggaaacccatctcacgtgcagagacacacataggctcaaaataaaaggatggaggaagatctaccaagcaattggaaaacaaaaaaaggcaggggttgcaatcctagtctctgataaaacagactttaaaccaacaaagatcaaaagagacaaagaaggccattacataatggtaaagggatcagttcaacaagaagagctaactatccaaaatatatatgcacccaatacaggagcacccagattcataaagcaagtcctgagtgacctacaaagagacttagactcccacacattaataatgggagactttaacaccccactgtcaacattagacagatcaacgagacagaaagttaactaagatacccaggaattgaactcagctctgcaccaagcggacctaatagacatctacagaactctccaccccaaatcaacagaatacacatttttttcagcaccacaccacacctattccaaaattgaccacatacttggaagtaaagctctcctcagcaaatgtaaaagaaaagagattataacaaactatctctcagaccacagtgcaatcaaactagaactcaggattaagaatctcactcaaaaccgctcaactagatggaaactgaacaacctgctcctgaatgactactggatacataatgaaatgaaggcagaaataaagatgttctttgaaaccaacgagaacaaagacacaatataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaagcaagaaataactaaaatcagagcacaactgaaggaaatagagacacaaaaaagtcttcaaaaaattaatgaatccaggagctggttttttgaaaggatcaacaaaattgatagaccgctagcaagactaataaagaagaaaagagagaagagtcaaatagacacaataaaaaatgataaaggggatatcaccaccaatcccacagaaatacaaactaccatcagagaatactacaaacacctctatgcaaataaactagaaaatctagaagaaatggataaattcctcaacatatacaccctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaaccgaatccagtagcacatcgaaaagcttatccaccatgatcaagtgggcttcatccctgggatgcaaggctggttcaatatacgcaaatcaataagtgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgtcctctctcaccactcctattcaacatagtgttggaagttctggccagggcaattaggcaggagaaggaaataaagggtattcaattaggaaaacaggaagtcaaattgtccctgtttgcagatgacatgattgtatatctagaaaaccccattgtctcagcccaaaatctccttaagctgataagcaacttcagcaaagtctcaggatacaaaaacaatgtacaaaaatcacaagcattcttatacaccaacaacagacaaacagagagccaaatcatgagtgaactcccattcacaattgcttcaaagagaataaaatacctaggaatccaacttacaagggatgggaaggacctcttcaaggagaactacaaaccacttctcgaagaaataaaagaggatacaaacaaatggaagaacattccatgctcatggataggaagaatcaatattgtgaaaatggccatactgcccaaggtaatttacagattcaatgccatccccataaagctaccaatgactttcttcacagaattggaaaaaactactttaaagttcatatggaaccaaaaaagagcccacatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagaaatggggaaaggattccctatttaataaatggtgctgggaaaactggctagccatatgtagaaagctgaaataggatcccctccttacaccttatacaaaaatcaattcaagatggattaaagacttaaacgttagacctaaaaccataaaaaccctagaagaaaacctaggcagtaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttaaaagaaaaaaaaaacaaccccatcaaaaagtgggcgaaggacatgaacagacacttctcaaaagaagacatttatgcagccaaaaaacacatgaaaaaatgctcatcaccactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatacacacaaaggactataaatcatgctgctataaagacacatgcacacgtatgtttattgcggcattattcacaatagcaaagacttggaaccaacccaaatgtccaacagtgataaactggattaagaaaatgtggcacatatacaccatggaatactatgcagccataaaaaatgatgagttcatgtcctttgtagggacatggatgaaattggaaatcatcattctcagtaaactatcgcaagaagaaaaaaccaaacaccgtatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacacatgtaactaacctgcacaatgtgcacatgtaccctaaaacttaaagtatatatataaaaaaaaggaatagtacagaggtggagggtgactggggttttaaaatgctatctctgagtcagaacacccaaaaatcgaataacttaaaactaggctaagaagtcacttgaaaaaaatctatgtgatttttaaatataataactcaagacatggatttaaattccatgtacactataattactactatagaacacgatatatataataaaaaatgctaccaaaaatgacaagaaattctacagtagttttcaaataaatggctctttatttaaaattcactgaaaaaatatgaacattgtgctcaaaatagattgctttgttttcattattttttgaatactgcatattgggccaagagtattattgatttataacgacaagacctttagagagtagacctttgactacctcatttaacgcaaccgataagaatggtattataataaatatggctatgtcaaaaatgtttctatataaatattccttcctccttaaaatacattttatacatttttgtgatgcaaagagaaggcaatcctttatgcaacagttttgttttcatgtcttttagtcaaacggtcaaaccaaattgtagtgttaagtatcctgagagtaaggaaacatgtcataatatttcttatatctcatgatttttttttcttttcttttctttttttttgagacggagtctccctctgtcacccatgctggagtgcgatctcggctcactgcaagctccacctcccaagttcacgccattctcctgcctcagcctgctgagtagctgggactacaggcgcccgccactacgcccagctaattttatgtatttttagtagagacggggtttcaccgtgttagccaggatggtctcgatctcgtgatccatcctccttggcctcccaaagtgctgagattacaggcgtgagccaccgcgcccggtccccacgatccttatatacttctctagaccctgtgaaaacccaataaatactgctaattcaataacaaggaggtaggaatactaagaaaaagagagattcattattcttggaagtgtgagaagcagtaattgctgaaaacaagaacaaaatatacttcttttatctaatagatattttatctagtatagattttttaatctaatagattaatttctctgcatactatatgcacaccttatctgaaggtgatatgagcaatagcaatagctagtagtagttgtgaagtgcttactattctaattctttaaatgcacttcccggtgaagtaaccctgtgttttggaggataaatttaaaaatgtgagtggtggaataaggtgcccaagatcacataatgggtgaactttaagcacagatagttctgtctccaggcccaagacactcaaccccttcatgatatttccactcagaggcgaataagatacaaacatacaatcaaggaacttcactttctcaaggactataggaatttctataaattactatactacaaagcaaaaggtgcaagaaagtaagagataatctgcacaggtttaaggagatagatattgcttctgatgaaaaagtcagagaatgcttcatcaagaaggtagcattttggttgcactttgaagaattcaaagtgggattgtgattggctgagaaaagaaaagacagattcaggggaaagaaggcaattcaatttaaacatattaattttcctggtattggggaaaaagggaaaggcaggagtaacttttagttttacttagttcaattaatatttttatatagtgtcccttctaatttcataactgccttggcaccatggaaatatgctctctacgatgagttaattaaatacttaaaattatacttaatcctaaaccataggtattagggatgttaaaaacaatttttctatttatagattgaaatacaagtttcaggttaagcataacgttaataaagttctctagcagggcagaggaaaaagagaagccgatgggagcagatagcttcctgtgcattttcttctattactttagagtggtcactgtctaacaatttttaatgaaatgataaggaagcaaataagccaaacattcttaaatattaggatgatttttatgttattgggagacccccaatatctaattcaatgatccaatgttatagcaaacaaaacttttaaaagatttttttcagcacatttaaagaaaagtttataacataatcagcacttgaacaaataaagggttaggggattgactctctatgcatttgaaaatttgtcgcctgtaaccccagcactttggcagggcaaggagggtggaccacctgaggtcaggagtccgagaccagcctggccagcatagtgaaaccctgtctctactaaaaacacaaaaattagctgggtgtggtggcgggtgcctgtaatcccagctattcaggaggctgaggcaggagagtcatttaaacccaggaggcggaggttgccgtgagccaagatagtgccattgcactccagcctgggcaacaagagcaaaactctgtctcaaaaaaaaaaaaaaaaagaaagaaaagaaaattagtgtctaacttttgacttccccaaaacttaactcctaatagcctattgttagcccacagcatcaccgataacatagtcaattaatatatatttagtatggtatatgtattatatactatattcttacaataaagtaagctagagcaaaaatgttattaagaaaataataaaaaatatatatttatagtactgtatttattgatactgtaagtttatgttattggcttccaagatgaatcaaatgtctgaaatggtaggcaatcacagctgcagacatcagtctatggtacatatcaagcaattcacatttttgggtagtggggtggggagagagacaaagtcttgctctgtcatacaggctggagtgcagtggcactctctttgctcatgcctcagcctcccaagtagctgggactacaggagcatgccaccatggcaggctaatttttgtatttttagtagtaaagggcttttaccatgttggccaggctggtctcgaactcctggcctcaggtgatacacccacctcgccctctcaaagtgtcgggattgcaggcgtaagccactgcatctggcccaattcacattttttcttgtaatgtagtgacatttttctgcttcttggaagtacttccagcattgctagtgtcacttcattcccatggcattattcagtttattgtattgcattaaacaacaaaaaatatctgagaaattacacaaatcaaattttactgcactatgcagtttactggagagacaaattgctgatgtggagatgactgatgctacatggtactttaagcaatacttgcaacacttgggctcaccataatagcaaaaagaagtggctaagaaattattactctagtacagtatgtactgtagttaattttgtgcagttgtgattttatatggcatctttatatttatttacattcctctccactgcaaattgtgccatgtatggtctgtaagtgtttgtgtgggtaagtttgaaaaaatgttaattttttataatagatttgtggacattttatggtagtaaatgataaaatagactgatgtatacatatattttatgcattcatgacatatctaagtttttctctttttttatgttacatggttcatctgtgagttctttcaaattgtcacaaatctccaaaaagttttctaatatatttatccaaaaaaattgcatattagtgaacctaaatagttcaaacttgtattgttcaagtgtcaactgcatgatgaatgtgtaaggaatatattaggtaagttaaggcactggtaacaaacaaaaatcaaataaaaccaggtaagaagttaatttatgagaaataaaatcttcattatgtaaatctagtcacttaaactgaatattgattcagattttattgaataaataatattaattttttttcaatttaagatcatcatccattcccacttatgctctccaaaactaacattgtttaacatttttcaaactgcaatttgcaaactttcagttaaatgaacattttttcagttggaaggtagaggggcaagggagatttttactgcattactcatagtaaatattcaaaaagttcagaagaccttaagaactgtttgcagtagagtttgaagccaggtagtgtgatgcctccagctttgttctttttgcttaggatgtcattggctatttgggctttttatttttgcatcaatatgaatttttagagtagtttttttctaattatgtgaaaaatgtcattgatagtttgataggaatagccacagatcaatacaatgaaaacagcgtggtactgatataaaaatagaaatacagaccaatagagtaggttagagaacccagaaatgaaaccatacacctacaacgatctgatctttgacaaagccaacaaaaacaagcataagggaaaggattctctatgcaataaataggtagtgttgagatgactggctaggcatatggagaagattgaaactttactctttcccctttcatcatatacaaaaaccaactcgggatggattaaagccttaaatgtaaaacctaaagctataaaagttctgaaagaaaacctaagacatgccaatacctagctcctggcaaaggtttcataatgaagatgccaaaagcaatagcaagaaatacaaaaattaacaaagaggacctaattgaactaaagagcttttgcacagcaaaagaaagtattaactgagtaaacagacaaccgacagaatatgagaaaatattcacaaaccatgaatctgacaaaggtctaatatccagaatctctaagaaccttgttagcaagcaaaaaaacagacaaccttattaaaatatgggcaaaggacatgaacagacacttctcaaaagaagacataaatgtggccaataagcatataaaaaatgttcaacttcatgactcattagagaaatacaaatcaaaaccacaatgagatatcatctgacaccagccagaatagctattaataaaagtcaaaaaataatggatgctggtgatgctttaaagaaaagggaatgcttatacattgctggtgggtatgtaagttagttcagtcattttggaaagcagtttggatatttctcaaagaagttaaaatagaaccattatttgagccagaaagcccattactgagtatttactcaaagaaatataaattgttctaccataaagtcacatgcatacatatgttcattgcactattcaaaatagtaaagacatggaatcaacctagatgcccatcaatagtggactgcacaaagaaaatgtgatacatatacactatggaatactacatagtcataaaaaggaatgaactcatgttctctgcaacaacatggaaagacctggagaccattatcctaagcaaattaatgcaggaacagaaagccaaataccacatgttctcacttacaagtgggagctaaacactgagtacacatggaaacaaagaagggaacaataaacacaaagtgaagggtgggagggcagagggtgggagtagggcaaggatgaaaaaaaaaaactacctattaggtactatgctcgttacctggaaacaaaataatctgtacaccaaacagccatgacatgcaatttactcatgtaacaaacctgcacatgtaccccctgaacctaaaataaaacttggaaaaaatacctgttttcacggctcattttacacaaatgtaatcttaattaatttatattatgtttaattgtgattaatttatcacaaagaatttctagcataatctgtcaatcctgcccttcattctaataagtttaggcctttaaagcagagatatggctctgtaccttacacttaaagcaacactagctaattagatgcacaggatggtgaaacaggagcttctatcatcatcctctgaagcagcctcaacttaaacaagtatctacaaacaaaagtacctttgtggaaatctggaagtccagtgaagaagttccagcagactgtggcatcataaaatccaaaaactgacttatcaaaggaagaacagtatcaggttacctatgtcgcctgtaccccagggtggcacaggttgatgccaagagaagcccctacagcccatgatttctcctacatggaaagtaaaggcatagtgactgagtgcctgacacctccagcatgcagaacactgcctaatagactcacttctatcttgcttcacctagaatcctgaagtggttgacactgctcagtaactgggagaggctggaaagagagaagggaggctgcagaagctactaatagctccactgactccatcagagacgctaccatgagatgtatgggatgctttgcctccagaaccccagatcatccaggcagataatcaacaaagaaacactgtacttgaactaccctatagaccaaataaacctaacagatagagcatttcacccatcagcagcagagtacacattattcttaaatgaacatggaatattcttcaggacatatcacgttaggtcacaaaacaagtccgaacaaattcaagaagactgaagttataccaaggacctttttcaacttaatggtatacaactagaagttggtaacaggaggaaaactagaaaattcacaaatatatggaaattaaacaacatgattgtgagcaataaatggttaaaagaagaaatcaaaaggaaaatttaaaaatatattgaagcaaatgaaggaggaaacatacaaaaccttatgggatgcagcattgtccaagagagaagttttcagtgataaatggctgcatgaagaaaatagaaagatctcaaataaacaatccaactttacccctcaagctatgaaaaaaaaaaaaaaaaaaaaaagctaagctcaaagttagtgaaaggaaaaggacaaagatcagagcagaaataaatgaaatggagactaggaaagcaatagaaaagatcaacaaaccaagagttggttttttgaaaaaataagccaaatttgtaaacttcagctatactaaagaaaaaagagagtctcaaataaataaaattataaatgaatcgtatcataagagactaccatcacaattacatgctaacaaattagataacctagaataaatgaataaattccaagaaaaacatgacttacaaagacttataaagaaatattaatataaatagattaataatgagtgagaagtctgattcactaattaaaaatctcccatcaaagaaaagctcagaaactgataatttcattgtagaattttatttaacatttaaagaataattaacaccaatctttctcagactcttccaaagaactgaagaggagagagcacatccagattcatttaaaaggccaatattaacctgacaccaaagacagacaagatactaccaaaaaaatttacaggctaatatccatgatgaacatagattcaaaaatcctaaaaaaattttaacaaaccaaattcaacagtgccatgatcaagttagatttatccctgggatgcaatatgtttcagtttactgtacagatactaataaacatgatatattacattaacaaaatgaatgacaaaattatcatctcaatagatgcagaaaaatcacttgacaaaattcaatatcctttcatgataaaaatttccaaaagatgaggtaatagaaagaatgcacctaaacacaataaaagtcatatatcagaagcccacagctgacatcaaacattgaaaagctaaaagcttgcccaacaagattaggaacaagacaagaatgcccactctcactaattctattcaccatagcactgaaagttctagccagagcaactaggaaagaaaaagaaaccaaaaccatccgaaacataaaagaagaaggcaattgtctctgtttgcagatgacgtcatcttacatatagaaaactctaaagactccaccaacaaaactggtagaactaataaattaattcagtaaaattgcaggatataacattaacatataaaaattagttgtgtttccatatactaacaatgaactattcaaaaaagacattaagaaagcaatgccatgtataatagcataaaaaagaataaaatacttaggtagaaatttaacgaaggaggtaaaaggtacactgaaaacaataaaacattaataaaaaaaattgaagctatgaaaaaattaacatcctgtgttcatgggtgagaagacttaatattgtagaaatacctatacgttccaaagcagtatacaggtttaattcaattcctatcaaaattccaatagcattttacacagaaatggaaaatcaaaccagaattcatataaagccatatagctaaagcagtcttgagcaagaagaatgaagctgatggcatcatacttcctggtttcaaattattacaaaacaaaacttatcaaaacaatatgataccagcacactggcatgaaaactatatatatatatatacatacacacacacacacgtatgtgtttttatataatttatatatgtatatgtgtgtgtatatatatttataatagaaaacctcaaaataaacccaggtatatatggtcaattaatcttcggcaaaggctctaagaatatatgaaggggaaagaacagtctcttcaataaatggtgttagaaaagctaatattcaaatgcaaaaatatgaaactggctctttatcctacacatatgaaaaatcaactccaaatgaattgaagacttaatcatgagacctgaaaccttaacacttctaatagaaaacagaaaaaagtgctctataattgtaatttcagagatgattttttggataaaacacaaaaatgcaaacaataaaagcaaagataaacagatggaactacattaaactgaaaagtttctgcccagcaagggtaacaatcaacaaaatgaaaagacaacacatggtggcgcatgcctgtaatcccagctactcaggaggctgaggcaggagaatcgcttgaacctgggaggcggaggttgcagtgagccaaagacgcaccactgtactccagcctgggtgacagagaaagatactgcctcaaaaaaaaaaaaaaaaaaaaaaaaaaaaaaagaatagaagaaaatatttgcaaaacatatactcgataaagggttaatatacattaaattcaagaaactcatattattttattttttaaacctcaagcaaccctattaggtaatgggctagacgtttcagtagacatgtctccaaagaagacatacaagtggtctacatgtatatggaaaggtactcagcatcactaatcatcagagaaatgcaaatcaaaaccacagtgagataccacctcacatctgttagcatgtctattgtaataaagaaaaaagataaaaaatgttggcatggatatggagaaaggggaacccttatacattgttggtgggaatttaagttggcacagctatatagaaaacagtagggaggttcctcagaatattaaaaatagaactaccatgtgatccagcaatatcacttcagggtatataaccgaaggacataaaatcactgatatctgcatcctcatgtttattgcagtagtgttcacagttgccaagatatagaaacaaccaacctaagtgtctattgatggatgaatgggaaagaaaatgtaatatatatatatggaatattattcaatatggaatattatttagcacttaaagagaagaaaatcctgactttgcaacaacatggatgaacctgcaagacattatggtaagtgaaataagccagacacacaaagacaaatgctccatgatctcatgtacatgtgggatctaacaaactcgaactcacagaaacagagtagaaagttggttaacaaaggtggggggtaggggaaatggtgagatgtcggccaaagggtacaaatttacagctgtaagatgaataatttctggagaccagacacacagcatgattactatagttaatagcattgtattataagcttaaaatttgctgaagagagatcttaaatattctcatcatgcacacacacacagtgtaactatgtgaggggatggatatgtaaattagcttgattactgcaatcatttcacaatgcagatgtataattaaaacattacgttgtatatcttgaatacatgcaagttttatttgtcaattatacctcagtaaagctaaaattaaaaaaaaaaaacccacaatgttaaggagcctcagcaaaaagtacaggaatgtattgatctctttggctccctgttctttgggtctcaaatacagtttcaactgtctaatatttccctagttcccactatcacatttcaaatggcagtgatcaatatgggacttccccagctgtttgaaatacacattgttgctgatttcaccttttattctcttcttactggtaataaaaaaaaattgtatatgatcgtattaaccaataaataaatgtccaaagaccatttttactagtgatttttgagttctgcagaattcataaagcaggtcttttttcctaacgctttgcaaaatgaaagaaaacaaataaacaaaaaaaggcacatgaggaaagtgtctatgcctgactgcctcctgactgcatcagctgagcaccatcttctgattttcatctcttagctcttctctagaggctgaatggagtggacttcatgccctgggagtatactgagcctgcaatgatggccttctctttggccaatgtattaaatatcactatttcaattcagaaagaagcttcatgctttcttcctctgtatcttcgagttgcattgaaatgcatcatgcaaagtactcaataattatatactataaagcaaacaataactcttggaaaatgtgacattatagatgaatttttaagatgtgagaggatttactatggactaaagctttattgtaaaataattatatgaagaggaaacaaaatcagtatgtgaacaattcttcattatgacaaattttagctcaagtgtttgaaatttcatggagatggaatgactgagaaatgccacgcataatgcaggtaaaccttgactttacatctgtgaatacaaaaattaggagcaagcctcccaatcctaaaccatatccaggtcagtaaggtacatctggttgatgaatatcttcccaaaagcatttcttataggtatcatggagaatatttacattctctgaagtgtaccaaatttattcaaggaaataaaccatcttgggtttaaccactttaattttactagtgagttattgtcttctttatgttaatagccaaaagagacataaaagtttctttagagacgagtagtccaactttcaatgggtacttagaatttctataacaaaaatctaaaaattttaaaataaataatgagaagcatgatagctaagtattgatagtgtttagctgtatgctttgctctaaaacatgctctataatagactattggctttttagatggctgtgtcattcaaactagatctgactcataagtactagggtggcatttgttgctggcaacaacacatgttgagtcattttatattcccattacagattctagctaatgaaattaaattcagaatgtgccttctttgtctactggactgcaagtgtgcatacaaaatacacaatttgacaatataaaacaaaatatattcaaatttcacttatgcgacataaatctaagcatgtaaaatatagcattctgaattaaaatattacattttaaaccattgatagattaatacaaatcctattacaaagcagtcactttgctatttgctgggagtaagaagaattaaacaaatagattaaatgataaattgctttgtgatgcgctaagtgccataaaaacaaatatgaacaagtttggtgggagtactgtgaatgaaataaccaattttacctatattagttgaggaaagcccagagataaagagaacctaatcaggttttaaaagcataaaatacaacctgctaaaacaattctataatgcctttgattttcctgagaaaaaaatctcatttcattatggttcttacgatcattagacaaattatcagccaggtataacagatatatgaacactaaattttatttcagcagacctaaagtctgcatggatgtaaataaaaaactatccctttcattggtcttcaccacagtagtttcttaggaacagttgatggggttcagattctttgaggatttttcaccttatattgtagctttgcattctcgtcttgtatccaaatggtgtgggattaagaaatccaaagaatttagggaagagattgcagtatagggaaacatgctaagagactataaattataggatcagctggagaacggcaagcagaccctctcgaattcttcatagcaacactaatagttctaaagtagataagctgtgatcagagttgggaaacagcgttcttctgaggacattttcttaaaaaagaaaaacattgtgatcctgcatgtatatttttagacaatcccagttaaaaacatttctgaactctttctttctttgttctttttttttttttttttttttttttttcagatggagtcttgctctgtcacccaggctaagtgcagtggctccatcatacctcactttaactttgaactcctgggctcaagtgagcctctagtctcagcttccagagacaccgaaatcacaggggtgtacaccaccaccaccatacgtggctaattattattattattttttttttgagagacagaggagtgcagcggggagggggatggttgaaggggtggtctgagattcttttttgcccagactcaccttgaatttctggcttcaagctatcttcccaccttaacctccaaaaggtgctgggattataggcagcaactaccatgcccagcctaaagtctaacctttaaaggaaagtctatgtgttataaaattactgagaagaagatcgtcagtctacaggtggtttaattgttcttttaaaaggttgtcacctaaaggtgtcttaattttattattcctttatccatgtttgctattctctgtttttctcccactgctcctattttctcccctactgttattattacaatagaggtttttgttttcatttttttggtttgcttgcttaaacttctttggagaaaaagtgctctataaagcataaatggaaaggagaaatcctcttgtggtagattacatatatggagttttattttatattaatttaaatcatgcacatttgaaataccttaaaatattaattcttactttacataaacagtttcaatttatgtaaataactcaataaaaataataatcacataatttcaaagatgtgaaccaaattggttgtaaaccatgtttattttgaaatgccacatggccttataccttcattttaactggaaataccctccagcctttggcacactacactttgcaagagaaatactatggagtgattgtaggtgacattcttacattcatctcacaaatatttgttgagcatctactatgtaccaaacactatgctctgtgctagagatccagccataaaaaaaagagcaagaaagataaataataactgcctttttcatgatgtatctattctcctgagcagataagacaataaccaaatatagaaaaattaacagattaggccaggcatggtggctcatgactgtaatcccagcactttgggagtccaaggtcggaggattgcttgaggcctagagtttgagaccaacctgtgcaacaaagcaaaactttgtcgtagaattttgtttttatttaaaaacattggtagattaaacaataagtcagatggttgtatgtgctaaggagaataagcaaattagaaaaggaggataggaagtattgaggggatattcattaaaagtcactttttagcagagaactgaaggaagcaaatgggcaactatgaagatatttgggaaaaagcattgcaggcagagggaatagcaaatacagggcaggaggatgtgcttggcctattgggggaaatggcaaggggaaccctgcagctggagtgccctaattgccatggtagcaaactcaccactccatttccacttttgctccccagagtctatttgcaacttagagcctgaatgagccttttatgacatatattctaggatcactatatgtttgtccctttgacaagcctttgctcagaatcctttaatggctttccatcttattctgagtaaaaccaaagcctttgtaatgacccacagaaccccacccggtatactgttatctctctgccctcaccccatctttttctcctccttactcattcaactttcaatgtcccccactcccagggccgtttccccaaaacacaaatatatatacagtaacaaaccacttcaggatgaagtgaatacttctattagagaggttctgtgtatctgttccatctagagctttttatttttagaatttctttttttagacttacaagtaaccatttccttttaaaataaagtattttaaaccaagaactatacaaagttagatattgaattttattttttagtttaaatcccatgttctattctcctctcagggatccgttatcaggattggaatttgaatatttcaaaaacctcttaaaaagtagtttagtacataaatgctaccttttactctggctggtaattcaatttcagataccgtgtttaagtttttgaactactctacagttgtttttatggtctagcataaaaattggagttgttgagttagtttcctaaacttatccattagatattgagacaactgtagacataacaagaaaaaaaaactgtactcatatcttctagggctagaaaataacaactggtcttatagaatatacagtttaaagtttgtacctagtttgaaaagaatatagaaccaatgacaatttttaagtctgtatttcgtgaacaaattttgagctaaacttggaaagtaataaaatctccctctccttccacttagatcatgcaaaatgtagcatatcaaattctaccataaaatgcatgaacttgaactgtccgaatgcatagtggatgagactaatttaggagctttgaaccatgacagtatagcatttgacaaaagttgaacaaatatgggctcttgtccccaagagtaaacctagttatagaacctaaacacattttccaaaatgcctttttaaatgtccatagagtagtcatgatattactgaacctgcaaattttaattgagagttttttttatctttccagatagttaagatagcacagtaattggtacctagaagcatgcagaaatctactttggcccaaagcaaaaaagttcaaataaatgatttttacagtcatgttggacaacatatagaatacgcctacatcatgaaatttaaccaataatataactactagatgcaattctataataggctgtcaccaaacatggctcttaaagaaagacaaaattgtaacctatatactataaaccatacgaaaaaagagttctggtattctggagcagttttgtgggcatatgtctgttgccctttgggacactggagctgctatagccaaaatgtaacaaaggaacggtgaaaatagtatattctattacagaaattccatctgcacaaggaaatattgatgtaaaataagtgttggtcatgttttcaccgaaaggctccaacaacttatctctggaattgagaaaagaaaatccctttctttgttatttaatttgtagaagcagatacttccatgaacagtggccatgaagcttctttgtgccaccatcgaaatggtaatgtttgggaacttcactttcattaactacaggcacaacttaatacagtaattaaaagtgactcgagtcagaatacctgagtcctcatctaggctttacctatgtgactttgggcaagttacataatctcaagtgccttcatctgtgaaatcagtataattacagtgccaaatttgtggttgctgtgtagattaaataagttagcatgcataatggatttggaacagagtcgtataactggtaagtactcaaaaattatatctattattatctcagtttatcttcatgtatgacataagcatttttagtggtatttttattttaaagataaagaaatatatatttaatgacatctacatatatagcttgaaagttacatatattgtgatcttcgaactgcacagcactcctaccatgtgagataaataagctatgggcatttattgaatgcttgaattcagaacattatattaatgaattatggcattgtcaagtagtcaagtagtccctcaccaacaatcaatccaatgtctaatccaaccacaagggtcacaagtgcagcaaatggaatgactcaccactctttcatggatttggctggtaaggtgacaacacatggattcagacagtttattacacagacaggaaacacaagatcagcgtaatgtcagttccctgaattctttgtcccctgggatgacaccaaacaggccagatggcagatggcatacaaagaggtacataaagcagtagtcctgcccaatctcattggcagctgaaagcatgtatattgaagggaaggaaaggtcactctgtcattgaggaaataattctgaattacagccaagcatttttaaaggcttatatagaagcctgaaaatgtacctttaagagggaaaatgtgtaaagtcctgtgttcaactgaaactagggagatgaattggaaaaggcctggtggcaattccacattaggctgcttgtctctccttattacataaggaaccccagaacattctctcaagaattgtgtcagactgaagatgagcctcacttatgtgacctacgtggaaatgttcaaggtcatcaggacactcattggatagtggagctgtttctctataggcttatcttccttgacaaatttcagagtaatgcatgtgcaaaatcttcacaataaaataatatagattatgtatagttaggtaagcaatagattaatattaaatgcaaacctgatcttccatgtctcaacacaaagagaaaagaatattgatttataacttttttcttatttgggcaaaatattggcaatctgtggtgtaaaacatgcatacttctggcccaggccattattaaaatggaccagataagtgcatgaattaatgtttaaaacacaagtaaaatctttgtaatttggggtagattatgtgtaaatacacctaggagaaaacaaaccacaatagctaaaaatattcaagcacattagtaaagtacatggcagtttcaaatctgtaattatctcattgaataaaaagtctcctttcttctgttgtttattccacaatgattcttgaaagtctaaaactaaaaatttcagattattttaagaaagaaattccatggccagtggacatacaggttaactatcttttgtctgttatgagtcaagttctagtatgttaccagtcattgcccagttgatttcaatgattatgatttttactatctatcttaatgtacattgataattactttctattccaagctttcagaataatacataatgcacagaacagaaattatccaagatacttctcaatgtatatgtttttaacaagccatttccaagtcttcacttcaatttacatacaaagaaaaccttaacattttctttccttcaattctcatatgtgtagctgccagtaggattggacagggcaactcctttatgtacctctttgcattcatgtatttacatagaagcagaagaaactcctgccagaaaaagtaatgaaacctgatatccaccagaatacaagagagagtttaaggctactaaagaaaattctctggattaagatgaaaaagagatctccaggttaaaataaaatcacctaaaagatactttttcctacataaaatcatggtatacagtaagatttagtgtgattcattcttcaatcaaagaatggtttttgagagtagaagtctttcactttgtaaaggaattaaacagaagacttccaattcttgaagctcttaagttatctcaaattgagaaataataattaggaacagaaatagaaataaaagaaaaagaatataaatatggttattaagccatagtcaagacagaaggcttatattttaaggactgtactgttcctttgcaagaaaagaaggcacaacttttttgtaggaggaaacatcctaaaccagacttacaaatgaagtttatcttcattgtatgccttggatgcctgggttccttccaaggaactgtttctaatttcgcatttttaaaaaattcttcttagatagtgcccccaaatcatttgagctttaagtaccacaaagcctagctctgtctccaaaagcaactgttcaatcagaccatcatggagtatagacacagacaatgtggattggcaatgaggagtaaggaccaaccataaagaaagttgaaaatctaggccagaacaaaggcattaactgaagttatttctggctataggctttatcagtatcatagagaggagggctaatactgaaaccactctatttatgcctgaatatattataaaatatattcatgattaagttaactcctataactgtttctttttgggcttaattcacttcaaataattttatgatttacatctttattttggtccagatcatctttttattaaaattattcatatgagttatgatttctgattccaccacttataaattgcatgacattttacttaaactacctgtgcctcggcttctgaaactatacaaaggacatttgaatagtgtctacctaggactgttatgaggatgacatatatgtaaaattttaaatcagtgcttggtgtgttattaagtgctcaacagctgataatattacttttcctgctttctctgaagttttcttaattagtggctattctccctcccatactccattttctactgggatggagttggggtagaattgcttattgctaatcactgctgttaggtaaactatatttcttcctttatttttggctcagattacatattatcatactgtacctctcctgttgcagtcatctagtagctgcctcataccttgacaggatttaagctccaggtttattatcaccctttcaaaatgaaacttctgtcccatttttggtgctttcaatatatcctattccattcactctcctgctttttaactactatttcatacattttctcttctctaagattcaatgtttccttctctatcctttctctcagctcatgatcctgcttcctacttcacagagaaaaggaaagtaatcaaaaaagaacttgtaccatattgtcccacagatttgcatctgtggccaccttctctgattttcttctgatgtgatccattatttgggctgatccatttgtgttcctaaggccagctactcagtttgcacattgctcttgcccacccaaaggcatcactctactaactgggtattctcttaaataatcaatttctcttgctcactggatcattttcattatcatacaaacatgttgtatctttctcctatcttaaaaaaaaaaatcactttcgatcatgtgatcaaacagtatccagtatccataatagtgagacattaagatattatataatacccatgagatctaaaatgatgttaaagcatcacccatgaaggactacggtaaaaacaaacaacaaaaaaagttcaatcagaatctaatcaaggctttagacttaacttgctgattacataataaataaccagggatggaagtggagtggggttgggagtgggggtatagtgactcaaaatgttcaatgttacaacaagaaagcaatcagaaaaatccagaatgtggaatattctatatgacaactggcccaatatcctcaacatgtcaggtcataggaaaaaaatactaaagaattagaataaaaagagtacacttggatcttgatttagttcctactttgggaaaaacaaagtagctttgaaagacatttgggggaaatttttggaaatttcagtaggaaccgtatgttaaattattccaaatgtagtaacggtactacaatgatgtaggagaatggccttattttgaaaatagacatattaaaatattttagagtgaaatatctgatgtctgtgttaaagtatgtcccagctgacagacaaaatgagttccccatggctaattgaggcactcgaagttaaaacagaaccagtaggccatggcttggtgagagagcagtcatgtactttgtattctcaaagcgattttctgaaagtgtcacagtaccctcctttctacaaataagctaaaccagttcctgttttcagggccaagatagattgcagatggaaattaatcaactgaccaccaacagacttcccgaggccagccaataaaaagagatacgtgatgtcttgcttaaaagccatccagtccagaccctgcatttgatccccgcctcctactgcatcttgtgttttttgcctctataatttcctactccttaatccttcccgggatcacaccttaattttgcaccaaaggctgcatttctccaatttgaggattgcttttagaaaataaaattctcttttcgcctcctcatatctcattggtctttggttaacatctgaaatgtactttcaaatgttacagaaaatgtaacataaaaacatatatggcaggccaggtgcagtcgctcatgcctgtaatcccagcactttggtaggccgaggtgggcggatcacctgaggttagagttcaagatcagcctgaccaacatggagaaaccctgcctctactaaaaatacaaaattagctgggtgtggtggcacatgcctgtaactccaggtactcgggagactgaggcaggagaatcgcttgaacctgggaggtggaggttgcggtgagctgagatcatgccattgcactccagcctgggcaataagagcgaaactctgtctcaaaaaataaattaattaattaatataaaaataaaaatatatatggcaaaatatcaataattgttaaacccagatagtacgtatacagacatcctctggcaatcttgctgcatatttgacaacttttataataaaaagttaaaggtaaaatctctattaattcaactttcccctccagctagcatttcatttcacttcatttccttcttctcagcaaaattcctcaaaagagttgtctagattcactgtctgcaattctcctcccattttctcaatctccactctgacactgaagctgcctttatcaaggtcaccaatggtttccttgtggccatgtatatttgcattttcaacattttagcagcatttgtggaagggattatcccttactccttgaaatcattcctatttagcctctaggacaccatttttttacttgtttttctcatattttacagactccctcttctcagtctcctttgctggctcttttatatctcccagatttctcaacattgctgagccccagggcttggcttcttctcagtctaaacttactctcttgctcatcttatccaatttcttggctttcaaaaatatctatatgctaatatcctgtaactttttctcaaatatggactctcttatgatctccagactgtgtattcaactggaatatgcctctgtctggagcctaacaaccatgccataggagtagtgagtatttctcattctctctctgtggtacactcaaaaggagattggctcttagaaaggtctgaggtctagctagcatataaaagcagtggaagaacacataaaacaggagctgtgtgaattccgattgggaaaccaaatatttgcgtctgaattgaagatgtcttaatttattccaggaattgggatcttattagggaatacccgtttctgcatataacttaaacaaattaaggagtatgtaatcaaacattctgaagatctttagcaccaatattcttcaattctcaaaaatgtcctctcctgtccaactttactgttctgccccatgatgttatgtatggggtattagaaccccttcctaacaggtttccctagcttcagtaaagcaaactaaagctagggaagcctaaatttgttattcataaatataagtgactgaaagatgttgtaagatgtaaacttaaacatgttatttctttgcttaaaacaccgtaatggatgtccatcactttttaaacaatgtacaatgttctccaacatctaagtcctgtttgccttttaatttgtccagtccttatcttcttagaccgaacaatgatgaatgttgtgttttcaacgtcacatttcttgaagacagattaggccttctaatttggtccgtatgcaaaagaatgaatttaagttcattcatgctgaattaatagggactctataacgatgtaaaagtaacgcaatgagtattgcgttatctggcacacgtagctatttaagcaacttctgtgtatctcattggtctcatttgtatactggagatgatgatgatagttttttgcatcacagacttgttgagaatactgaatgggttgatacatgcaaatcacttagcatagtgcctaatcatcataagaaatcaacatacttaataaattttcattatatctccattttacaaatgggagtcagaggggttaactatgtttttcaacttgccacagtttctaagttatgaacaagatttgaacctggggagtttttctatctgagtccatatggactattacagggctgctgttcattactatatcaattctaataaaacatatactgaggcttcagaacaacatagaaaaatgcatgaaataagacctattcatcattgtagaaactgtgtccttcaaggactgattaaaaagcaaaaaagaaagaagtgtttgctccacattgactatacctacagttgaattggggattcgaaaaagagctgcaaaaaagccacttaagcccaaaacagatttgtagacacatcagttttacctgttttactaatgttattcactttgcctagcgggactttctcatcttttctatttggcagaatcaagcacattttcacaaatatgtcatttttgagaagctgttccctatccttccacacaaaaaaaatacctctttgctacattatgcattttattcctaattctcacatcatagtgtcatacttagtcttagatatttattttcccttacaatatagtagaacttcattgatgagaatattttattcattttttttattatactttaagttttagggtacatgtgcacattgtgcaggttagttacatatgtatacatgtgccatgctggtgtgctgcacccactaactcgtcatctagcattaggtatatctcccagtgctatccctcccccctccctattttattcatttttatctttgctactcaactcagtgctaattaaatatttgttgaattatattgatttaatttttgttgaatagtgggatagataaatatatcaaatccatcatttgtcttaaagaaattgctaatgtctagttcatcttttctatatcaccatcacctagcacagcatgacagtttgttacttaaactcagtttggtaaattaatgaatagatgagtgaataaatgaatgaaggctaaatttcaaaaggctgagtttagagtatcccaaatctagatgttaagagagcttaatgagagaatcctgatctgttaatatgaacaacacttattcatggcagaggaggggacatactcctttaaaaagtgtaagtaatagatattaaaagttttttgaaaatttttaatgctacattatcacccatgcacaaagaaaagaataattttaatgttgtaacaacatattatgatattcactacaatttaatcttttatttttatttacattttatgtagaatgcttataactagaaagaaaggtttcttaaaagctttccaaatttggcaatgacttaaatattatagaaatcgatatcctgaaattcagtaaacaaattcaagaaaaacttctttggcaaattctagaactttatttttagtctattttagtcttctttttttctcctgaagaaaataaaactatataatgtccactgaaggtgtatgctgctcaaaatgttcatgctgcttgacttcaagtcattattacaattctggacaattcaaataaacaaagtatgaagtaaagaaccttagccatgagatctggaagacagacaaatctattctttacatctagctttgacacttatcatgaatcacttcatctctctgatcactgcttttccaatatggaaactagaaagattagtgactacctactaagattattgcaagtaagtgagagaaataccataaagtaccaggtgagatacttttatataaatgaataaaagtactagcaaggtatcactatgtacatgctgaacactcaatagtgttatttcacttctttctcccttatagcttttggcagactactaaaagcctgaaaattctctaaagatatgagatatgatttccatatctagggcacttggttttgacaagccagactcacaaatgagatgcccattaaatttaagcaatttacatgtaatctttattcctgcttgtttctttttaggtatttatttgtatatttatttgtttgtttttgcttttaggagaaaggcattgtaagatcaataaatacaatgcaatcaaatgagtatgttgcaggggaggggattcgagaggaaaaaaaaagaaaagaaaacatagtaaagtcagtgatgatatccttgaaattttacctgagaaacaaatctgtaatgacatgttaatatttttttccaaagtcataggaaatttgggataaggtggcatgcccagattagaccctagtcagtggagtgtaattaaaaattttctaaattgaaaactggtataacctactttaccttttataggtacaaggcaagccttagttcagtattttacacaagcacattacatcaagtcatctcaaacatcatgattgaacaagtgagaaatcatattatattatcagaaaaacaaagcaatgtctggaaaaatgaaaatcaaacatttttgaggacaaaaaaggctcagaatttcttttagaaaatagtgatcagattcaattgagattcaagttttatatgatatgaaaaggttaatattttatacctgcaacattctgtagcagatataacaaaacatcaactagttcaaattcaaaaagatatagtaaaatgcatgaaataaaagctatccatcacctttgaaatacactgtttgtcgactgattaaaacacatgaagagaaatgttacttacacattgagcataccaataattgagctgggattcaaagagtgctacaaagagagtacttgggtacaatacacagatgtagaaaaatggtttatagccagaaaagtagtttgggggaggtaaataatcccctaactccttttgaaaaacacctgcttgaagtgcaatatttacattctgcaaacaacttcctaaagctctaagttcatttgtctctatgttttctctgcaacttaccttgacatttttgatgattaccaaagatattgtttatttaaataagcacacagtctctacctgacccatatgttccttcttgactttggatttaatttatgatgcctattttataacattttattatttccatggcaactgtcttggtataataaacaaagaatgacttcagctactttatcccgcagtgaaggagctggatttgagaagggtaagtttgaggtaaagacaaaatatcaaaaaaaaccagaaatgataatgaaaaaatgaaattcattttatctcataccgataatattttcgttagggactgaatgcatttactaggcagaataatggcagtcctactctctcgtattcaaccgaagcccacccctgttgatgccaccaaactcaaggccagttggtccctcagtataatgcactgttactaatttatagtcctagtttgttccaatgtccttttgtctgttttcaaagccctaggtacatttgaacctatcttagctaagtgcattaccagatgacaaacaataaaaccaattattagaaatcagcctctgtattaatggcatatatattttctattatttttaatattataaggctaaaagtagaaataatctatatacacacatatacagaacaaaaagacacatggattttatttttaaaaaatggaattagaacaaattttaaaatctatttacctaatatgataatgacctttgttcccagcttcaaaataattttaggtactgtcagtctattccaatttcaattaaatcctaccctctcctgagatatgacatcaagatctaattcagttataagcagcgttatcatttaattatcttctccagttatctacactgccaaatgatagtatttcctgagaaccacatatgtcactgttgtaagcaagaaccagtttggggatacatacagaatattgaactacactgacttatttaatgttttaattcttacgacttatagcaaaaaattgctcccaatctaacttgctttgaataaaaataccgttaatatattttcctagtgaaaattgcttaacctccctgtgtctcagggcccttattcatagctcataagaccaaacctagcatacagtaaacacacagcaaatattagcttttattattacctcaggtaaaatattccttatctggcattaatatatactagggacaagtaacctaattaagtaaagatatattaagctaaaaaccaaaattagtttgtctgatggcaaagttgatgaatatcatactttctaggttaatattataacatttatttttgctttaaagcactactttgaggtctattatagtttttctttttttccagcatattttccaatatgtctaggttaaatttcttagacatagccaaagaaaaagtatgctctaggtatttctgaacttgggcaaattccaaaactaggaagaggtcacccagagtttagacaaagagcaagtttttctggcactttcgtaattctttctcgtgtgagagtctcactcttgcaattgcttctaggacatgaccctctgcaacagagattccacacaacactccactctttgcctctcttctgtaattcaaactctcttttaaaaagtctgtgtcctctctgcaatccccaaacctatctttgaacttaccaattagcagtcaaattttggcttgtaacaagatttatagtcagagcataaggacatatatggagaatgaggtatttttaggagtcttctattttaagtcctcataaaactcaaaaatttttatccaaagagatttgagattttaataacatgagaatcaatgaaaccctccctatgggtgaatcaccatatagataggtcagggtctactctgttaagttggttcctgatgatcacatggtgaattaactttatactgtcttctgttcagaatgagcacctgttacttgccaaagtttgtggcagacacacagaaagtataaagaaaactaagatccagcctccaccttcaaaggacttacaggtatcaagtaaaatcatccttattcatgtgccagctacagtataataaaataaattcagatatttatctcctaatgagctgactggctgcgttctaaaaggatgtctgtaaatttgtttgtctacaaatcccaagtgaataagaattgaagttcacagtccacaatctaatttcattaaataggacatgtgtattggtccctcgcaatcttgtggatactatttctatcacacaccttttttaccttacttttttaactcattgaaaaagtttttgagtcagctattttccctgttaagctctgaattttactgcatattagggaaagaattattccatatacaggtacagaattcatcattttctcaccatattcaatttttataaatttatctttttgtttctatcaatcataatcataagcttcttcttagtagtcttttcaggcatcttaattacttggttggttggttggttggttggttggttggttggtttacttattagacttgagagattgtgtgtaaataacccacagcaaatgcattatagactaaacaacagtgtgacagctgaggttgaaatggcaattatagtcctttattggagttagacagaattgactctattttcctctggagcacagctttgttcatgtaaatgaaagttagtaagttgaaaatgtggaagtaaaggagttttgtcgatattatatattcatttctttatcaactcaacaaatttacttaaagctttctatatgctaaacactgttgtagataaaaaggcaattcaatatagcatgatgaaatctagaaaggggagatatggaaaagctcatgcaactcataggaaagacatctaacgtactcttgggaggtcaaggggagcttaccagaatgattaaatgaggtgactttaaaggatgaagggattaggccaaattatggagtggagattggggttaagagaataatattcagaatttatcttaagggcagtggaaaacaatgaaagattttaagtaagagagtaacataatcaaatttgcatcacaggaggttctttctgactccatagtttggtttaaggaaaaaggcacaagaatgaagattagagtgctgtttaaactattacagtaataaggtagataatgatagataatactgtcttgaacgatgacagggtaatgggaatggagctcaacagattaaaaagcaaaggctgcttcagcaactaaacaatgatttctgtgttttctcactgcgattttattattatttatttttttagagacagcatcttgctctgttgcccaggctggagtgtggtggcaccatcacagctcactgcccccttgaactcctgggctcaggcaatcctcttgcctcagcctccccagtggctgagacaaccgtcatacaccacaatgcctagataattttttatagagaaggggtctcattattttgctcaggctgttcttactgtacttttaaacccatattcttacagattaaaaaaatcatttgtttgcttatgtaaacacaagtgagaatttggtcatttgcatgcactagacctcaatatagccttaaaatcataaagtatagaaaatggttggcatgttttcaagtggcatgtaacatcttgtggctatattccaggatgcatatagccatgtaaagaaatgtcagtagaagacgctaaagccaactcatgaaaggacttaagaaattgtgactttatccagtgggcaatgtcaaacttagtgttttacgcagggaatagacagatgatctggtctttcaaaggataactggtatggtggacagactttaagttgaaccccatgatacctgtttttttagcaattatgccttaagccaatctccttcccttgagtataggcaggatctatggctttctcctcatcactccctgtattatgttaccttctataaaacttcatcttcctcgcagattcaccagagagacaccccttgctggcttgatgaagtaagcagctgtattgtagaccacatggtaaggaactgtggatggaattgagcaaagaattgaagctttcagttccacaacacaagaaactgattgcttccaatataaccatgtgaccttggaagaggaccctgaacctcaggtgagaactcagccctggttaacacattaattgtagtctgtggaccctgagaagagggtctaaaccatgcccagactctcaacccacagaaaccatgagaaagtaactgtattgtataaagtctctaaatttgtggtaatctattactcatcaataaaaatctaatataattagttataatattgaagataaattagatgagagaaagctggaaacaggaagtccagctaggaaaaaagaggtaacacaatgagattatatatataactgctaaaatatgaacatgacagtcagaaagagtaggttttaagctttttatcaagttctgtagttaatcacctagtcacattataaaatggaatgataatatcttcttaaatggtttgtataaagggtatgtgaagtgaaatatttacacagggttcaacacaatgcctgccgtgtattattattcttatgctactatgttaatctttttgaggaccaatgagagctgggctaggacaaaggaagtgagaatgaaaatagtggtaaatttgagcaatatttttaggtggtaagtcataaggactgctctgatatggataaaaagagagggaggaaggagtgaaagataatacaatttctagcttggatgattgaataagaatgattccataactgaaataaagagtgcagaaagaaaggctgatttggctgaggagataatgagttctgtcttagcagtgtaaagtcaatgtgcttgtgggaggacatccatatggagaggtccagtgtactcagaagagatttgagtatacggatagattttgagatggttgagaattatgttaccaacaaactacatcagtattcacacacacacacacacacacacacacacacacacacacacactcctaatagtctcttttgaaaaacatgagaaatatttcctcttaataataaatacattatgagtttaataaatggagcccaggatgaaaaattagagaataggtaaaggatcctttcttctttccctaaaggatcaatgactaagaaatgcccaaatacaaaagggatatttaagttgattaagcttgataagtctgttgcaagggccagcaaactatggctccacagccatatccagattattgtttttgtaaataaagttttgttggaacacagccacatcaattcatttatgtattttctattgttgctttcacaatacaatagcagagttcagtaattgtaactcaaaccatgtggcctcaaagccctaaatatttactgtggagcactttacagaaaaagtttgcccacccctggtctattgtataaaaaaacgatagtcttctaacttgaaaattgtgcatcaataaataaggtaataaatgaatgttgcttgaaatgccacaacactcatctaagaattacaaatctttgtttctcgtacatttcttttatttattaattgtaacatttctgagcatgcattttctaaactgctaaaaaggaataacacctcctctgcttacttcataaggttgtgagcaataaactctttaaaaaatgtagatagcattgaacaaatataagttaatattctagaagcttttatattgttaagccaagaaatcaatgcattcagtcctaatcatacaagagagaagtaaatatatatttctttatattactcactagagcacttttctttcatcttaaaaaaaaattgggttaaatagaactcatactggcatcatcctttccagaaaagaaaaatatagaaaattaaggcatttgcctaaattaaccagctaattaatggtaaactctacgatcaatctaagtctcttgatttttaattttctttctaccaggccatatatctgcaatgctgactaactggatagatcagtcatatttgatatacatatgtgggcatctgatagatataattttagtatagagagcttggaggttaagataaagtaaatagaatttgtttcaagagaaattgcctcttcaaatgcactttattctttcatattttgaatttttaatacattttcattttggaatagttttaggttaacagagaagttacaatgatagtacagacagttcgcatatatgctgcacattcagtttgctctcttcatttttaaactaagaaataaataactatcatcatatatcatctgaaaggtcagaaaagtgagaataatatgtagatgtgtaatatagagttatcatttttatcatttgactcatgattaaggcaagatgttgttacttgtccaaggtcaaataaaaaaatcaatgacacacgaaattagaaacagaagaagatgtattaaatgggggattatgaggatgaatgaattaatgtctttgaaatcacttcaaaatgtgtgggcttcttaaaatatgtggactcctgcctaaagacaaatcattactaatatttaacttgctaatctactttccaaaacaacatgttctttcattagctcgttgtttatttgcaacatggcctggcttggttcctggtatatttggatgctgagtgaagacatgcaagtttttcctgatttaaaaagatagcaacgtaaatgacagtgtttttgtaatgtaaactttagaaaaagaaatcatgtacttatatcttaaacaaaaaaggaaagtgtttcttattttaatcaacttatcaacttaccggtagtttttaatttttttatttatttatatttgttttattttactttatttttttgctgttgggtatttggttgccacttaaacaagtgatcagatattcattcctgagaaacatggctctccaggaaaatcattcaaatacaaaacatcttaactaaaatatcattttttctgtttttaaagtttttcccaaaatgtgaagtataattacagatacataaatatctatttcagatagtaaaactttcatcttgattactaactagtaaacgagattttgtgtattgagtgcttatctactaatagtgtaataaaacttttcctgttatactcttaatttctgtcaagattattctcctgcttctacaaatttttctgcatttaagcaacatcagataaatggattatggttgaagaagttttcctctagttaaatagaggacaagcatacgaagttctctgaagccatgtatcaactataatgcaggccagatttcctcccaactttatcaaagtctccagtcagagacaatggtgtgctactactgtggaccatacacaggacttagactcggaacattgtgataatcataaatctgctcctgggtttgtgttcaaccttgagtatttttatagacatcatatctttactgataagatagttgtattaaacttactttcacaatatttgggagtctttggaatgagatattacacgacagaatttttcatagatgtaaatggccatattatggtattattacattttaatattttgttaaactttaaacttaaatgcagagcttgtgtaggaaattgtttaaagaaaaattttatttattcctcattcaacatccagaataagataaattttgccaaattctaccaaaagaaatgaagataccaatcaacctgtacactaaatattgaatcaaaatctatataaataaaatgtaaagtaagtttccaaaactagctttatcagttcccttactatccagaatcagatgccttatataacctatatacacacaaatcgctttagtaaacgttaatattagtttcatactttgtataaaatttaaaacctcatctggggcttgttctgggagtgtatccatcatttgtacccttgtgccaggaaaagaatgtttagattccaaataactgaaacagcagcaaacttttgaaatacaacctacttaaaatttggctattgttaacctaggctttctatgcagttggcaatgctgaagactaaataatgattttttaaacaagtatgaaatagagaattggtgttagggtatatgaaataaaaagtacaaagaggttaagaagaaataaaagctgtccaaataaactaacattcctaaaagtggacatctgctcagatgaatggctacaaataacatgcattttatgtgaataaagactaaaatatggaaaaaaaaacaaaataagaaatatacacatacgtgtgtttagaatcagaaattcaagaaggaacaaatttgttttgaagcataagcaaagcagtaaagaaaaaagttcaaaaaaattggaggagtaacattttaaaaaacatttctttttaaaggaatatttctccccatcctgtaacttaaatgtatgcctaccgtggaatttattaaggtcaattgaattaattgtaaattttaataagcttaaaagcaagcacagctaatttgaaaatgggtaggggggaattcccatggcaataactttgctttctaaatttgtccacagggtaattttctttcatccttcccattaaagatttgggtacgaataaaccagtctcaaagaaacaccttaataaaacaaaattaactcaatggtagatttttgcaatgtcaggttttcatagatccatttattaaaatatatcataaatataaactaaattttttaaatgtacatgtaaacactttttttttcaacctatgtaacggcctggcatgtattcggttactctgagagaaaatgttagttctctatgatagattccttctagaatcacgtttccctagacactagtgaggaaaaaattgggctttggaatgaaacagatcactacaaaaaaatcatagtgctacctcttacaaacttgatgatcttgggcaagttatttagcatctctaagcctcaggcttcttctaatgaaaaatggaagagataataatatcaggattttagtaaggattaaatgagatgactttacataaaagaacctagcaggtccttataatgttagcgttttataaaatggaattatttcccactgtaattgattttataaactaagttgacaggctggagagacagcagattatactcaaaacaattagttaaaataaaatctaaattcggaatgcttcctatattcaagggattgtgccaggtgtctgatttatatgactaatttcttttaatcctcataactaactcataacaatgagttaggtgctacagttgcaaacattttgctgatgagaaaaatgaagttgagaaaagtgaattggccaaatatcaaatggtcaggcactctgtagccctcacttggactattccaaaggtttcattaagtaccttcgaaaacagtcacaaaaatgaaaattggcataatgaagtaaagtacaggaatttcaaatgtggcagtaagcagtagcagtagtaacaacaaaatgtccttaaaaaaaaaaatgcaccctgcatagctcctggaaaagatgccctgagagtatgattacttatcacctcccaacttcaagcctctatggttgcttgtgccatttctataaaaatctgtgatttttaaagagaaatttcatctgctaggtatcttgaaaacaatctcattacaataaaagacttcagacccacactaacttggatgatcatattttttggcttgatttgtggttccacaggaattcccacattctatatattggacaatatattgaataaggcaaaaaggatataacttcttcaatctcatttcaacctgcagggcattttgtatccatagtaaagagcaggggcttaaaccacatttcaaatctctaccaattttcctgattttgtagcatattataagttacatagatttgtgacccacaattagatttataattaatcaaattaagtgcttgtgataattttcaatagctttataaaataattataaaatggccatttgaatcttattctatcataagatgtactgataatcactaaacagcaagaagtttttggccttaatattttctaatttaaagagggaatgatttaagtcttaatgaaaagccttttttctaccgaacatttttttctttttatcagtcaaaatatttacttccaaagattgagatggtgacttcacgcttccaacactttaattatagttattttttatttcacaacatgaatgaatagctctcttaatttatctatcaaatattgagccaataagttcattaagagcccttaaattagttacctattcttcatttggcactttctcttgtaatcatcttttatgcatgttaattttaagttataaaatattgtcaaaaccttggtcagaatatactatcaatagaatacaagaattctattttctgtgagctctcaaaatatgattctatttctatctgtctatctgtctatctatatcatctatctttctccatatatctatgtgtctatcatatttctatctatctatctatctatctatctatctatctatctatctatctaatttgtttcttatccctatctgaaaacaaatttataagcatggtttcttgaatggagcagtagagaagttaattcagttacaccagattgccaaatagaaaaaaagttgaaataattaatgtgaaataaatgcagaaattcaacagattataaagaacgaagggtgtaaccatgcaactccatggacagtgactacacatacaagcaaatgaaagcagctgaccacgtacccacacaccttggcagaggtgcactccacactcgtcggccaccaccaagacagatgatctctgatgttccttccagtcgataacccgaagagcatgagaaggtcagagtgtcaccaatcccaaagttgaacccgattcgactaccatattgaggaatgccaggatcttcacaaggttcaaggttatattctgtaaattagagagaaaaatttccccgcgggggaggaaaggacaaagaaaatgatagtggttacttttaaaggtatattcctattgtttttagaacctagtcatatatttagaagggactatatgaatagctatcagaacgtacaaatggcacacatacgtttctttttctgtgaaatagctaataacttgataaatatttgtatttgtggtattcaatatagatgagaaaatatcaccttctgaataataaattaaaaaatagctatttatcttattgttttttctgcattagaaacatttttatttcatatattttcgacttacggcataagaactgcatattttcaaacacaaaataacatttgaaatgaaatcatttgcacttttgaaatgcttttgcttaatattttacatttaaatgataaaggcccttctgcttcttgtatacaagttcaattaatgcatattctgaaaaacacatgatttgagatgcaagggtttatgtgagactgaagtgaccacacattgaaaactattgtattatggatttttacaggaagttttccccaggcaataaatgaacattatgaaaatgaacaagtaaacagtcttcagggtatgaaaagtagagttgattaaacattataatttatatacagtcctaagaagaagtagcttatctaaaaatattcccagagcagttactgtgtaattacaacaaagaacaagaggcattgcttcatgttgattagctaatattttatgctttaaaaaaattacttggactttttttaacattctaggttatgttcatttactattcatgataaaatactttaatgattttagcatccaaacatttccacccaaatactaaaatagttgtttaagaacaaggttagtgcttgtatcattttaatgttagcaagttggcataagatttacttattaatttgtgtctgtattaagaaatagctagttgtgttcattcaaatggaaagtacaactctaagtggtgggaatacattttattttctttggtctcatacaattttttccccctgtaatctaagtaatactattgtctataagtgaggttatactagaagaaaggagtaactatgttaatttgattatagattatagattatctaattccagaataataaattactatttattaattatatatataattaaaatatataatttattattaattaattaagatcattaattctggcctgttgactatgccttctatgtgttttcctagacacataaaacaaggaaatcactggattaattctcatttcatttttgagtttaactgaaactttaaaatatatattttaatttttattttgtgtttactaggcattttagctagttttgacctttgttagaatttttcaggattgtaaattaaagaaatgtaattattgtacttccggtagatttatagcaaattaatttttgctttttcccttatttattactagagataatcttcagtgtattccaagctttccttaaaacttgacacatactactttgctttcttctttttaaaatttttcttctctccagctatttttcactgttttatcatcagttatgctcatatcttgaaaaattgcttttttaaaagttactgaatgagcccttttgttttttattttctcaccagagaatgttatgttaaatccttcatatgatattgaaaaatctgaaatgaaacgcaattgagccctgaaatttccatagagaccagcattgattgttggaggaagatctgaaccagtcaggcgtgccagtggttgggtaaaactgccattctctgtgatcagtaagtagtcatgatggtcttccaaatgaaaagtgtggaagttgaactgcacacctattaagaaaaatagaaacactgaatttacaggtagatcagtaaaacacagagagttactgtcaaactaactattagccaggactttacttataattaaattttctgaaaatgagaggcattgctataaaatattccaaatatatgttatattattctttttgtgtgtgtttttccttcaggttcattataagagatataatgagtcatgtcttggaaactgcttgaaaatacaatttaaaaatcagtgcctgaaaaaaaattacctggttttctgaaaatttcaagagaaatacatatcttttgtttataatagaggtgcaatttcctggcaaatactgcacatgcctccattttcttctccaatcccttcgaccaacataaaagcaatgcttaatattatagcacttaacttccaaatatgcttgtttattttagaagagaaatataaaacaggcatagggaatgctatctgttagatgaatgtaattattctccatttatttatttgtcacacatttcaacctgtgcatataatatgcaaaaaatgtatatataagtgttcaggtcaatagttttcacaaatcggacacctttgtaaatagtatccaaatcaatagccacaataataccaacacccagcgccttctttataaaacttttctgtcatttcagttttccagaagtaaccactcacttaacttctaatagcacaaactaatgttgctgctttgtatatatattttgtagtttatagattggaatcatatatactcttttggatctgacttcttttactcagcattaggtatgtgaaatttctcaatatcattgtgcatagttgggggtggttcatttttggtgatgtatagtatggcattccaccttgtgaatataccacatctatttacctgttcaactgttgatggtcacttaagtcgtttgcgttttaccacaaatgtaaatggtacagccatgaacatttatcttttgtgaacatatgtgcttttttctgttgggtatgtatctaggaatggaattactgaatgatgggagtaataatatgtgttctgctttaacaaatactgttttacaaagtggccatgctgatttacatctccatagacaacatggttgctccgtatcttctccaatacttgaaaatctggggctttttaatttgttccattccagtgagtatatagtggactccttgtggtatcacgttagtatttaattacactgtcaagaacacatgtaaaagactaatgacttcacacaaacacacacactcaaatacacacaacacactgtgtgtaaggagccatctgaaataaaaaatggctaccacagggatccttcccttgaggtgctttatttttttgtacctcacctaaaaaattaccaaagtatttgctaagaaaattccaaaatatcagagtatgacaagtaacattttttattcatttacattttagttccaaatgttggaaattcttaagagtctccattgttttaaaaaaaaggggacagaaaatgagaccaaaacaaatgattgaaaacacaaacattaacacaacaaggttatcactgcataatgaatcagagatttcatatttgagaaatatttgaaatatataaggtactattttcaaattatttttcaaaatgcaagttttggtgttttttttttctcctctctataattggcagcaatacaagagcccttttagagggggtctaaaaattaagtcagtttttcaaatcttctatagtataaaatcagtattgatactagacagatgaaaggaaaatgggattttgacatagtaaagagaagatgctttgctgtccagattagctcctgcaaaataatgtaagggtagaaagttcagataagtcagtcttatttctgctataaagctaagaaaaaaatagttagacaataggagagtagattgaataaaagagaaataaatcatcatgtatactatattatttttattttttaagaaaaatgtgcttgttctgaaatacatagaatgaattattttagaatttcattaattaattatcggtgccaacaaagccactgttaagtattatttacctttctgagccctactttctccatatttaaaatggggttctaatagagttgttttgcaatttaaataaggtaacaggtaaatgacttcgcacagtgactggcacagaaagcgttattgctattgatcaatttcccaaaatgagagctaatgtttttcctgttatttagccctggccagccgctttgtaaaaagaagctgctgttcatcaagtcatggattaaatggtaatatttgctttctttcactactgcaaaacaacttaagaccttcaaagttgtgccaaaggtcaattaatccaaataagaaaatgatcctgagaaactactatattctagtcattatagaatataaatatttagaagactgtaagtaactcatggcctatttgaggaaaaaggtacatgaaccaaaattttaatcattctgccaaactggttaatacaactcaatataggagcatagaaatagaggtaactaatttgtcaaaggggtccgtagaggggtataaaaatgaccttcaaatgtaatgacaatccaggtctggtggctcacacctgtaatcccagcactttgggaggcctagacgggtggattgcttgaatccagaagtttgagatcagcttgggaaacatggtggaatcccaactctacaaaaaaatacaaaacttagctgagtgtggtggcatacacctgtagtcccacctactcaggaggctgaggtgggagggtcacctgagcccaggaagactgaggatgcagtgagccaggatcagcctgggtgacagggtgagaacccatctcaggaaaaacataaaaaacaaacaaacaaacaaaaaaccccaaagcaatgacctcctaaatcaaaaaggcaatgactttcaaaagtgagaagtttgtgatggtgaggacctagtatagacattttggaaagaaggggattagacaggaaaagacaaccaattctaataaggcagggagaaaaagtcagtggtttcaatatcgtaattacttctagtaagaatgctaattcaagatgcccaataaaggtaatttatgtttatatatatatatatctgtatgacttgtacttaaagtcaaaatagcgttaatatctaggttttagttatagtcatgccaccagctattacctaaagggtgccatttgactttttttttctaatatgtaaagtaataggtgtggactatgctttatttaaggacagtccaacttctaaaagtctaagggtttttcctgatgtacatttttttctctaggtttcccgtaactatttataattagcatcctgacttctacaacgtgtttaaggaaaatctctcatggtgtccttgtaaataaggagcaatgtaggctgaatgacactgtcgttaactgagtttgaaactactgaacaattgtatgtgttcaaacaccttgacttaatgtttaatggtgaagagattacagatggtacatatacattttattatttcttaaatatttagatatttagatttatccttgttaagattcttataaacccttaaaatactaatgatcatagttatataagaacatctgactacacaatgtaaatgtaaatgaaatgtaaatcacttcaaaatgatctcataggaactctgaatcaaaatcaatatgataaagcataacagggatacatataaaagcttgcactgaagatagaaaaaagcaattgcataattatagaattttaagaattgaatttatctgtattttaagtcccagtaatctaaaaagatgatttagattactacaaacttcttatcaattagtattataacatggcagcaaaaaagttaattaacacaaatactgtcttcttcaatgaaaataattttagtgttacactgtgccatgatgtgttcagttttagaaaaccacattttaaagagataagctggaatgcatccagaggaagttgattagagtggtgatgaacatgaaaatattatcttatgatgaattaaagaaactaggagtgtttagtctgggaagaaaagacttggaatcatgatctagggatagaggacatgaaaaacatggtagtctcagaatggtgagttgatgtgtttgaggagcttttggttggagcaaggattaggctgccttttttggtatagctccagagagcagaacagggataacggctgcagaataatttttaaacaatcaaatatggaaaaaatgaggaatttgtcccaaggagtacagtccttatcaacagaaatacccataacaggccagttcatcatgtttctgaaacaccatacggagaagctagttttctgagtaagaggttagactatattaccttgaatatttctcccaactttgaaattttccttcatgtaaatttgctacactttggaagagttgtacttcagacaaacttagttggctcttaaaagaaaggcatctacgtccgcatctcttgccatgtaaatacagatttaattaacatttgcaacctgtgaagatgcaaaactttaagtgttaattaaacctctatttacatagcaagcagtatgtagccctccactcccttctataatatcagggagcttattttaaactctattaatctattgcacactgggataatgggacactttggttaacttccagcaaagagtcttctattaataaagattgacaaaaatcacagtttacaaagtcttctacctcattcctgctattcagtaccagaatactcattttaacaacgctttttctcagtaatatttaattcattgtagaaatttaaccaaactagtcctgacataattctcacctcctgataaaatatatatgtaatttaatcaaaggcaaactttatttctgaaaacgcaaatttaaatgtattaaacacaagcttttagttttaatggtaataacatcttctcattgctaaaagtattttgttttgactttttctttttttagattttctatattaaaatcaataaatatattttaatagtaaaattcaataatataatacatcaacagagctaaaaaaaagtacttttcaaaatcagattttaaaatgaataaactagctcttttagaagatcaacccatggagattttcaagtaaataactttaatatattttttgttttcatatattagaatggtcattttaccattcataagttgttaccttgataaattacactgtatcttgataaatttgaaatacatacttatacacttctaattataagcaatatttgcaaaaatggatggtaaattaaacatgagtaattgtttagcagtccctcttattaagcagtaagaaaacgaattattaatcatgcaaaattgtttgttatagattcctatagggatacatgtcattctttacagattcctttcaaaacagtgaagtaggttgtaaaagttttatgagtggttgaatctcatgaatgaaccatgtttaatactacagagccttttacttatttgtttatttgtaaaaggacatttattaacatctaccttatgcagagtgcaattttacactctatgtgagacatatctatagctctgtactaaagaatctgagacacagatatttatagaatggctataaatttatatagagaatataattgttacaaacaattataaacaagtatatataaacacatactagttgctttaaaaattggcttagcatatcagagcatctcatattcccctttgaactcctgaaatccatttcttaacactatgccagaaactaaagccctcttgtttgaggttttcctgttacaaaaatttcaaatgacattagtttattatatcaaaagtaaacaaatctctcatagcaacagcctggtaaaaacatgagcacaatataatactatagaagagtaaatataatttttgtggcaattatttaaattgaaatgtgttttagcatattgtagtactgatctgtttttgctcatgcaaaataacatgtaaaggaaagtgaaataagaatagactcaatgaaaattcagaagatagtccaattattatttcatgaggcaaattaccttttccatgggttacatcaacagtccatgtacaattcagagaatttggataaaattccgggtaaccaggtgataagattgttccactaggccctctaacatctcctccacataatgctgaaatacaaagaaacagatccatgtgatcagcagtgagagagacagagggtgaacaaatctctatctcctctcttgaattgagcagtcgcattatctttgcttatgctacctcctagtaataacaggtgtgcatgcagcactagagaagaaaagtgtactcagtagcatctgagaattagtgcagtccccaagagaacatggctcaactttccaagtttgaatttgaagtatgtgctaatacatttctaattataagcagtatttgcataaattggtggtaaattaaacatgagtaattaattgtttaacagttgctcttattaagcactaagaaaatgaattaactgtataaaactgtttgatatagattcctaaagggatatgtgtcattctttataggattcctttcaaaactatgaagtgagttgtaaaagtttttaaggctgcttctgggtttctttatttttctaggaaatattatgaacaaaaacgagttttgtaagtaattattctaagatagtaaaaataagctaactatctgaggtcaaaaaattaatatttgatttgatattcatttctttgagaacaaatcatagtttacaaggtcttctatatattcaacagctatcagtgcttatggtatgccaggcaattctatcaaaattgaaagctggaggaagcaaaaaaatattgcttagtaagcatttttattctagtgtgagcagagaatttgttgactccttattcactttcacttggaaaggccaactcttagacacagccaagggcagtaagaatcatgaatgccacatgtacccttgtctaatttgatccttgcccactttcttagcacactagaaaagtgagttttggttttgtctcttccaaaaatacctaacactataacatgatatgaatttgtatgatgaatgaaatgtctactgagttaaaacctacagtctctacttcaaaggactatatgtcatgcagctagaataaaatttctcactgaacacaagcatgaaaattaagggagttaaattaatttaaaatacacaaaaaggtaacaaaaaagagagatgcaaactttcagaaaggacaccagacatgtgctcctgagcatgcacatttatgtgtgtttgtatatctgtgtgtttgtgtgtgtgtatatctgcgtgtttgtgtgtgtgtatttacaagaagttgagagaaagtttttctgtatatcagtattctttcaaataaagacactttgtcaagtatcctacttcttgagaagtttcttgggaatttttttgtctgtaagctgtacctatatacatatgtagaaggggaaacttaaagggacattctgcaggtaaatgcataaatctatgtaacacataaacacatttaaacatttaggaggaatggtcaacaactaatataacaaacattcgtactattactttgactagaatcagatgggaaagtatagaatatatttttataacaaagtgaagatttctgttatttgaaaataattatcattggatgaagacactgaagagaatggacttaaagatggaatttcatagtaaatagtgaagaaagaatgtaatttaagctttttttataagatgaaactaaaaacatgaagacataaattttattttatatctaataaaacaggataaaattacaatgatttactaattcttatcagaaacaagagcaaactgttttgaacttaaaacgtagctggcactattctgcagattttatttatgttaactcagcccccacaacaaccttttgagaaaaatgctgtaattattcggtttacagatgagaaagcaagcaagtatagaaataactcaaacagtctagttccagggtctatgatctcaggcagattcttgaattgtgtggatgttttttccacattaagagtactattttagcaagctatgatgttctttactcatgtttgattttgtagcacttccctcacaaatgatgaatatataaaaaaaattcaagggcatcctttattttctcagagattcatttaatcctgtcattttcaaatcacttttttttttttttttgagatggaatctcgccttgtcccccagggctggagtgcagtggcgctatctcggctccctgaaagctccgccccccgggttcacgccattctcctgcctcagcccctccaccgcagtagctgggactattggcgctcgccaccacgcccggctaatttttttgtatttttggtagagacaggtttcactgtgttagccaggatggtctcgatctcctgatctcatgatcctcccgcctctgcctcccaaagtgctgggattacaggcgtaagccaccgcaccaggccttcaaatcacttttttaatgcacctaacacctattgtgtcagtatccttgtctatgttctttaattgatctatctcttccgaattctcatttgccagtagctttgtatgtgactgaaataattctccatcatcatcatcagcctcatcattttcatcaacctaatgacatttttcatttttctaaatgagattattttacattgccaatgttttaagttgcatttgttttatattgtcagctgcaagtggtgatcataatagcacttatctatagagttacttggaagagaaaatgacttaaaatacataaggcacctgtagcagtatcagcatatggtaaaaactcaataaatattagtcatcactattattaccaccatactacattgtctggtttgctttgtaaatcagctaatcatgggatataaagacatcacaaaagctgatgtatgttagagtgaagcacactgtacacaagcattaggcaacctaggtcaatcaagtttacattcttggagcagggcaagaaattctgtttgtctgtttctcccttgttacctcaggagatctggactagttaccgctggggcaaaagtttctgttaaaggaaaggtctgatcaaatctgttcactaggtgatacaatagttgagttcagttcgagtcaacagaaaaaaattattattaagtacctgctttatacacagcttagacattttttaaataaacataattcagtccttgtccagttgcactcaacatgaaatagaaatacaaaagaggaggccaggttataatagaggttaaaagtaacatgatttgatcttttaaaataaagatgcattgtaagaatgcaggacagaaacatcactgaaaaggatggatttctcaaggttaaggacattgaattccatgattagtcatttgagctttcatttctaagcaataaaaagccattaagaattttggatatggaatataacgtgaaataaccttagtgagaaacatggggttggatggaaaaatgatgagggcctgtgctgctcctgggaaaactggatatatttgcttttattattaataaaagttaagcgtgttgatgcgcttgccattactttttatcttcctggttcttataatattgcctccatacctttctttcgtggtgaatgctcctcattcaggccaaccttgtagctttattagggtctggcaaacataggacttttaaaccaccatggtctgtctcaaccacagggatagatgagcacatgaccaagacaaagtcaatcataatgggcccttctccttcactagagttactagtttagatatggatgaattgaataccttccctgggatttttctaattagagtgacagggaagagctctccttcctctctgaaactgaagatacagggctatcaacttccatctgcctgagagtgtatacactactgtcaattcctcatacggaaaaagcctgtctgcagcgtaagagaattatgtgaatacacaaagaaaagtctaagtgtaagatggagaagttcttaaaaagttttgaatttatgcttcttattagcaatgagagttatcccaccttgccttttctactagttgaacagttgaacaacagcttctgcttttatttttaaataccagttagagttgggtttctgtcacttacaatcacaaattaaaggaagatgttttgatgagttgtttaaatcttcatataaaaacaaattagcttaaaactgtttaaaaaatgatggcactgacagtacttgaaaatttaatcataaaatgacaaatggtatcttccacttcaagaaatagtaagtgtagaatttgaaaatagtactgtaaatagaaattaaaacccatagttaaataatatatggatttacattgagtgtgctttttgacaagcaagcatgcaagcacttcccaatcttaggagaagcagtttcctccactggatttcatatgtgtttcctgaaaaatgaagcacttctgacttattctcatagaaacaaagaagcagtaaggaacactagtatgctatttattataactaggaacttgacacaacagggtagtcggagtaaactaccatagtgctgtgtagctggttagaatttttgtagacaggctggccttctatttgaactgggacatgttgccattcaaggcaggaaacaaatgctgcatttttttcaggactttcttctcatacaaatttggcattttcaaggctgttttgaaaaggtccacagcatgttcttaaaatagttacacaggtgagttttaaatatatatgcatatataaacagggtagatacacagatagtatctttaggcatggagtaagtttggctgattagcaatagtctttatttcatgaatggtttgataacataaatttgccagaaatcaaaagaacttttaaaaaacctaaaatatttataattatgttaaaccccatataaaaaactacattgatttttctgtttataaatcagcatattttgcatgtcaaatgagttattaccatcacaggttggaagtggatgactccaccagtggtttttttcgcatagaaggggctcttcatgactcaacctgtatcctgaatcacaactaaatgaaacagtagagccaatggagaaatcatgaccatagcgacggccatgtacaggtatgccagggtccaaacaagaatacgtgttcactgtaacacctggaaaacaaagggaagaaaataaagagtaagcttggtgggatttggagttgctgaaaataattcctagttcttcaaacaattacaagcaatgatttttacaaataaaggtactcgtacttcatttttaaaatcagcaatttatttaataaatttgttttctcatttcctaccagtaaggatcaaattcaggtcatttaattacataagaacttgatgaaaatgtataactatctgtaaaactttgtattgttataaattttgtgtatatatacacatatatcacaataatcatagcaatagtcaacatttcttgaacttattatattccaagcaccattctaaatattatacaaaattttctcatttaattactaaaggaaaaagaagagtagaggcattttgcaaggtatgaaagtatgaacaccagaaccgttctaagtataaccaattagcacatttcttctggtggttaactgttgttgttatcaatagtctctagtacacttcagtgtctcctgatatcttccttgcaatttacaatccctagctgagatcataccatgacaatgtttttcctttaataagatatggcttctcaacctcggcactgttgacattttggactggatacttctgtgttgtgggtgtcctgtgcattggagtacttttagaaacattcctggcccccacctgttcgatgccagtagcatttctccaatcatgacaataacaaatatctccaaatactgctacacatttcttggggtgcaacaatgccctcagttgagaaccactggtacaaactataacaagtaattatttttttcttcctatataggatatttaaacaatgaataactactatttctatattccaaaattagtcgttaacatttttaagactgtataattatattaaatcatatttatatgagaaaatatttatttgtattagctacccaattcaaaaatgaagctaaacaaaatggtacaaaatagaagtttaattttaaagacggaaattgtacattttaagtgtatttatcaagcatattcgtttcatctaaatggtgttattttaatgagaaactaaaatacaatagagacaattttatcttcaacacatctacttttatctgctaagttcctcttctaagtgtgaccattatttttctaagcacccagtgcattttttttttttttttgacggagtctcgctttgtcgcccaggctggagtacaatggcgtgatctcggctcactgtgaccttcacctgccgggttcaagcaattctcctgcctcagcctcccgagtagctgggactacaggcacatgccaccattcccggctaattttttgtattgttagtagagacgggttttaccatgctggccaggctggtcttgaactcctgaccttgtgatcttcctgcatcagtcttccaaagtgctgggattacaggcgtgagtcactgcacctggccagcacccagtgcttttaaactctcattcatctttgattcctcactcttttcctccacaaaatatgtctgaaatccattctcattgaaaagcatcatgtcatgtattatttctcttaccctatccaaggccctcatcacctcaagtttatgaaacaaacaataacatttagcatgtttttcagtatctttcatctccaatttattctatataaaatgttggacatacgtatagccaaaacatgttttttcattgctttaataccctatggctaatggcaccatgttcaaagtcgtcaccctgaaaattaagattcccaaattagactttactattctaaattgtcattatctcccaatggtcattttttatatcaatcagataagtctcctcattagttttaggctttgtctcataggaataccttcagttgtcctcttaatgtacacaatcttctcaacctttaacagaaaagtttagacccccttccttcaggtttcaatttcccccaatgttccaggtgatatataactttcctttacatgaacctctaacattgtagtaaaatcgtctaaaatcagagaaatgggggttgcagtggtcatatacaatgtaaattacagtaaaatttaattattcaaaagtgattgtaatgcttttgttcattgacctatagtaaaggtcaatgaatatatggggttaataattcatttgcctttcttggcttttcaactgataaagtaagatgatgtatttcttttatgtcttccactgtggtgcattgatctaggagtcacaaaataagtctaaagaaatagttcataattgattgacaagcaaataactcaaggcataatgcaaggcaatggaaatgttgcaaaattgagaaaatgagaaacatcatgaggaactgatatcagtattatttattaactgatagtcattactgaatactaaaacataattggtaagtagctttagaagattttttttttagacagagtctcacccatcctacaggctggaatgcagtggctaatcttggctcactgcagcctccacttcgcttcctgggttcaagcaatcaattctcctgcctcagcctcccaagtagtgggaattataggcatgcaccaccactcctggctaaattttgtatttttagtagagacgtggtttcaccacgttggccaggctggtctcaaactaatgacctcaagtgacactcccgcctcagcctccaaagtgctgggattacaggctttagtcatcgtgcccagctagttttagaaaattcttaaatgttggcaatgtacataattttcagaagttcatgtctgcattatatcaaatgacattaacatgttatctttttccttattgctttatagagcttgtttttttaaaaagtagaaattcaaaatggacatttttcttatttatgtaatacaacgtttgaacattttatgtttctgtttctactactcctcccctcaaatatctattgatcataaattgtgcattcttttagatgtctaacattttcctaattggaaaatacatctatacgttcatatgaaaaatacatatttggagatgaatatatgtctatacgtttgttctgtatccattttcaattttaaaatttgtataatatttagatatccaagacttaattatagtcatatttcaagcaatacaacataataaacagacgtgattttttcctggggaaaaactatagaaataaaaataaattatattcctaaagtctactctatgttgttataattttaatgtgttttgaaacctctaaataatcttatctttttttttttttttttgagatggagtctcactctgtcacccaggctggagtacaatggtgtgatctcggctcactgcaacctccacctcccaggttcaagtgattctcctgcctcagcctcctgagtagcttggattacaagcacacaccaccatgcctggctaatttttgtatttttagtagagatggggtttcaccatgttggtcaggctggtcttgaactcctgacctcgtgatctgcctgccttggcctcccaaagtgttgggattacaggcgtgagccaccgcacccagccaaccttatcttattgatagtttttgtaatccccatgttttggggggcagatagaatggggtaaaaaaaaagaatggggtaaaaaatataacagaaacctggagtacaaacaatggtggcattgcaagcattccttcctataggattttggttgcctggggaagacaaattactttcactttcaatgaatttgattaaaaaaatagaaatacaccaaatgccaaatatattgttaatgttctcattagcaatctactgattttgaggtttgtgaatggttcatttgaaaaagatagtttagttaccttcagcttgggaaacagtaagaaagagatgaatgaaaaggcttttgttggtttcttgataagaaaggatttatgatgttggagattatttcacaggagtaaatataccacaagactaatagaataaaatgagagaaggtgatttcttaaagacaaatttaaatacaaagttatttcatcttgttagatttgaccaaattaataacaagtgtgtctctaatcaacctcaatgtttgtcagctctcagcttccactttgccttttaaggcactagccctcgaaaataacttggactatgccactaaggacctgtaagtgacaaacttgctgactgaaggtatgcatttgagcaggacttcttatttttattccttatctgactagtttttgtaggagaaatgtaaaggctatcatttattgagaacatactgcatgttaccagttatgctgacacattttgcatgttttgtttcatttaatctttaaaatagtcctgtttttggtaaagaccacataccttgggtggaatgggattgaatacgatttactgggtaaaggatacagcaatggactaaaagaaaagctgcctgcatattgatatcaattaattactagtgagaattagttttgaagtagatttttctaaatgactaatttgactcaggtttagtaaatacatgttagactcaaaatatcagttaaggcactttagttcatttgaacccccaagtatgtgtgcattctcttattgcattttaccatgatttttacaaaatatgctttcatgccacaaagctcaaaataatgggaagttaatatagtcaaacaatactgtagataagatgatttaaaaaaactaatggatctatattgacaattattttaaaaacccatgagtccattgactatatctattgaagatagatgcccaacagcaaatataaaactatatatttcaaatgcagaaatctcttcttgagggggaaagggtcataattaacttgaatattaaaataaataatataatatctgcatttgaaataaagacatattttaataaccctcttaagtgtgttgttagattaatttatcaaaagtgcatttcacgtaaaagtatatggctatgcattcatgatgaaaatgtacacatatgtaaatttatatgtttgcacacacataaatcttatgcaatatagccacacatgtgcaagatgtttataaatggaaaaaaagcccatttctgtgttcatatcagcatcaaaatgtttcaaaaatcaaaatattttagactttttaaacaaaaccatgagatttaataggggttataatgattccaacactctgaattatagcttgtattaatatagttttctcgacttatattaatcatatttgaatatatgtatatacagtttgccttttaattttaatattattttcaacattttatgcaaaataataaaattaaatattttaaatggaaaatatgtgcaattagtgtgaggaaactataaaagaataactgaatttgtgaagtaaatgctaaaaatgttattgtttatatatatcttagactggcaattactgtctattatctgtttttcagaactatacacaaataattggtacaaaacctcattttcaaataatgatttgatgcttctgatatttctttagtattttgtttcataatgatattagatagatattgctggaaaatctattgcagaatttactaaaacacacaccttataaagcattaacattcttatagatgaaggaaagctttgatttaaaataaatagagctaatagttccattagtaaaactataataatacaaaaagtagggcaaacagaatgaggaaatcaaaaagttttatcattacttactttcataatgaatcttgaaaccattattggaacgactgttgtctgttgtaaatagaaggtatataaaattactgctactaaatagaaactggggcacttgggtgccattgtaagatccaagcaagggtgacagaagatttggcccatcatgaacttccagaacatcataattcagttcagtctgaaatctaagattaaaagacacatgtgaaaatatatttagaattaacactatatatggaaataatgctttggactgctatttaaattcctatttaaaatttttccattttatattataattttctttagcttatctaatatctaagatatcatttaagacaccatcatttgtgaatgccaaaggtataagctcttattcctatgaaaaattattattaaaaagttatgtattgttcctaagattctttcaaatattataaattatcttataactggactgttcatgaaccaaacatatttttggaattatctttggttgtcttccttatttttatggaaaaatatgtggtttacatttattttcaatcagataattagattatcatcttaataacacacacatttcaaatttgacatctgcttttataattattttttattcaagtgttttttattgatacataacatttatacaaaatttttggacaaatctatttctgcctttaaacatgtgataaagtttgtatttgaaaacaacagttctaagtaggtagtaactaatgatgatacatttgatgtttattaaagtatcagcagctctattaaagacttcattgacattagtttttgtaatcctcccattaaccctatggtgtagctcatattattaaacccactttccaagtaagaaaaccacagccttaaaaacttttttttctttttactttttttttttttttttttgaggcaaaatctaattccatcaaccaggctagagtgcagtggtgccatcttgggtcactgcagcgtctgcctcctggactaaagcaattcttgtgcctcagccttctgagtagctggaattacaggcgtgtgccaccacgcctggcggatttttgtattttcagtagacacagggtttcaccatcttggccaggctggtctctaagtcctgacctcaagtgatccacctgtcttggcctcccaaagtactgggattacaggcgtgagccactgcacccagccaccttcaaaacttaaatagtattacattatcttaaattacaaaagtaggcatcaaaaccaagtctccctgactctaacctctattctatgatgtctgatcttattagatttttggttgttctgctgttttcaattctttaaaacatattaatttattttataaacgtcaatcgacacagggctacttttaacatgtataacatctattttaaaaaaatagcattttgtattcttcccttgcacttcagggttatactatatcctgaatctagatccaagatctaaactgtggaaaaatgtttatgtgaactcatggagtactaaaatatttttcccttgcctatgatgatcttgaagcctcgaaaattcttttccttgctttaaccaaggttttcctacacatctttcagtttcagcttaaatatgcgaacagcaagacctcttctgtcctcacattgtagattattttatttcctattctactgccacaatttactgtggcttttgtgatactaatcacagtagtgtttactttttagacaactgtcttccttaaaagtctataaactccatgaggttaagcagtgtgtttttgtcaatgctttgcatatagtagacactcaataaatatttattggatcaaagaaaaaatgaatgtattttacagttaaaaatgtctttcttttctctagggtagttactagttttacaaaaaagtatccaacataattggatgctttagtattaaccatgtatttttactcatgttaaatgcactttccaataaagtttcagtactttatttctccagttttatctccagtacactttaaaaaataatttttagtttgaaatgcccactaattttcagagaatcacttttactatcatacttgccagtcttttgcagtatgtgttatgagattaaaccactttattcctcaaaaccaaaatgaataaaactcatatgtggtcaaacaaatgcccagaactaattgaatggattcaaaaaaggttagaaactctatttcattatatcgtatcagtctctgatattattatgaacatagcatatgacacgttagtcaaaattaagtatataatttaatactgttcaggaagcacaactgcctcctattaatcagtaaacagtatatgtgaatttttgaagtgtattttacttctaattttgtgacctggaatatactgtatgtgtttcataaatgtttcaataatatggtgtagagaaggaaagataaaggaacactaagttctttaaataaatgatcatatacttagaaattgtcaatctaggccaggcacagtggcttttgcctataattccagcactttgggaggctgaggtgggtgagtcacctgaagtcagaagtttgagaccagcctggccaacatggcaaaaccctgtctctactaaaaataccaaaattagcaaggcgtggttggcgtctgtaatcctagctactcgggaggctgaggcacgagaatcacttgaacctgggaggcggaggttgcagtgggccgagatcgcaccactgcactccagcctgggtgacagagtgagactttgtctcaaaagaaaaaaaaaagaaattgtcaatctattatttggttgctttgtagtcagtctactgtgaatattgaaattggagtttgactttgatagctagtcagctgacagcagccaaattaaaatgcacggaagagtcagggattacttcaaattgaaacataaagagacttaattcttaatagaatagcaacattaactggtgatataaagaacattgttcagtaccagtgaatctttaaaaagaaaatcattgcagatttgccctgaggaactataaaaatacattctaataacaagcaaaatgggatagggttacacaataaattgaatttctttcattttctattttaaaatagttgtataaatttctcatgaattgcctcagtctcatgtttgtttatgaaattaaatttattgtatatgctaaacaaatattatggtagcactaaatgttattatgaatgaaattggatctaatcttattcaatttttgttgtctttaaaaaacattcttgatgtaatccaaacccttcctaaccaaattgagatagtcctcattaacttaaaaaaatattctctgaaagactgatagtgatagcatgcattcagggagctgaggataggaaaaggaaccgaaaaatacactttgaatgatggatagtaaaatgaatacctcttagactcaggagctgctggatattgagaaaatttagaaagtgtgggaataaacaaaaacaaaaattcctttgcagatctgagagtaagaattgttaaatgtttggatatgttaagaagaggtaaatggttttaaaaacatgtttgttggtgttattgctattttgttttgtattttacaagaaatcatatttcttgtagttttattgacaagctgttgagacaatctcaaagagaaaatgaatgaataatatattggtaaataatattactttctgtaggttaattctaatcattttctccatttgagaatatagaaaaaaactacaaaatagctatgccaccatgttaaatatattatctgatttttacaaattttgttttcaacaaatttaaatgactcacgagtagtggaaagtaagtgacatgactctgtaataaatcatttcttggaaccagcttcttcaagaatattctcagaataagaggaattattaaagagttggcaactagtgtccttacaagagtttggctggaaatcaaaagagaattagatattttcaagaatccattatgtgttagatactttagaaataatattcgatttcttaaaacaatctttagaaaaaaataaagcaccaagacattataaggccactgatcaaggaagtgataggcatatttatgtctgatttcaaagtgattattttatgttgctgccctaatggataaaattcacttatttttaaaattgaaataccttgttcatccctttgctactgagttactgctaaccatgtgatatctgtgtaagatgtagattattaaaagaaccaattttctggcaaagcatatggaatatagacagccctcaaccaatacctcatacccttaaaaggtctttagagaagaacaaatggaagaagatatttaaggatttttttttcttagctccaattcaataatcttataggatttggggtggaagtaaaggaaaggcaaatagaaggctcaagccctaaaaggagcgtttatttcagtttacaacatttggaagaatttgggacttaatttattttatttatataaggtagattcaaaggaaatatgtgatataaatgtgctctgtttattctaaaatactgaaaataccattaataaattcttaaagcattgtaactcctgattattccagtgtttgggccaattaacaaagaatgattttttaatgattggttttagggaagtggaagaagccatgagattataattgatttgagtgggtaatttcaggattaagaaatgaggcacggttgacaagtccagcttggtgatgtccatggggagaagccaaaatctttaaactgtaggaaacattcctcacccaaggcctattctgatctacgcacaagactgattattgttcctgtgcataaatcctacattgaaaatcacttttcaattagactttcttacttctagcctaatttaaaagatttgtgtcttaatcaatagataaaagaataagaaagtggcagagtaaaacgtgctaagtaacgctatagaaattaatttaagtttatgcctatttaactagtgttacattttattaaaatggctggaaagatttcaccagaaagtcaggtttgaaacagtctaatttcaaatataggctatacagtacaagtgaattcatttggagaattctaaaggtatctaaacaagataggcaagcagcaaagaggcctatattggcctgttggaaggacagcagatgcatgctaagaattttggacagagaaaatagtgccttcaaacaaaagtccaaaatcaaatgtcagagtacggatgccctctgaattgcaggcattgtttggcaatcaaactgttcatcaagtgagccactcttagtagcctactttgagctgaaagatactaggtgtttatttatttaatgatgattaatgactctcattagcaaatcagcagatgcttttcaacataataatgcactttgtgttcataaagcttaaactaattttctagtcatattatttttggcttatatagtattttaaaactgaataagagaataaaagaaaatgttattttaaaataacattccagtttcagtcagctagaaggtggggaaggggtgaggtcttcataagaaaacactgctgtttgataaaaaataataataataatagtatgtttcaaaagaaaggcaagatccattcctactccccaacatcacccagaaaaacaaataattaaatcactctgcataataaagtaataggtattttgagacttaccctgctatataccaggagcacagggaatggggaaatgaggactgaagattctagatgcagaagagattaaaaatgaagaacaaacaaatggaagaacattccatgctcatgggtaggaagaatcaatattgtgaaaatggccacactgcccaaggtaatttatagattcaatgccatccccatcaagctaccgatgactttcttcacagaattggaaaaaaactactttaaagttcatatggaaccaaaaaagagcccacatttccaagtcaatcctaagccaaaagaacaaagctggaggcatcacgctacctgacttcgaactatactacaaggctacagtaaccaaaacagcatggtactggtaccaaaacaaagatatagaccaacggaacagaacagagccctcagaaataatgccacatatctacaactatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgtgcagggacttcatgtctaaaacaccaaaagcaatggcaacaaaagccaaaactgacaaatgggatctaattaaactaaagagcttctgcacagcaaaagaaactacaatcagagtgaacaggcaacctacagaatgggagaaaatttttgcaatctactcatctgacaaagggttaatatccagaatctacaatgaactcaaacaaatttacaagaaaaaaactaacaactccatcacaaagtgggaaaaggatatgaacagacacttctcaaaagaagacatttatgcagccaaaagacacatgaaaaaaatgctcatcatcactggccatcagataaatgcaaatcaaaaccacaacgagataccatctcacaccagttagaatggcgatcattaaaaagtcaggaaacaacaggtgctggagaggatgtggagaaataggaacacttttacactgttggtggcgactcctcagggatctagaactagaaataccatttgacccagccatcccattactgggtatatacccaaaggattataaatcatgctgctataaagacacacgcacatgtatgtttactgcagcactattcacaataccaaagacttggaaccaagccaaatgtccaacaatgatagactggattaagaatatgtagcacatatacaccatggaatactatgcagccataaaaaatgatgagttcatgtcctttgtagggacatggatgaagctggaaaccaccattctcagcaaactatcgcgaggacaaaaaaccaaacaccacatgtcctcacttataggtgggaattgaacgctgagaacacatggacacaggaaggggaacatcacacaccggggcctgttgtggggtggggggaggggggagggatagcattaggagatatacttaatgttaaatgacaagttaatgggtgcagcataccaacgtggcacatgtatacatatgtaacaaatctgcacattgtgcacatgtaccctaaaacttaaagtataataaaaaaaaaatgaagaacagtttgggataagagaggggattggagagatacaagcaattattcctgtgatgagggttatcaagaaaatttagaacagtgtaggcttattcaatcttaaatgactctggattgtgcaataatcctctttcattgtcacctgcattatggttttcatgagaatgaaagaaagtgatgcaaatgaatagagtaatgttgagagagtgcagcagcctcagtgtctattatgtaggttgattctggagacagaatttaagtccagaagtgaacaaaagcacccccaggcattctttgaaaattgaaggagagagtaggtttcccttgtatgtgggatggcggtgaagtctttttacttgaatattgaaggataatgactggtgagagtcatctgggtgatagatgctatgaactgatacaaataaaatatgaaaataacatattttcaactaccgttgcacctcctgatacaaaataatgtttagtccaaaacaagaaatacgaaaattatgtacttgacatattatataaatatatatgagattaattctgatagattgacaaatatgcttgtttttcaaatgtaaaatactaaatttaaaaactgaaaaatatggatgaaatctttgtcctattgttccaaatcaatacatatcatgctttatcatgtattccaaaccaaacataattctgtgtgctaaagtaaggttggttaattttagttcaacattcatggaaaaactatattggaaaaagatttaatgatgaataactaagatgtttttcaagctttctaaaattgctatggcaacataagccatgtaaaccaataaataggggatacggttttaacagaatagcaacaacaacaacaaaatgccaaatgaatgtaaatgaaaatttttaaaaatgtgtcaattattgttgtgggctaaattgtgttcccccaaatttctatgttgaaatcttaatccctagtagtactcagaatgtgacagtatttggagaaagagactttaaaagggtaattaaggtaaagtgagatcatatagatgggccctaatccaatgtaactggtgtccaggacataaacacacacacacagaaaatcacgtgaagataaatggagaagacagccatctacaaggcaaagggagaatccagaataaactgtcttgtggacaccttgatcttgaacttctagcctccagaaatgtgagaaaattagtttttgttttttatctcatgcagtctgtgacacttggttatggcagccctaactaatatagaaaactaatatagccctagtaaaccatgtagattataacaagatagtgttaaattaagtttagcttaaaacctcctgtatactttgaattcccgcataagaaatggcaacctaactaagagtataatcttgtaataaatagctgagtgtcatccaattacagaaaccaagcttcagtcagtaacaggccaccgactgatcagatcatatctatataagtcaaatgcgaagttgtaactaatcaagctgtttctttatgtcacttcctttttttgtctataaatactttctgcccatttgccatacgaagctcttcatatttactgattcaaggtgctacctgattcatgaatggttctttgctcaaataaacatggttaaatttaagttgtctaacgtttttgttttaacagtagaatgaagccatgtgaaatgtttaatactctacctctgttcaaagtggaatctgttctctcccatgcaaatgttaacactagcatggatagacaaattcaatgaaagaccttttgagttaggaaagaatcatgttaggtttgtaaaattcaatcttcagtcaataataaatatattctgctgtacttatatgtttttcatgtggatctaatgcttaaataagtttttttgttcatctgtttgttttttgaagaaaggggttgggagatgagagaagtcaatgatataactgagagattatatagataaatctattttgatttgtaagttgtgattcaataacgtaagagaagtttcattcttttaagatttaaaatatacaatattatagccttttacaatatagtttatttgatcagtaatactaatttttctaggggaaataaaaggtcagctgttccaccattactacatactacatgacagtcattttcacaaggacttataggtgaaagcatatggatagtgtgcctaagtgtcttagactgcactagtgttgatttgaatgtgtttacagcaccttcgcctcttgaaacctagcagagcagaattcacaggcccttcaaagtatagaacaactaaactcattaagttaaaggtcacatgttcacatcttagtagtacataaagcaaaaaggtcgatcttgcatatttcaatagtactgatacagcattacacaaatagaaaattaacttggaaacacgctgaaaggttaaaagggggcaaacagatggaagcattcaaagcacagcaattgactattacaataaaattaaacattcatttggtaaatgcaaaagagaatgtcaactaatcttttagataatattttctttaaaagtaggaaaaatatttgtgagacctttcaaatgtaattttgatagagtgtccaggttcagcttcaatcacccactcacaattcaaagagtctttgtagtatcctggccatcctggtgagagaatcactccactgggagctgaaaaatggccaccacatggggctgaaaaattaaatcagacaagtaagaataaaacattcaagataaatcgcagatattattcttaatacaaacaatttcaaaaacaagtctctgcatatccttattaaatagttaatactatttttgaaagcaatggtacatctagtcaattacttctgttaaatgattatttttctaaaaaggtaatttacttttcaaaatatgaaatagctacatttagcatgtcaggtaataaactgctcctccttaagtctctgaataataccccttacatatattcttgtctctccatcgtcatctttgtattcaaagcttgaaagaaaacctaagttgttagctttggtttctttctctttgattttcttacttatgttatcaaattctactaattcatcttatacactaacagtttgtgcttccattttccagagtcacttcattgattcagctttttaccttatttctcatctgctattttctttcttactttagtccagctgtcagaataagctcctccaaattatagtttcatcataccatttcctagacatctagcccctttcttagatttgtattttgatctcttttctttttaatatcaaatttaaatattctgtttatcatttcaaatattgtatcctctgatttccctaagctcacacacaattgaaaccacaatgatagcattgtagttccagtaagtactgattaggtcatttagtgtaaacgcctcattttggagatgtgtaaaccaagttttagagagagcaacttgccaaagttcagtaggttgaaaggtcttaaaatcactttgaagtcaacttttgcaaaacaaagccttagtactgaccctcttccattatttcctgtattggtaaatgaaaccgccatctgtccagttgcataaactagaagctagaagtattcagttttcatacgtatattatttttaccatttactcccatatccaacccatcctcaagctcactcttatttctctagctctatggatttcatcttagtttaaaataacatcatctcatccttgaagtatagaaataacccctgaactggtctctgcatttacactattctccatgctacggatacagtgatttttttttctttttaattcacaaagcttaccatgcccttcagtgacaactttctgtgtttcctgataaggctctgtgggatctagctgttgcttattctctagccttgtctcagaactcccctccactctgcagcccagctacattagcctgctctactttcaggaagtatacacagaagagaaaatggaggaaagagtgtttaagatgttgaaaattatcaggaaagaaaaaaagtctaaatgtacactagatcaactttttaatacatcattatttccagtgacttttcacatcattttctttaaatcttcccatttaaactcttacccatgtgtttatatttttcctagcttatttctttctgttttgccttacagaatttctgaaaacaattgctctagacactattttactcctttttattctttaaataacttgatggaacccaaatgaaatagcaaatatttataaattggcctaggaattaaacattactgtaaaatttctgtttttagtaaaacattttctatgtgaaattgccaaaagatgttatttgtatgacagagaactctcataaaaactaagttttcttccttaatagaatttaattttgtttcctaaaaagctagttttaaaggaggccatttttatgaggattatttactcttcctagttatgatgactcataattaggtttcctgtagggttatgtatttcaaaaatgaaattatgtgcataatagtcacttaaattaccatattttacaagacagagctaagtattttagtgacagaaagccccaaaatacagagtatttctgacataaatctttattatgtcagcaactcatattgttccagaaaagtattcactcattcattcaacctaatcatcattagacgaggtaattagtcataaaattaacaattgagaaatgggccataaagaattaaaaagtaaagtactgagaagcattccgactagccactcagtgcaaaatgtgagggaggcagagttagaaggggtctttaaagtgaagaagtagcctaaagatgtgattgattgctgtttgtttcctaaaatgactctctggtatagtgaccctgcttgtggttcttctcctacttatgacattttctgaagtagctactttctcacttaaaggattggaatttcccaaaattattcttccaaaagtataggaaccaactttctagaaggtctaccaccaagaggggagagacatgcttatatgggtcggtcagcaaaagtctcatcattaaagtgactctcgggcacatgagaggaaaatgtcagtaaggagaagccatggtgtagcaacagtggaagagcatggaatagataacatgcaggagaaaggagaggctaaatgtagaaaaacaaaacaaaacaaaacaaaacaaaacagctgaagaaaaaaaaagctgcctagagttttggaacagaaacctaaaaatattattattattattatgtatttattcttttttttttgagatggagctttgctcttgttgcccaggctggagtgcaattgcacaatctcatctcactgcaacctctgcctcctgggttcaaacgattctcctgcctcagcctcccgagtagctgggattacaggcacacaccaccacacccggctaattttttgtatttttagtagagacagggtttcgccatggccaggctggtcttgaacttctgatctcaggtgatccacctgtcttggcctcccagagtgctgggattacaggcatgagccactgtgcacggcctaaaaatattattaattgcaaatattttatctgtaaagaaatctaactgcaatatgagtaaaatacaactaaaaaaaacaaaaagttatccaaacttaacaatgttgccatatccatatattgcctatgtagttaattatgtacctactgaaatttaagaaattcttatacatttttttaaccaaaaatgagcttgtgtatctccaggtgtgaagatactacacttcaaaaaggatttctctaaaaaacaataactactcttggctgaacaagaaaaatttggaatatacagaaagcaaaaaggggaccaaggccataaagaagcattttcaaagtcccattcattcattcatcttttattcatttatatttcagttcttcgacgtaccattgtctgacaggtgtgtgcctgtgtggcatttgtactacttctactaatgaacatttatggaatgctttctctgtgtcaggcaccctcagattattttatataatgctcaaaataatctagccagataagtacactattatagataagaaaactgatgtgtaaggaatttaaataatttgcatctgaactgtcaaggatttgaacaaaggcagtttgactctagaaaaattctttccaactgacattaagatagtctttttcctttcctcccagtgcccatggtgcaaaagacagaaacattaacaaaacgtaaaaatgtcaagttctataacaaaggtatgtccacagtacaaggggcccagaaaaggaaatgaataaatgtttcatagaagagattctgtttaatttgaagattaaacaggatgaaatcaagaatgaagatgaaatcaagaagaagaaatcaagaagcaccaacagaaaaactgagggaggatattgtaaatgaaagcaacatcacatgcaaatgcatagaggattgagttagcataaagtaatgcaattaccttttctggggaataaagaagtgatgagagaaaattagaaaaggacctggtttgctccactatggaaagtgaaccacggcaattgaaaaattgttgacaaaggatatgtatatatacacacacacgtatatagacaaaggataagattttcatttaagtgaaactttcatgtaaaatggattgcagcagtacacctggatttagtgagatcagttagaagattgttgcaactatctaggaaaggcattatcagattatgaaataaggctgtagcagagataggcagaatatacaaggtatttaggaaggagaatcaaaagcatttattgacgtgcaaagagtgagtcagaggaaggagtctaaactggtccttgagcccttggcatgtgcaatagggtggatggtgattccattcaccaaaatgggaaacacggaacagggaggagtttcatgtggaaagttaatgagattcagtgctaaaatggaagggtctgtgaaatatcacaagaaacaagagaaaatagaatctggagctcttggctatcttaggagtgattttcaaaattggttgatgttcaagtttccatggaggttgaaggtaaaggtgaatatttagaggaaaaaatgaaagatgattgaatatgcaaccctttgaaaaaagtattttaatttaataaaattaagtaggtattgtccaatagccagtatatcactacaacactgagaaaagggctgagatgaattatttgtttgggtcttcctctcacctaagtgtgtgaactgggataattttagcaagtaaaagtaataaattcctaggttttagtggaaaaatagaatagtttatatctcagttgactgagataaactttagtttaactaaatttagacaggcttcttcctgattcaagaccctccttcccacctccctttcctagagcatttagtttagaaaacttgtttgttttttttcctctgtacctttgaaatgtacattttctcccagcctcttactagttttatgacccaggaatgtctttttcaatgacctgggagccatccctttgaagcacccttattttccactctctctgtgggagagtgggaacctaacttcagtaagctccaattatcaaacataaatgatctaatcacattggccaacctaccccctaacatgctccagtacttttctactagctcaccccaatgcttaaaaaccttctccctctttcaaaggagttgagttcaatttttcttctcctttgcaatagtctcaaatagtcttgcttgcctgtttaactctgacagagaaatttttctttgacacacagatgatcctcaacttatgatggagttttgacttatgatcatgacttgatcagaaacatggactaggtagcggcagagctgagactcaaattcaaattgttaaattcctagttaagaattacttccacagtagatttattatttttccaaaagaaatgtttatttaaacattttatactctctttaccattggtttagtgaagacagaaatagatgaaaagtcagggggtagaatatttagtccaaaggtttttagtataattttgaggctctaaccccattttaagtgcctctccactactattattcattttttaattaattaaataaacatttagtttctgctactatgtctaagatactgtgctagctgctgaaattgaaaaaaaattctatgtgatattatatctgccttcaagagatacacattttctacaaggaagattgatacagttaacatgaaacatgataagtacatgcttgagctgggtaagtagccttgaaatatagggcagggacaggtactgtcccaggggcattaggaaagagtctgggtaggagatgttgtcaaagaagagtttagattaaaaaatgaatacaagcaaaacaggcttaacagaagtgggacagaataggcagaggtaggaagtaaaaaacactaatctgtgtgggggaaagtcaagtggttcttgttgttacaacttattattagtggaggcctaaggaggagcagttcatgggggcctctggttacctgcagttattattgctttcaaagactttcaaacgttagtggccatctactgagcttgttaaaatgcagattcctgtattgtacttctaatagttgtaagatgggacccaaaaatctgcatggttgacaagacccccacctgatccctcaggtccttttattggttaggtatgtggaccacacaggaaatttaagggatgtgggtgttctgcagctccaagactccattggttaatctctcagttttctgggatgaggaagttatttggatattttagtgaaacacaggtcgttgcctttaattcttctttttgtagcaatgaaaacaacaatgagatatgtaaattcaatatagttcatttatctagttttatttttctaaggcctgaagaacgtctgttataaataatgtgagtttgagtgctggctcaattttgtcttactttaagaagaaaggatacattcaaagaacccactgtgttttaagacctcgatgaaagaatcagaagtgcttcagactgcattcagataaaattctcctgaataaaaatgctaaggagtgctggtactccacagcaggagatgctcttccatctgagaagtggtacttaggtgctcagaaggaagttggggaccatgggctaagctaggttttgatcacagggattttgccataggtgaattaaagaggtgaacattgtagcatttggtctgataaacagtccttctgtggagttgttcttgataaaatctagatgccaattcaaggacaatcagacaatgacagttccattttgttccttaaaaaaaaaaacttgctttatggttataggtgtggtaagtaatcaccaggtctctcaaacctcagcacactgcatcatggttcaaaaaaaaaaaattacaatgaacaagtcaggtatgtatctaggataagaagagaaagacagaaacatggtaattaaggagccaaaatagagtccatttccataactacttctatccctccctgtacccagctccacaaagattagaagcaaagccctgcagatggctattaaattacattattctatattagtgcttcaggagacgtagaatttaataacacctaaatacttaactaaaggaggggttcattgttagatataaatatatataaatgtgtgaatacatatctgtttataagaaccacaaatcaattctgatctgtgtatcaaattgttactctaattgcttcctcaaaagaactctctctaaaaagaatgtaatggctgtgaatgagaatggcttcctttcctctgagactaattgagattcaagagagaacctcttaccctcaaagggaaagttcatcaggcatgcaagtccaggcttgtcttcaaacagttctcccgggacttcagtcccatcctattcactcaaagaattctcttagatatcccattagggagtaggaaggagcataagccacagctatgcagggagttctgtgctgagggcaagggagttcttgcttgagtaagcattttatagaacattctaaagttggtgaagcaaaaacagaagactttttttttttctaattactgccttaaaacacacactgccaagtctctttctctcctcaaagagcatgttaagcagagcctctagttttcttatcacttctagtatttaaaaacttgatccagttcaatttaaaactgttatctcattctctccattcactcacccaaggtgccttgagtagcagccagagagacttggaggatagggaagagcatgctaaaggaatgccagcactttcagattcattcctctacttacttcagcacttggagtagagaaggtattatcacttattttatatcttgtcctcttccttttacctttagatcctgtttcctgtggtgagttagggctgggatgaggtgaaaggtcatagtcctttcctggaagttattgctttccttgcaaacctttgtctggtcactggtgcctctcttttgtcaggtatggaacatgttgattctcccatgagaacaaatgagttgtttgcaaaggccaagagtgaggagaatggcttctcaccgcacaattccctgataaaagagaagctcaaccttttgtagttgcctgtctgctcccatccctgacggcacaccctataactctgttggattgtcttttcctgtggccaagcctgagtaatttctttggtattcatttgatgcacaggaaacttacatcactgactaatcaaactgtttgaactaaacagctctccctctctccaacctgccagcttttcaccaatttcttttcttttgttcaataggcatagaaggtagatcagcaagctcattgtataagcaaatatccacctgggaattctctttcacacaaacatctccattctctaagagggattcttatgcagccctttccctcaatttggcttgaagataaggagactagcactttccctcctctaagaagaatgaaaaaccaaacaacttataattcaaacagttatagatagatgaatgatagagaaagacagatatacggattagatagataaagacatatagatctccctagcttttgctgcttagcacattggaagtgggatggcagaggttatgattgagataaaagaatcagctagaacccacttaagctctggaggggtgtcttgtccttaaattttcaagaagaggaatatagataattttttcttcttaactggagatctaagttgccaaagctaaagcagcaggaaaatttagttctccattttgttagtcacacatttattcctatggttttccttgtcaggagggctgcaaatataacaatgttcaaaatcatttcgagtatccacaagaaaaaggcaactttgccagtcttaacccagctcttagttaaatcatcagctttgaggcaatagcattcatcagactcttccaatgtatttcactaaatgtaatctcctttatctataaagcagacccatgaatgtattacatctaatcatattcaagaacatgatcatgtaatccagaaggccaatattcatttccatttttgtcacggagattgctttagatcaaagggggcactgctgactacagtgtaggggacatgtgagtcagagtgaggtaaaaaggacaagagaagcagaaagcatatatacatcagagccttctgagactcagaggagaaataattatgaggaaactaatggttgggcacaggtggactgaacaacaagctatttctaatttgaactacaaatttcagtatctgcatgggatctggaaggaaatgacaaggtactgcttaggggaaaaaaatcacagggaccaagtctctttagagaagaatggtatatcactttggcagctgtgttgagaatagaactgaataaaagcagagacagaagcagtgagagcagttagggggctacggattaattaaagccagagacaaaggttgctgggaccaagatgtcagcagtggaggtagtaagaaatatttgggttttgaatgatttcaaaggaagagctagccagtttttctgatgcattatctatggttatgacagaaagaaaggagtcaggaaagatttgataaagaccgaagaattttggcctgaatgactgaaataatagagttgctattaataatggagaaagtgagtgacaacagcaggtttagagtgacgtggggagacatatcagtttcagacagggtaagtttgagatgcctattaaacacttaagtgcagatgtggagtaggaagttgaacatataagtctacatttcagggcagagaaccaggctagagatgtaaatttgagagacagcggcatgtagatattgtttacagttagagactgattgaaaaatcaccaatgaaatgaatgcaatagagagcagaacatatccaaaatgtagctctgggacatgcacttaaacagatcacagagaggaggagaaaccaggaaaggagactaaaatgagcctgagtagcatatttaataaaataaaatttaataacatatataatttttagacttgtctaacttatttttccattaacagttaaataattgtataactttaaattattgaggaaaatttgattttaaaacaaaaatggtatgaatttcagattctataacaaaataatgaatacattaatgcatctttcatttttggtctgcaataaaatccttttcaactttcaatctacatgagtatagttcagtagcattttattttaaaggcattcaccaatgaataataaatctttatattcaggaactgtttccttctgtggctgcaacagaggagaattaatttatgtccaactgtcttgctttttaaaacagaaaactctagatgacttagtcctcactgcttgacacttagaaagataactttcttgttttatactacatctcatggcctggtatccctttcaagttcttttgggattcattggctggcttattactggcaaattcagaagcgggcattataaagtagaaatgtaactcagagagtagctgagaatatatgtcaaaaacttgctgtctctcttctcgttgttttcaaaatcagtacataatttattataacaaggtgaagaatttattcaccaagcttccaaggagacagaatgtcaatcgaaaaccatcagaatggaattaatgaatctttcctgggtgcagagtacagtggagtggattttctggtaacttgaggattatgtgtgtgacagagggactgaattcatgtgaacaaagacatgggccctggaaaggaaaatagaaagggagagaagaagagcttagtgatgggaggactgtgtgtgtgtaagcatgggggaagacagggaaataaatgataatgatgatggtggtgatgatttttacaagctatcttgaatggtgggtgagaagggggaaaagatggcctagaaaggtatttgagaagccttctgtttacttcattgtataaaacacttgcatcctaactcaaaaaaaaaaatcaaagtaaaaatctctgttatttatcaatgcttcttaaataactttggtctagttcctgagtctgactgaaatgaaatcatactagataactgagccacattaggagctaaattattagcaaaattgtactgtctcatggtaaaaataggataagacatgagcagaatatcaatgcaaagccaaaaggatattgcagagagtactttgaatttgaaatgatcatttgggggagaatgcacaattcaagatatgatgttccagctagactctaggtgctagaggattggacttaaacagtgttacacaacttcacaacaaaaaatagtaactcaagaaactttctcctgaaataactactttgcaaaatgattcttaaggccctaaaggatacccaatttcttgagacattggtgtgctttcttagaaggaatagaggttgctgtccaatatatgatttctgaactgcttcactggcctagcacaatggattgattgtggctcttttctaatgtccatgaaggtattgtataagctaatggaaacattgctctcagttgtcaataatataattttttgtattatttatactgtttttaagcacatatttatctataattatgtctgtataaaaagtgggaaaatacacctgtccattgggagggtagcctgcttcctttagcccatctaattcatttctgttacttccttgctcctgttaagcatttgagattatgattcctgatctgtggcattgggcattaggtgctatctgtagactcagattcaccaaaactaccatccagtctagtggcagttggcttcaccaacctagaggacataaatatctagatgaagttgagttgagtaaaaattttggaaagacattttctgcctgtgtgttaaactcacagaacaagttaaaagcaagacatccactaggaagaagtattaaaagattggataatcaaaagtacctgcaacaagatgatggcagaattacctatagctaatttaccaaataatcacagacactctcctttacaaactgatctcaagaatctggtaaagcaaatcagagctgagaaaaataagttaattatggctataattaagaaagaaagccaagtaatgatgctaagatcatttaaggtaatctttaagtggattgaggttctgagttttcaaacaaaaacattttatactgatttccattgttctgtaagttctgattaaaacaaaatgttctaccttctaattttaatacacaacaatccatatatatatataacttttaacaatgaatttgattttgaagaaaataaaatagaagtagaaatttagttgtattaaccagaaaataccaacatgtacctttaaaaagttattctatttgaaatgtttaatatgaagataatttaaaagtttcagtgaaaatcttaaggatgttaacgtttgttaacatttgtaaatgttggaggctgcgatagtgccccaaagatgaacaataataaataataagaaaaattttatctgtaaaaatatagactgtctacagaaaaaaggagacaggaggagtagcctcccaaccatagttctctatgtaagtgggagtggctctggaagtttcaggaatggtggggggatggggcaggtttttttttttttttttttaaattaggaaaaataaaaataagctgaggcatcagttagtctcaggctttaattgttagtacctaagtagaattcaggcaaaatgaaaggaaatcaatataaaccttaattagaggctaagaaatcaaacctacctgagttagttatagagttgacagcagtctgctttgttgggtggaaactggctcagaggtggtttgggatagagtagtaacctggcaagggccaccctaagattgcttctggcccactccagttctgccttccttggctccaacctcatccttagtgatgtttccaccttgctattgggtccacaaacaggcaggtgtgccaactgtgtgtcatttcactcacacatagagaaaaacaattcttgtccatcagaaacttcataagggttctcttagggatgtgtggagggcttattggcctttgtcaagttagagttctgaatattttatcttacttaattttaaaagttaaataccatttgtttttcacagatagtagaaaatctccctgaaattgctctacataagtagtgattcattaaattactgattgacattactaattacttttacctccaccatgaagctaggcaccaagcaaccccaaaaccaatgcccaagttaggcaaacgaggatccaacaaaattcaaacttacctagaagtggtctctgtatgtgtcgactgagatttaaaacaaatttcagtgcaggggagggtgaggctcagataatgtcatttcccagctgcaatggctcctgtttagccacagggtaactttggagctacttagcattatttaaaaagggtctaatgctctggacttctctagtcattcatcagatccaactcactgtgtcctcccctgcagtcacactgaactggctctattccttttgcctgaaacacacttttctctcatttcctactgttgcttcaaatactaatgtgtggccgtagggcgtggtggctcgtgcctgtaatcccagcactttgggaggccgaggcaggcggatgacctgaggtcaggagttcaagaccagcctggccaacatggtgaaacccagtttctactaagaatacaaaaaaaattagatgggtgtggtgatgtgcacctatagtcccagctactcaggaggctgaggcacaagaatctcttgaacccgggcggcggaggttgcagtcagcagaaatggtgccactgctctccagcctgggtgacaaaagcaaaactccatctcaaaacaaacaaacaaacaaacaaacaaaaatgctaatgtagatttttcttactggttccccaaagccggatcaaaaactatgttaaaagaatgaatgggctccggcaaaaagaatggtggaaaaactaagtattactatccatattatccattttccctttttactttagtccattattgtgtaactccactatgtttttaaaataccatcatagtcataattattgacagagtagcccctgctgaacccatactatttgaagtttgaaaaagaacactaaagtcatctagttctgcccacctgatattactaatgagaaagcagttagtagtaaaaagaaggaaagcattaattgaaggggccactaggaaaacataattacacggtctgggattacttcatcatgagacattatgaaaatgttcaatccaatgaaagtcatcaatatataggtaatgcttcaattaaatttgttgtactttggaaaattacatattaaatcttctcaatttatcagctagtcagtttggagacaggtaagaggaaaaacttggaaaataagaaaaagaaactgcttttaaaataatcaattattatatgacaatctactaaaggtgttagacagttatagttcatctatttcttagtaaaagttcatttgtatacttttttcctttttcttttttttttttttaagacagagtcttgctctatcaccaggctggagtgcagtggcgcgatctcagctcactgcaacctctgcctcccaggttcaagcgattcccctgcctcagcctcctgagtagctgggactacaggcatgtgccaccacacccggctagttttttttcttattaatattattatttattttagtagagacggggtttcatcatgttggccagaatggtctcaatctcctgatctcgtgatccgcccgccttggcctcctaaagtgctggggttacaggcgtgagccaccgtgcccagcccatttatatctttataataaaatagatatgtattattagatactatagtggaaggagaaattaaaatttagaatgttaattccttctgtggcaaatctaaataaaggtccctcatttcagtagattctaaattgatatactatgtaattgatgttttacttttaattatgatcatccttccttcttaccaacataatctgagatttcatatgagtgtatatatacaaaaataggccaagagcagtggctcatgcctgtaatcccagcactttgggaggccgaggcagacagatcacttgatatcaagagtttgagaccagcctggccaacatggaaaaaccgtgtctctactaaaaatacaaaaaattagctgggcacggaggcatgcacctgtaatcccagctactagggaggctgaggcaggagaattgctggaacctgggaggcagaggttgcagtgagttgagattgcaccattgcattccagtctgggcaacagagtgagaatcggtttaaaaataataataattccaaagatcatacatatatatcacacacacacatatatatgccttgaaccttgttgactatatttaattggaaaaataaaaactgaaaaaaattagcaaatgatgccttcagaaatcatatattttaaataaatgggtgttttagcttaaatgtatttattataattgatcattattaacacatttttgaaaattagtgtgtaccatgaatagataacataccgagaaaaaatgaatggaaactataaagtgtattaaactataactaggaagtatactatagagagtttacacatgtgaccaatatttaccattcattaatctttatcttttaataagagctttttttaaaaggaagcttctaaaaggtttctaaaaatttgttttaacatgaaaaattaaaagtgtaatttccttaacaagatatgtttaatatagaatatcaagaaatgttttaagataatgattatgacagtcctggtaggataatgtgtttcttgttgtggtttcttgtacataatgatgatgaggttctatttctcactcactactacacttacctccacattttggaatcagtccactccacattacttttccatccataagaatacatgtaattgtttctgttccctgggttttaataaatccttcttcacaaataactgaaattgaacttcctaattgaaagttgtccccaaaccgccgtgcattgattggtattccaggatcagggcattcattatgtccaaatgctttagaataatatgcaaagaaaaatacacaaacaaacaacattagccagagagagatccttctatattttggaaaagagagagagagaaagagatattttaaaaggttgtgtttatttctacacaagtttttatttatttactttaaatttggaggttctcctctgaccttacctgtttgcctgtgatgtgcaataaatgtgaatgttttaaaatgtgaattacactctaaaattataaaatttcaaaacagaattatttctgcttatttctggagaccatgagactagctaagattatgaaaatatttccagtataagctggtcagaatttcaattaattaaaatgcaaagcaattgacagaagcattagtatgtattcctttggaaacttttatttatttttctctatttccaactggaaatagagagagtgagtctcatcttgagaattaaagtgaaatgtctcaatctagtatgaaactgttacaactttttaaataattttccatgacatttattttctgccatctgggaaaaaggaagagagttaattctttcgcaattaccatgttccaagcactgtgatatgttattatctcatttaatatttagaatagctgatgaggaaagtattgccatctattcaaaagagtaatgttagactcaggaaaagttaagtaacttgcctaatgtcatagaaatagggcttcataggattgaaatgtatcccctggaccggattttaatttcttctcaacaacctattgtatcttggcttatttgtctcatgtatctcaggagaacaggagttcttgagctcagggccactatcttattctaccttgtttgtctcacagtttatatttagccaagttacagcaaatagcaggagtataataaaaatgggtttatttgaatttttcatagattatagattacatgaacaatccaaatttttctctgtattcatctgagtgaccaattgtgtattataaaattttaatgtattacaatataaatggaagaatatttaaagaggcaaggtctacatgtgtaaaatatattttatgagatgcttataacttattattatattcatactgcattagtacatgcagtgattttaaattttctcactaatcatcactttgatgctggttataaattgtataattttactatctgttctccttattttaaatgaaacagtgcaaaagaatattaaggtacgttttagaatacataaaatatgttttatatgtatacatatttctaattattattttattttgtaattttaaaaactcaattttgattaagcagtgtaactctaatatagagtacctggtagatattttttcagaaaaaatgaatctcattagtaagcattaaataaaataatttgcacattatcaattaaattatttactatagaacagaaccaggaaaagggagacctatttccataataccctgaaaaactatcaacattaaagttaaaaatattatgcatttaagacaaaataaaaattatagatagatagatgcatatacatgtctatctttagacatgtacatgaagtattttttaaaaattctcaaagcagtcattttatataagtttctatgacacatgtcaccgctaatttaactttaataatatgcaattacatgtttacaatttacagcgacactattcaccactagtatcactttgaaaatacaacaactacactttgtctgccaaagcttaacattgaataggtgagggtgggagtgaagtgtgaaattctttttataaagcaacaggaagagctggaaactaaatccttttattatgtgacacttaaatattaactcatccaattggtcaatatctgacacagtgtaaaagcttcaaggaaaagcaataaaaattactagtattctatggcttcaggtatatttgcaaacagaagcattagtatctaagtgttattaatccactaaggtttttttcttttttatgtgattcatcttttttctatgattataaacatttttgcagataaataatatttaacatctcacacaacaacataagatgtcaagataattgttcaaaaaccaactaaacaataatggctaatgtttattaagcttttactaagtaatatgtactctgtgctaaattattcacatgcatcacctaatttattctttatagcaatccattgtggtttcactaatgtgagtactgtggctcagttataaaacctaaaacaaggctaagatccaaagttaattatttccttttctatgatgctactgtagccatgtgattttttctttggaattttaattctatgccatgattagttgtttaatatctattggtgcatgaatatctttaagggaaactctatttctcttttatgttgcatacaaataacaaagtatgtgatcaataataggtttgggtttatgctaagatataaatatgttggctgatataacaattataaatatattggcttacataataacaatatttgaaacatatttccttgatattgggcctctcacaaaaaaggaaatgtattaatataatagagagtaaaatgtgattggaaatgaaggaagaaatgaccatccttggcacaatgagatttacagcttttacaaattttcttaactaggaaacaagggaaccaatatacatgatcacttttcaactcaaatttatagaaatatattatatgggaaaaaaacagaaacagaaacttactgttgtaagtgatgttaaagccacgtcctgacattgagtggtcagcctgaaattccaatcgcagtatgtgactattactagtaagatgggaaggcacctcagccccagtaaaggttccaagaattggggattctggagagtcaccatctttaacagcaaggaaatcaaactgggattccaggtcaaagtcattgaaagaaagatgtatccggctccctggatcagagattatcgtccagatgcaatttaaattatttccatacccttctgggtaatcaggagaaagaactgttcccattggtgcagtaaagttagacaggcagggaactggtgaaacaggaagattatgaaatacaataaatattcaaaaataatatttcatcttattttgtcatattctacaattatgataatcaattagcagtataagataatattaaattatgtaaattataaaacagaacaaaacggttaccatttttacatattgaaaaaggcaactagtactttggataaacttaaggctctacccttaaataatgcacaaaaatataattggaataatagcaattttttgacatatatcttgtttatgttagactgtataaagtgttcatttcagtgtttaaaaagtgaaaaaatatacagaagttcccatagaaagcaataaggttcttgaaatgattgaagacaaaaaatattatgtggatattaacagaacaagaatccggtagctcagaaaacactcaaggggatggttatcaatgtgtgagttccatttctatggtggcaatggatgctctgatagtttactacacaaataaggagataaactaacttctttaacagccattagtggctaaaacctgaagaacagctaaatgagagctcttgccatcacactaaaatgaagtctttctcctccagtttttttaacttttaaaaacatgtgatttgaaagttcacatagaacatttagaaagcagaggaaaaataaagaaacagaaaagaaaatgacatactactcaaaggaaatcaaagtttaagtattgatatattatcttccaaagttttcattacattttttttttttttttctgagacggagtctcattttgttgcccaggctggagtgcagtggcaccatctaggctcactgcaacctccaccttccgggttcaagagattctcccacctcagcttccggagtagctgggaatacaggcacgcccaccacgcccagctaatttttgtatttttagtagagatggggtttcgccatattggtcaagctgatctcgaacgcctgacctcaagtgatccacctgcctcggcctccgtaagtaatgggattacaggcgtgagctaccgtgcccggccttttattacatattttttaaaaaattgaattccctacattttgtactaaattatgttttccttatatttaatatgtgagtttttcaagtcgagtttttaagcaaaatttatacttattagttaaaactctcctccattaatttatatggacatataaacattaattgaactgttcttctagtgtttgacatttaaaattgtattttaaaatttttgcaatataaataacactgactctattcttgaagaaagcttttttgttcattatttccttggtatacattttcaaaaaaagcacttagtatgacaaaggatatgaatttaagcctcaaaacattttgctaaatttctgatttaaagttattttgacgttattgaaaaataacagaaatatcagagaatacaacacccgtaacagtataaaatattgtgattattttccttctcctccattgataagaaaaatgataactcattgtcttaactcgcatttctttgactactagagaagttgaagatttcttacttttgttagacattttcattttcttttaaaaaattatctgctcataaactgatcatttaagtttatgatctcttagtttataatatgcataaaactttctcattattttgtaattttagtattttggcataaattatttgttttaatttgaatattaaaataattgttcgcatttcttacaatcttttagcatcatatgttttattaacattcagacattataccaatatctatttatctacacaaatataaaaccataggtatagctgcatctaccaacagatatatctctctttataacttttatcattttatcattcaaaaatattttgtactttgaatctatttattttctgcataattttatgagttgaactgaagcttgcaaactgacagtcattggattgaattcagattgcagatgtgtttggcttgatttttttttcttctgcccccataaaaatttgaaatcacattgaaaaatcatcatatttcatatttaaggggaaaacatcttttattctagcttatcttgaaaagttaaggcaccccagtttcctaccacttccaaaatgggtgcacacatacttactcctaatccctcttcacactgtttcctgcctgcatcctggaataatttgatcctataactcctgatctaaattaagggtcggaaatctttttctgaaaaggagtaggtaataaatgctttggctttgcaaaccatacgatctcctttgcaactatttaattctgcaattgtagctggaaggcagccatgcacaatcagtaaatgaaagtgtttggttatgttccaataaaactttgcttaaaaatacatggaaaggaggatggatttggcccacaatctgtttgccatctcctgatctaaatgatccccacttggagcaagagctaaccaaagacacactttaatggcccttatcagatagatagatgcttatatcatactttaaattcttaattatataagatgcagtttttatgtaacttcccttcacaatttgttagtaccacactcataacttaagatgatacttaagcatccacagaagcactttgcttttacaaaattcttgtatctactcctgcctgttttattacttagctatatgtcaatacaatacgtcaagttcccagaaaaactatgttagaattttgactaaaattgcaaagcaatttctgtataactcatgtatttgaaatagtgatttatcattcaggaacatggcttctatctgtatttcgttctcataaaattttattttcttgtaagttttataattttttgtatgagttatttgaaatatgtgaggattatttatttgtattttataattgtattttctgaatgtattctcttttaaatgtatttccaagttagttattactggtatataaaacattattaatcgctacatttttatcatatatcaggatatcagacctaattttaaaatagtaaaaaatgttttctagtattcaagaatgttttaaaaattggttttagtcagcaaaattttcagtattttcactaaatgccttttggaatctgttaaaatgctcttaaaatatttttatttttgatgtgatatattacactaatggattctccagtattaagccaacgttgtcctcctagaagaacacctagaattaaaaattgtcaacaaaagtattttgaagtattactaagctttggtaaatcgaatcagatcctcctaatatattttcttctcttacaagaacttcaccaagtaatcttggttaaagataagaactaaaacaaaaggggactgtgaaggggacgtatgcacttttcctcttctagacttcctgaagagcaaacacaatatattgttattagggaaatttctgccagattctaaaaatatccacttcattttaatgtattgaagacagcatttaattgagcacaccaagtgcgtgaataggcaatacaaattatacttttgctgtagttaaactgcaatatcttaatgtatttgaatacattattttaatccaagcatattgtatatcattaatgttaatgaattgtattgtatgcaatataaaaaaatggcacctcatgcattagtgttaacatctacaagcaaaaataagttagtgcattatacatacaatataagctttaaatattttaatgtttttgattgcaaataaacatatactatcttattaaaataaatgagtctattagaattcattcagatgtataatttccataagaagtatgctctctagaaagtataaaatgtcatgaaataaaatgttgtaagaacacacgtaatatatattttgccattaccaagtgaactatgttaactttatttaaatctgtaataaaatttataatttggcataagcacacttgttaaagatagcatcacaaagtgctactcactcaaaaataattacacggttgcagctctttgcaattaattacaaaagcaattatatgcaaggacagggtaacatatgctatctggaagcaaagcatttggtactcacagatacagatgggtatgtttgcagaccattggttattctcttgacaaacaatggatttctctccaattaattcaaacccaaactggcattcaaaccttaaaacatcacgattagaaaatccatcgccttctctaattccatataagggtgtaccaggatcaccacaactttctttctcaatttctggaaaaatagaagataaaagtcaccttccaagggttgcaggcatatgatacccataatacaagttaggtagatatatgctctttgttgtggagatatttcagaacaaaaaataaatatattctccaatctttttttttttggccattcttacaggcatgataaaatgatctttagataataattagtatatttctttctttttatatatgaagaatctgaggttatcagagctaatgaggtgccagaggccatgtacttaacagaaaaattatgataagatctcatattttctctctgtactacatatatacataaatgtacacacacatagacataaatgtatatttccctcaaatcccaaagacttttcttattcttgtcatttctacaggatacggtaaatccctgaatcatgaccaggacacgagggaacattctctgtgtctatactcctacagaaatcaatgaatacctctcacctaagatctcttccacactctggtactagttggttgaattattttcccaactagacccccccccccaacaaaaaaaaaatcttctcaaaggaagcaatcagttttgaattccaaattactcagctatgttccttaataaatgtttcttggatgagtggaaagagattgaaaaaaatattttaacaccattaaaacaacctttgagatgtatccaaagaaacttcaaatatctgggatcatcactgtttaactatgaatgttagcagtaaattattgtggtggttgatttgccttaaaagtcacataaaatcttagtaatacagttgtcttcaaacaaacaatagtaaaaaaaaatacaaattaaaaaaatgtaactttaagataaagttatagtctctcctgacactcaaatatcgacacattgctagttcctccgttatccactagcatcgatttaatgtgtatctttccagttcttttttcaagatgtataattccacacagacatatctaatatgtaacattatagaaacctaaaaattatcttcacaaaaactatgcagtattgtttcatgtacatcatactttaacttttattatactgtcaatattattttctttctcctttttaaccaaacactatgttttagagatactattgaacatccttgtatccttagcagaaatcatacatgcatttaaacgtttctttaaaaaactggatttgattttatattttcttagactttttttatctatcagggacattggtctataacttttttcttctgctcttcatatctagttttaatatcaagggaagatgttagtaattttccacattttactagtctttaggttaatttgtaccagaaaaaaattggattcttgcatggatgagtttggtagccatctgagtaccattttttttcttcaaaggttattttcctatttaagtgtttcatgttgttgtttgttttttcttttgcttgtttcttggagagggttttgggccaatattggcaacttataaacattagagaagtgacatttttcaaggtttgctggtagtttagttgtaacagaattgttacaagattttttaatatctcctttataaatatgccataattatttctgacttctaatgctattagtgtttactttctggttttctttcttcatatttacaaaaggttgtcagatttattaggtggcttaaagaaccagtgtttgctgttgataaattgtttttttgtttgtttgtttttttgtttgtgttttgagacagagtctcttactctgtcacccaggctgaagtgcagtggcgtgatctcggctcattgtaacctatgcctcccaggttcaagagattctcctgcctcagcctcctgggtagctcggactataggtgctcgtgccaccatgcccaagtagtttttgtatttttagtagagatggggtttcactgtgttgtccaggctggtctctaactcctgacctcaaatcattcgccctccttggtctcccaaagtgctggaattacaggtgtgagccactgcgcccggcaaattctattgtttttattttaatttaaacatcttttctttttatatttttggattccatcttcagttttcttttggattatattgctattcttttttctgttttcttgagttgaaatcttagaacttttttagtatattttcagcctttcttatttattaaaaaataaaataaatttagctctaaattgatatggagagattttattgttcacttgtgaaaagtttgtagcttatgttttggtttactttgtaactcataaataatgtctgagtgttttaaaatttatgggttgatctatcattttgttgctgctttctaatgttgtttctttggtattcagtatatgtatatcgaggtcttgcagtggataaataagtgaaatatattcagttcaatttgttatattaatcaagttgaaattatttatgccttcaatgtctactggctccaacaacttcttgaagaagcctgttaaagttccaaatgtggatttgacaacattttttaatagttgaatcaaattcatttcacatactttaaagcatcattcagttagttagtttatacaacaaacagttgattgtcttatacactaattcctctttatctgcattttgctttctgtggtttcagttacctgagataatgtggtccaaaaataggtaagtatagtacagtaaattattttgagagagacagagagcacattcacataacttttatgacagtatattattataattcttctattttatttttagttattgttatcaatctctttctgtgtctaatttacaaattaatctttatatctatctatctatctatctatctatctatctatctatctatctatctatctatctatcgagagaaaataacatagcctgtataaagttcaggactatctgtggtttaaagcacccattggggctattgaatcatatccttatgaacaaggggggactactgtatttacatgtgtcagatgctgttccagggatctaagatacaccaataaataaacagacaaggatttctgctccatgaatgcatgtattccattggatgtttgcaaactataaataataaacaaataatgtcttattttagaatgtgatatatagtacagaaaaggaaaagattaaacaggaagtagttgtgttaaagtgctaggtgattgggggtgacactattgctaggttcagtttattactcttataccttcttcgaaaaattgtttctgttattgaaagaataggtccttcttcatctgaaaatgtctttattttgccttcactgttgaataatagggggtaaggtataaaattttaattcaaaattatttgccctcagcatttaaagatgttttcctctagtctattatccatccactattcctgataagaaatatgatatcaaattgattttaattctttcataattaatctgccccttctcctccattcttttaagagctaggattccttttcagacttgctgtttttaaatatactcatttttaaatctattttttctactaggtgctcaatagactacttctgtcaaataccttgtaacttttttttcagttctaggaaattgttaccattatttcctttaaaatgttgtttattatatgtcctcatgtttctgaaacttgttcatattgaatgttgaaaattaggaatttagccctcatgttgcgcaaactttcaacttctcatttttagggattctctattttgcattctagaagaattcaataattccatatgtatataatacacatatacacacacatttatatatttatatattataaatttcagtttactaattcactgtttagttttatttaattacaaattaccttaaatactgaaaaattatgttgtcatttcctaaatatttaatgactttaatgattgttatttcttattgtttcatagtcttctttttttccataaatacaatttccccccttaattttgtgaaggtatctactctaattattttaaaatattttcttattgctcttttaactctgtttccttggatttaatgagaagtgtatttagagagtagcagagtgaactttattctaatgcagcatatttgaaaatttatacagtgaatcataatggctgttatgcctatgatgaaaaggcacaggaggaagtagtttaggggagaacaaaacttgtgtttgagcaagaaaaaacaatgataacaaacatttatttatatgtttatttacacttatttatcttaggaataccctacagcctcaaaacaattgtaaatgttctcttttcattcttagtcattattatatttttaaatacgctttctattatcttgggtttagtgttgagagtgagtgttaatctatttgaaactctatttttttctttgctccattaatacaacactctttaaaattaagaacatattttaaatttaatgaagctgtaaatactctctaacatagactggaaacaatacacagtaagtaaagtaaacatgcacctagtatgtaacactgcttttgggtttttttcctatgcagtagtgatatggttaggctttgtctctccacctaaatctcataaattgagatttttataaagtcttaatcaccatgctattgtggagaacttttcattcactagttattcatttataaaacctttacttagtttctaatatttataaaaaataaaataaggatggccaaataggaacagctccagtctacagctcccagtgtgagcgaagcagaagacgggtgatttctgcatttccaactgaggtaccaggttcatctcactgaggcttgtcggacagtgtgtgcagcccaccgagtgtgagccgaagcaggggaaggcatcacctcactcaggaagcacaaggggtcagggattttcctttcctagccaagggaagctgtgacagacggaacctggaaaatcgggtcacttccactctaatactgagcttttccaatggtcttagcaaatgctaagtctctcctgacactcaaatactgacacattcctagctcctctgttatccactagcaccaatttaatgtgtatctttccagttcttttttcaagatgtataattccacacagacatatctaatatgtaacgttatagaaacctaaaaattatcttcacaaaaactatgcagtattgtgttatgtatatcatactttaacttttattatactgtcaatattattttctttctcctttttaaccaaacaatatgttttagagatacttttgaacatccttgcaaggctggttcaacatatgcaaatcaataaatgcaatccagcatataaagagaaccaaagacaaaaatcacatgattatctcaatagatgcagaaaaggcctttgacaaaattcaacagcccttcatgctaaaaactctcaataaattatgtattgatgggacgtatctaaaaataataagagctatctatgaaaaacccacagccaatgtcatgctgaatgggcaaaaactggaagtattccctttgaaaacaggcacaagacagggatgccctctctcaccattcctattcaacatagtgttggaagttctggccagggcaatcaggcaggagaaagaaataaagggtattcagttaggaaaagtggaagtcaaattgtccctgtttgcagatgacatgattgcatatttagaaaaccccatcgtctcagcccaaaatctccttaggctgataagcaaattcagcaaagtctcaggacacaaaaccaatgtgcaaaaatcacaagcattcttatacaccaataacagacagagagccaaattatgagtgaactcccattcacaattgcttcaaagagaataaaatacctaagaatccaacctacaagggatgtgaaggacctcttcaaggagaactacaaaccactgctcagcgaaataaaagaggacacaaatggaagaacattccatgctcatggatatgaagaatcagtatcgtgaaaatggctatactgcccaaggtaatttatagattcaatgccatcctcatcaagctaccaatgacctttttcacagaatttgaaaaaactactttaaagttcatatggaaccaaaaaagggtctgcattgccaatacaatcctaagccaaaagaacaaagctggaggcatcatgctacctgacttcaaactatactacaaggctacagtaaccaaaacagcatggtactggtaccaaaacagacacatagaccaatggaacagaacagagccctcaggaataataccacacatctacaaccatctgatctttgacaaacctgagaaaaacaagcaatggggaaaggattccctatttaataaatggtgctgggaaaactggctagccatacatagaaagctgaaactggatcccttccttacaccttatacaaaaagtaattcaagatggattgaagacttaaatgttagacctaaaaacataaaaacccaagaagaaaacctaggcaataccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaacaaccccatcacaaagtgggcaaaggatatgaacagacacttctcaaaagaagacatttatgcagccaacaaacacatgaaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagacagtgtggcaattcctcaaggctctggaactagaaataccatttgacccagccatcccattactgggtatatacccaaaggattataaatcatgctgctataaagacacatgcatccatatgtttattgcagcactattcacaatagcaaagacttggaaccaacccaaatgtccatcaatgatagactgggttaagaaaatgtggcacatatacaccatggaatactatgcagccataaaaaaggatgagttcatgtcctttgtagggacatggatctttgtagggacgtggatgtttgcatcattctcagcaaagtatcacaaggacaaaaaaccaaacaccacatgttctcactcataggtgggaattgaataatgagaacacttggacacaggaaggggaacatcacacaccggggcctgttgtggggtgggggcaggggggagggttagcattaggtgatacacctaatgcaaatgacaagttaatgggtgcagcacaccaacatgacgcatgtatacatatgtaacaaacgttgtgcacatgtaccctagaacttaaagtataataaaaaaaaataaggtactaaggatataaagacaaataaaatgtagcccctgtccttaactgaaggcacaaaggaggtattagctaagtctccttggatttggaggttggaaaagaggtaaagactgcacagaagaggtaaccctaaagctattttcagagttatctcaccgagtagactaagaaggacaaaagaaagaaaaagtatcctgaatagagagggcagtatcagaaaaggtataaagcctttttcttcccttttctttcaaagtggaatgggtagagttaggtggcagtggcagtggcaccagaggttgaggagatattagggtcaagtacgtggtattatggatgagggccagagaagtagaagtgaggctaaaaaggcagccggtaaggttgggaggttaagtatatgtgaagaaggttgagaatcagaaatattgaagataagggcagacagacttctcactaacaaaaaagagcatttacaaatgtagaaacagaaaagactacaaagaaccctaaggggttaaactgaaatgttaaaaaatcgtgtgaactcaagtttaaaatatgaatataactagatataaatgggtggatatacatacatatgtcatgcatacacacatatgtacacatatatgtgcacatattttctagctgcatccactgagagtcctaaaagcaataaagctctatagaaacaagtatattgagtacccagatttggtttctacataccattcttcactaaagggaaccaggggagctgattttaggggatggacaaggaaaaagataagatgaaactggaataccttgttgtgccaataaaagtagggtgtacttaaagaatgatggtggggacatatcaaaaggacatagaggccagcttgaagaagctccattggctattctggtgcaatttaaccatcaaacaaagataatggcagagtacaacacattgaataaaatttaaatgcattcatccatactgacataaataaataaatgggacagaagggaaaacattttctccataaagaggtgaaaggtgaagccggctgggcttctgggtcaggtggggacttggagaacttttctatctagctaaaggattgtaaatgcaccaatcggtgctgtgtgtctcgctaaaggtttgtaaatgcaccaatcagcactctgtaaaaacgcaccaatcagcgctccttgtctagctaaaggtttgtaaatgcaccaatcagcactctgtaaaaacggaccaatcagcactctataaaatggacccatcagcactctgtaaaatggaccaatcagcaggatgtgggtggggccaaataagggaataaatgctggccacccaagccagcagcagcaacccgctcgcgtccccttccatgctgtggaagctttgttctttcccccttgataataaatcttgctgctgctcactcttcgggtccgcagtacctttaagagctgtaacactcactgcaaaagtctgcagcttcactcctgaagtcagcaagaccacgaacccaccagaaggaagaaactccggacacgtctgaacatctgaaggaacaaactccaaacacaccatctttaagatctgtaacattcaccgctagggtccacggcttcatgcttgaagtcggcaagacctagaacccaccggaaggaaccaattccgaacacagagggacagttaataaatacagaataagtggggaaaaaaagagaaaactaacatctggcaaccatcacagtggttgtggatttttggctggatgtttgataaaaaataagatattacctctctgtgaaacacatataaatcacaaaggtgaaattggtgatgttctcatgaaaaatcctggaagacatcaattttactaggtgactaatgatcgcataggacgtatattcaggtatattgacgttgtttgcctcctggtgtgatgtcctgagaggcgagcatcatttttgtgatacatctgtcaagaatgtgtggcctatgcctggatatgggaaaatattgtatgtacccaaattgagggatatatcacaaaataaaaggcttatactctttagagctatcaaggtcatgacagatagggaaacattgaggaactcatccagattgaaggaaatgaaagagacatgacaacaatgcaatgcaggttcttgggttgaatcctggacaagaaaaaaacatacacgtgtgtgtgtgtgcgtgcgtgtgtgtagttagtgaaatttggaagggttttaatttgtttggaagtgttttatttatgttgattttctgatttgtatggttgttttgtggttacataaaggagttttttgttttggtgcaattcaaactgaatatttgggaatgatgagctattatgtttgcaacttgttctcaaatcattccgtagtagttttaaaacatgtctgcaaattatttgatgcttctatcaaaaggtagagtcagctgggcatggtggctcatggctgtaatcccagcactttgggaggccaaggaaggcggatcacctgaggtcagaaggttgagagcagcctggccaacatggagaaaccccgtctcttctaaaaatacaaaaattagctgggcatggtggcaggtgcctgtaatcccagctactcgggaggttgaggctggaaaatcgcttgaacccaggaggcagaggttgtaatgaggagagattgtgccactgcactccagcctgggcaacaaaagcagaactccatctcaaaaacaaacaaacaaaagcaaaaaaacaaaaggtagagtcaaattcccctcttttttattattggccagtattgttgcctagattttaatgaagagaatatgacagaagtgacactcatgaccatttctgttggctcctcttctaatgttaccagttgtctcaggctcatgcaggcttacggacagaacaaccatggtaacagttgccgttttcttgtcaattgcaacataaactactatagcagctccagtacccagatttgactccacaggaacacaggaatcttcctacaggggctggatagcagcatcaaattgtggagaatttaaagcctgagagatgaaattttaccatcaaggagcaagagaagagatgggaaggagaccagtagataaatttctaacccttcctctcccaaaacagatggttctaaagcacaactggtccacatggctcacataattaaacattcagctgtgtttcttgtgaggctgtggccagctcagtaacataccaccttatatttgattctccaatttctctgtttatataacttttccccctctttcttgctgtcttagaaatacacctcccaagctcctcaataaagtattagtctataatctttgcttcaactatgttttctagagaattaaagctaatacaagtgagtgacgactggcaaacaaattggtagacaaggtaggggattagagtatcttaaggtggaaacatggatgtaatttccaggaagataagaatattagctgacattagtgatttttttgaaaaggggattgctgaatactataatcattttaactcatgtaatttttattgcagtgctattagccagtcaccattatttcccattaaaggatgaaaaaactgaagttctgagaagctgaccacagttatatatgtagaaatagctcaactgagattctactcatgcccacactcttttctattgtcccatgataatcgagagaaagaatggaatgagacactgtaagccaggtactgggaaaaatgagggaaaggaaaggataccttgagtccactgttgaaagggaaaggatggtcatattaattttaagaaatttttttgtctctactcctttggcccaccaaagttccacccctgcacactctgaaggtaacttgggaactatttagatctcttcgacttccttaccatagagggcccttcatgatctcagcctttcctacctctccagtcctgtctcccatcattttcccataagcaacctaagtgttagacatgttgaagcacttgttgttccctttcaacctctgtgccctgaggcatgacatcttctctgcctgaaaagaaggcattctctgagtgtataaaacatgaagaaattgctatttatttcttaaggtcaaactatacatcctccataatgagtgccctgagcttgcaagcactgttaattgctattttctttgggcttctataggccttggacatacctatattggtccaagtattttactataattattgatttactcatctgtctttttcccatgagtttatatttatttttatttattttttactttgtatcccaagtgtctaaacacttacatatgatttatgtatcacacggttctaggctcttacatttaatcctgacacagccctatgaggaccccaaaagttaaaggatttgtccaacgacacacaaattttaagtggcagagctggcttttgaatacagtcagtgtcattccaggatatgagttcttaagcactataccctctctcagagcctaatattcaagaaacagttgtggaatgtataaagaaggaaggaaggcaatcaagaacatacaaaagtatatggtccgcttaatacataatataagcaatcacaaaatctcatagttagagaaaatcataggataatccatatttcagctacgtcttttgaatgatttaaattgtatagttgtcttgtaattgaaagatatgagtgctggatatcttctgtttacccactaaagccattctgccccttctctgctcgctttttgcacttctttcctacttccggggtggggggtaaagactgatccccatggtcccatgatagccaggaccctatgctctcaggctttctgtgggtaagagaacagagagttatcaggcagtgagcagcattttggtaggagagtagggtgaggaggtcaggaggggcgtgaagtagggtatttcccctcagttccttctttgcctgatcgctatgtgatggctgtgtcctgttagtgaaagccacacttatgtaaggcagcccactccataccgctgtcctccaagctgtggttatcattcctgaagctactagtggctccctgctgtcaatagctagagatatggtacaatcctttgttagtttccttaagctctacccccacacacccagtatgaatgtgtcatttgtttcctgcagggtttcttaatgatacaatataatttatcattgaaatatcaattaaacacacaaaaaatttagctagcatcctactggtacttgattttgttataataattttgtctttcagaatataaaatgaggttgggatttctttaatacatgttgcctccactgtcagctaaatatctgtgcatcatccacaactaaatttggaagaaacaaagtgaggatccatccccagggtcagaggttagcacccatagagagtagcacatgattctgctctttttttcttccctgctgtgcaggcaaagaaatcagaagcaggggaagaggtgctgaaatgaattagactgggaggtcagaggaaataaaagcagagcagtcagaatgctctcatgcagtgagttcagagcaatattggaaatataggtttaaatggcagtggctaaaatttgtagaaacaaggctttttcaacactttttaaagtgaccaagtaactttgatccttgatggctaaagtaataaaccctaattttaaattcaatcagatttccagccaaataataacatctggccttaaagtgacatagaactactcattgatcaatctctgacttgacaacagttgacactataattcaaatacttcacagagaaactgtgtaggttaaaagagagtgatctgtaaaacttgcagttttgctgattcttaatgttaagaagccttttgggaatctcattacctcagcaacgggtttacaaaggttgtgaaatatagaatcatgcagctagaaaagaccttgtgagttaaaccatgtctcaccttcaagcatctcagacaaacgagactatagtcaatatttagagaggttttgaggaggaaatctataactgcccacagaaagtaatgaaaggcatatttacaataataaataaatgtgtgaagtgttttacaatcatgatgtaaacactgacatttaaaatgcctcagattgagtacaacaatttaataaaaatatgcaaaatttagaatggcagcaagtatgccctgggacacgggtttccattttacacagagctaatatagaacatctgcagctagtagttaaatcatgcactcttttgagatacagcaaatagagacactctaaaaaatacatatttaattctctctctctctcttttttagaaacaggctctcactatgttgctcagacttggtttcgaactcctgacctcaatgatccccccacctcaactgctgagtagctgggattacaggcatgaaccaccaagcccaacaagaatattttaatatgtttaacagaattcagaactctttaactgtgataaaaaactatgcttttctttgactctaaatatgttacttgaaatatcattaacgtgaagttgtttttatgattgcactgagtatttatcacaagccatttatatcgtcaactcagctcttagatcgcaaatttacaggatggctagaagacctgcacgaaatgtctgtggacagacaaggagtttgccagtcttcataggtatgggacctatgaatttggattatgtagcattttgctgcaacccgatgattatcaaaattttttctggttgtgagtttccgagagttttatgcaagactctgcttaataattgtagctccatcctctctctctctctcaagagaatacattgaaatacacaagtgtgggattaagcttatttttatggataagactaattgttctctagcttaattaaaatgaaatatataatttacaaatgtacgtacttcaaacattatttattagtagtaatatatttcctgaaacctcataacactttgaaacgctccacaatgtgactatttcaaaatcaagagctaatgctctaacataatagttccccagcttataaatttatttcatgtccaaaacaattaaatgggatatagtgggaatgaatttaaaaaatccacacttcttgatgattataagtggtttagttaaggaaatgttaaggctagtctcatcaactttaatgtatgatcaattcacttcagttcaatatttacagagcatatactgtgtacaaagaactggggtaggaactatggctgctgaagtagttcgggacatgctaccccaaaatattgtttattttgagatgaaggcacttgagaacagcagatacgaactttctgacctcttctcttttacctaaaaacaagccatgaaatttcccatgagaaagatatcctaggaagaaaagaacatctttatcactagagagtggaaatcaacactgaaatgaatctgcacaacaaacttgctaaaataatctctacctttgactagtgttctccagtatatcttactcacttccccacaagttaatgccccagcccaaaccccttgtcttctcatttcttcacgaatttaggatttctttgtctaaaaagtatataagctttctgctctggtcacttctttggatcttcatttcttgaggactctcatgtacatttaaaatttttataaaatttacatgctttttctcccgttaatctgacatgagatatcatgtaagtttcttaggcctagtcagataccctaaaaagggtagaggagaaatttttcctcccctgcatcacaaaaaagatgcaagccataatctctgcccttaaaaaggatacagtctataagagctgccaaataggtgtattcagaatatattttaaaattctctggcacacatttttcaagataaaaaatggactatactctggtcaacacctttgctaaaaaatgtaaatgttttaaaactctgagatgatttcaaaagtttagtgcatttcttatatattctgacttactgggtatattatagtttagactattaaagatgaaacatgaagtgataagggaatcctccttgacttgccttgaggtagcattttaaaaaaacttagcccattgtttatatacttaaagttcttcaaaggaactccttgacatttgtcctcagtttgggactaggtactgtgtctgtgacaaatgcacaatgtaacagtctacttgaggataggaaactcagatatatgctcaagggcactttcattgtaaaaatctcaaatcagtagattccatcatccagtgagtcagctaattatagcttcattatcaatttttcagatactctgacctttcttgttcacacattcattcattcatctattcattcaaatatctatcactattcaaaaaaaaaatcttgaaattgtactatgtcctaaatgttgggacaacagaagtgaataagacaatttattattgcctactaagaagacaagcatacaagtacataaaaagtctaataaataatgtaattttatcataaaatgtattgggaatatggagaaaaaaaataaacaattctgccaagaagtagaaagacaaaaaagattataacagaaagatgaactaagatttgaaagatttgcatggatgtgtgtgtattgggggtgatgtagaggtagctcgtgactttttaggtatggagagtagtttgaccaagggaatgatagtgtgaacaaaagagcacatttggaaaaattcaacagctcagtagaactggagttcagatgcagggagggttaggtaagacacgagactagagagatgtggggctacccttgtgtccaatgttaagggcctttgattttattataaggagagaaaaccattctggctgtgcacaccaaatactccatacatagcaactgtcacactattatcatgtgaaatgaactaaacttgatatacagtcaattaaagagacatgacactactttcttaggagtttataatctaataatagagcagtaaaatggaagtatcaggaaacatttctttttataaaaagattcaacatggcattgttcacttgcaaccttacttaacctgtctattttttaaacattttctctgaagtaccttgaatgaaagaacaaagtggaatatagatttttgtctaaatcctgtagctacctgtttaaaagagtttgcaagcaaggatagatcaatattttttgaactataatagcaatcaaagtaaatggatttttcttttgaaagaaccttaactgcatacagcccaatagtcaccatcaaaaactttgaaacattattgctcttactgtatctactagatggtaaatgaacttataattatctggaaatataattttgtatatctataaagcaagtaagaaggataaaccactcttacttattatgaaagactacattaagaaaagtgacagtgaaacaagtgagcagcagatgccttttgctttaaaagtaatcatgttgatactgtgttagtcctttataaaattaaagggctatcagcacaacctcttgcaacctaataaaccattattgagactgcatctgtgctgagctaattattgggggtggtagtggtggtggtgcggcgggaggggggtggttcctagatgaatgggactaggtattttctcaaggaaataaatacaacagttaaacaggcaatttggaaaattggtgatgggtataaaaacaacaatataatactaggtctttggagctgatttctttcctcaacctttgagggttgttttgaaaactacttctctattgtgtttgtctatctttcacgctcctggggctgtgtgtccaggaaaaatttattctcaaaagagaatcctgaatcaataatctttagtttgaatttgaaataacaggtaacttcttactattatccgcattttaactcttataaattctagaaagaactctataattttaaaagaatattaagttgtatttgggatatactgtttggagactgaaaaataaatttcaaaagtcagatgtttggccttatttatttaacaatagtacatgccagacatagtctgcacataggctgtaaaatttaaaaagttgaccaaaataaagattctgtatataaagaaaattattagttacatgatatacaattaatttaaatgtaaggcaatgtgacacaaatgattgttatttattcaaggtgttttagaaattcagagggagaaaaagttattttcatgttgaaactaggtgagtgtagggatgattataggagactgattcaaggaagttaaatttcatatggtccctaatgaatgaaaaggacttttgtatatggaatttagtaattatagtacagaagaagaaggaggcatatcaaagtttgaaaggaaaaagctttcaagatataagtggaaaagtaaattatacccagatggtagagaatgtcttacatctggttataatggagttaattgtgtaagattggaaaagatattagcaattttagaataaataagaaacaaaactaaaactaatcttaaatctatgagaagagcagacgcaagaaaggaattgggattcattttggaataattaaaggagcacaaaataaaggatattagagtggagaccaaaacatggtaacagacaggataaaacttgcaacttgtttgaagtgggaagtgcagaaggaagattaaaggttaaaaataatataaaaatatatggcaaagtaacaagttttatgggttgttagggtaatgcttcttttttttttttttttttaatctgaaggactgaatatatattggaaaaccaccacaccaaacaggacgatagagcaaaaaaaacctacaaaaaaaaatccagggaactaaaccacaacctctgcaacaatcgagagcaaaaaaggtcggacttggtcaatgacagaaaacttttttcatgtttctttccacttccaacttaggatcaatcaagaaagccaaatgtgctgctcacactaacgtggtagctagcttatcttcagcttccccataccaaaaacctccagctaaagcataactgaatccttccttctttattaactaataaagttttcccattctcttgactgcgtttaagtctctgccaaagacaagtgatggtggctgcctcccttgctacagaaagctctgaataagtagccttgatttattcccatttgcatggtcttcatttatttccaacaatccgagctcatatacacatgccaacaaacacacacaaaaataaataactgcaaaatacgtttcatagtaaaatacatatccccataaatgtattataagtaatgccttctgaaattttctattccattacataaaaagtaaatgttggccccaaaccaaaattatttaatggcccattaaccagtacgacttttatattgaaaaataggtgtacacatattttctaaagcttatttgaccccgcggccatctgttcactgagtatctcttaagacttgtttccttaggacacgcttggggaaggttaactacattttgaatagagattactggaagaatagagatgtgattaacaaacaatcagaataaacacttggtttttaatgaaaggtatttagttcaatttaaattatattgattaagaaattacaattcagagaaacagaaaaaaatactaaaattgagaaagaaaagagttttataaaattctagtcctttctgaagcttatttaaaggtcatttagtttaactttcctctcaatcaacaattttgttttcctgttctagtatctattattaaaatgggactgctgttttaggcaaagtaaatataaacaaagaataaactcctgtctattagaaagtgaagggaaagtgtaagggcaagcacaaaacgaaaagaggcttaattttttagggttagggttagtgttagggttttaatgagagaagactcctgttgaaaataagagaagagactccttttcacctccctttatctcagataactcactttagaaaaactgtaattgtcagatttttcttttgcaagtatatgtaatttttaaaatgctaaataagccctttaatagtctcaaaatttaaaaattcttccttaaggacgtgtaagccatttctttaaaatataaccatctaggaagacagcactgcaatctcccagtttctgtgaaaaggtaggagtccaacatatgccaagttgcagaactacctcctgccataaagatatggggtttattttttcttcagataaagccaatttattttttctttgaataaagccaacacagatggtcaccccaattataggtgaatttaagataaactatgagtgacaaacagtggtgtcaagttcttttacttgagaacaaactactgtttcttgtgagaacatgtgtctaatgaggttgtatctgcttggctatttaaaagggtaacacgtctttctggcttttcaatctctttagcagattgcctaagatgcacatcttgttctcatttcatgcttatccaataataaaaataattttctttctatactgcttttgtggagaggctttctgtactggccgattatgtttttaatcacattaacccaacgccagtcacatatagaaattacaacttttttttcttagtggaaaaagcttgtatttattaacatttggttttgtttttgtattaaggtttggagtaaaaagaattgggtgtgggagaaagacaaggaaagtctgagaaagatgtagtggcccaagtgtgaagggaggcaaagtctaaaaaatctcttacttcatgagtatttatactttatacacattttaaaaaattataatttcttgtttagggtgggtaaagcagaagtctttatgctatgatgtatactagataagcataagttcccataagacttttgttgagagattttgacaaaagctttgtacttcgtaagagatattgcatatttctgcttccctttctggtactcctgccatttgctgctccaaggataagagaccctggggcagacctgaattagatccactttctggagccaaagcccagccagccaacagggtaaagcagagccccacaggccagttcactacattgaactaattgctgttgattcacagaaagaaagagcaataaataaataaatatttcttattttatagtagagtggatattttagcagcattattgcaatgatagtaactgatataagtgcttacaaatgaagatagcctaacaatagatcatcttaattaagtaaaaggtgaaaggttttaagaaacttataatctctattttcacaagaagaaaaaaattttaccagggtaatttcagacctcatgaagagattttccttgaaaaaaataataatgtgccagaaggcccaaaatgaagacagaggcaccattaaacaagcgcattgcgatttacacaaaatcaaggctgtaaagaagtaggaggagaaaaaataatatgacaggaaaaggtaggaagagttgaactagttcaatgggttgttgagtccttaagaagtaaaaatttctaacttattttcgtgtgcctagcacccagcaaaataactggcatctaatatgctattttatctttttttattttcatgaatcataagggaaatcagaggtggaactactggaactcaaagctaggcttcattaaaaaccacagtctacactgattagttataacaggactaattccaaaaatagtattctggatttgtgaattgtcactacaattgattttctgagaacctttctaaacaaaaatacaatttgtatatcaatatcattgttatttatgtatttattatgtgtttatgtatttttttagagtcacagtcttgctttgtcactcaggctggagtgcagtggccagataatggctcactgcagctcactgaggcctccaattcttgagctcaaatataatcctgcctcagcctcctgagtatctggtactacaggagcacgacaccaattatatatcaagatgttccagaagagtcctacttaggacattatgcctaactattaagctactggcggtatgtggacttttgttggcttggagccaatatgcttatggcctgataggagatgcaagagtaactgagaaacactgtaaaatctgtgacactctgtgtgcaagtcagtgatactacagacctcagatactattgacctctcctccagtgttgtgccactctcatctaccaccacaaatgttctcagagctgaaactgtgagcttaagaagacccactatgaagagcaggatcctcaaggaaatgttaacttgacatcaaaccaacaaacaacaataaaaaacaccttgtaagttgggagaaggggtaattaaaattttacttcaatttggtaaatgtagtctgattcaaaaatttaagtaatcttgaggtaatttagtttctattaaacagatctttttaccgtgtaagtggttgattcatgttaattactcacctactcctgttcctttttaaaatggttatacacagggttggatttatgggacagtgaggagattgtcaggacaggaggccccgcaactgtaggatggaagttctctgattttactgtcactgctgatgtagagtaactggattaatattttccttggactgatgagttgtcaaatgtaattattctggttttgacttttggggtatattcggaatcttaaggatcgaggcattaagacatttgtgccttgtagtcttttaatcttgaatatttgctagtccataagtcttacaaggaattctgcatctaattattaagacaggtaagaattaccacaatcccttgacatgccaagactgtgtagaatcaaaaataaaaaaaaaaaaaaagagcctgaagtttctctcatgacatattgaatggaaaactgaacttacttaggtgctgcagacttccttcaggacacccaactcaacatttggggaagctggttattagtctgtccttaaaaatagattctaaggggcagggccaagatggcttactagaagaagcagcgattggaggcacccatcaaaaagaaccaaaacagtatgcaaatccagcaccagcaaccaatatccaggtatctaggttgtcaacaggactgactaggtggctggcatgaccaacagagagaaaggaagagcagtgtggtgcagcagcccacctgagagccacatggggcaggggagatcccaccccttagccaagggaggcagtgagtgtgctacctagtctgggaaactgtgctttttccatggaactgtgaaacccacagatcagaagatcccactcgtgagcccaaatatcaatagccgaattgattaagtggaagaaagaatattagagcgtgaagaccatcttgctgaaataaggcaggcagacaagattagaaaataaataaataaataaataaataaataaataggaacaaacaaaacctccgagaaatatgggactatgtaaaaagaccgaacctactattgatcagagagtctgaaagagatggggagaatggaaccaagttggaaacacacttcaggatattatccaggagaacttccccatcctagcaagagaggctaacattcaaattcaggaaatacaaaaaacaccactaaggtactacatgagaagatcaaccccaagatacacaatcagattctccaaggttgaaataaaggaaaaaatgttaaggacagccagacaaaaaggccaggtcacctacaagtggaagcccaccaaactatcaagagatctctcagcagaaaccctgcaagccagaagagagtggggaccaatattcaacattcttaaaagaaaggaattttcaacccagaatttcatatccagccaaactaagcttcataagggaaggagaaataacctccatctcagacaagcaaaggctgagagattttgtcaccaccaggcctgccttgcaagagctcctgaaggaagcactaaatagtggaagaaaaaccagtaccagacactggaaaaacatgccaaaatataaatacaaagacactatgaagaaactgcatcaactagtgggcaaaataaccagacagcatcatgatgacaggatcaaattcccacataataatattaaccttaaatgtaaatgagctaaatgcctcaattaaaaggcacagactggcagattggatgaagagtcaagacccatcagtgtgctgtattcaggagacccatcttatgtgcacaggcacacacaggctcaaaataaaaggatggagaaaaatttaccaagcaaatgaacagaaaaaaaaaaaagcaggggttgcaatgttactctctgacaaaacagacttttaaccatcaaagatcaaaaaagacaaagaaaggcattacataatggtaaagggatcaattcaatatgaagagctaactattctagatatatatgtacccaatacaggagctcccagattcataaaacaagttcttagagacctacaaagagacttagactcccacacaataatagtcagagatttaacaccccactgtcaatattagacagttcaacaacacagaaaattaacaaggatattcaggacttgaaagcagctctggatcaggtggacctaatcaacatctacagaactctccaccccaaatcaatggaatatacattcttctcagtgccacatctcacttattctaaaatcaaccacataattagaagtaaagctcctccgcaaatgcaaaaaaagctgaaataataaaaaacagtctctcagaccacagtgcaatcaaattagaactcaggattatgaaacactcaaaaccacacaactacatggaaattgaataacctgctcctgaaagactcctggttaaaaataatgaaattaaggcagaaatcaagaagttctttgaaaccaatgagaataaagagacaacataccagaatctctgggacacagctaaagcagtgtttagatggaaatttataacactaaatgcccacatcagaaagctagaaagatcttaaatcaacaccctaatatcacaattaaaagaactagagaaacaagagcaaataaatccaaaagccagcagaagacaaaaaataattattcagggcagaattgaaggagatagaggcacaaaaaacccttcaaaaaaagcaatgaatcaatgagctggtttttgaaaaaattaacaaaatagatagaccactagctacactaatgaaggagaaaagagataagaatcaaatagacacaataaaaaatgtcacaataaaaatgacacactgaccccacataaatacaaactaccatcagagaatactataaacacctctgtgcaaataaactagaaaatctaaaagatattgataaattcctggactcatgcaccctccaaaaactaaaccagaaagaagtcaaatccctgagaaaccaacatcaagttctgaaatctaggcagtaattaacatcataccaaccaaaaaaaatctcaggacaagacaaattcacagcaaaatgctgccagaggtacaaagaggagctggtaccattccttctgagactattccaaagaattgaaaaggagagtctcctccctaatgcattttttgaggccagcatcatcctgataccaaaacctggcagagacacaacaaaaaaagaaaacttcagtccaatatccctgatgaacatcgaagtgaaacacctcaataaaatactgacaaactgaatccagctgcacatcaaaaagcgtatccaccatgatgaagtcggcttcatccctggaatgcaacgctggttcaacatacacaaaccggcagatgtaatccatcacataaacataaccaatgacgaaaaccacatgattatttcaatagatgcagaaaaggcctttgctaaaattcaacatccccaattgttaaacgtttttgataaactagatattcatgcaaaatatctcaaaataataagagctgtttatgaaaaacccacagccaatatcacactgagtgggcaaaagctggaatcattccctttgaaaactggcacaaaacaaagatgcactgtcttcccactcttattcagcatagtattggaagatttgtccagggcaatcaggcaagagaaagaaataaagggtattcaaataggaagagaggaagtcaaattgtttctgttttcagactacatgattttatatttacaaaactccattgtctcagcccaaaaactccttaagctgataagcacttcagcaaagtctcaggatacaaaatcaacgtgcaaaaatcacaagcatttctatatgccaactatagataagcagagagccacaacatgaataaactcccattcacaattgctacgaagagaataaaatacctaggaatacagctaacagaaacgtgaaggacttcttcaaggagaactacaaaccactgctcaaggaaataagagaaaacacaaacaaatggaaaaacattccatgttcatatataggaagaatcaatagtgtgaaaatagccatgctgcccaaagtaatttataaattcaatgttattcccatcaaactaccattgacatttttcacataatgacaaaaagaaccactttaaatttcatgtggaaccaatgaagagcccgtatagccatgacaatcctaagcaataagaacaaagcaggaggtatcatgctacctggcttcaaactatactacaaggctacgattaccaaaacagcatagtacaggtaccaaaacagaaatatagaccaatggaacagaacagagacttcagaaataacaccacacatctacaaccatctgatcttctacaaacacgacaaaagcaagcaatgggtaaagaattccctatttaataaatggtgctgggaaaactggctagccatatgcagaaaactgaagctggaccccttccttacacctcatacaaaaattaacttaagatggattaaagacttaaatgtaaaaccataaaaaccctagaagaaaacctaggcaataccattcaggatatgggcatgggtaaagatttcatgatgaaaataccaaaagcaattgcaacagaagctaaaattgacaaatgggatctaattaagctaaagagcttctgcacagcaaaagaaactatcatcagagtgaacaggcaacctaaaaaatgggagaaattttttgcaatctattcatctgacaaaggtctaatatccagaatctacaagaaacttaaacaaatttatcagaaaaaaaaaacaaccccataaaaggcgggtgaaggacatgaacagatgcttctcaaaagaagacatttttgtggccaacaaacacacgacaaaaagctcaacatcactgctcattagagaaatgcaaatcaaaatcacaatgagatactatctcttgccagtcagaatggcgattattaaaaagaaacaacaatgctggcgaggctgtggagaaataggaatgcttttacactgttgttgggaatgtaaattaattcaatcattgtggaagacagtgtggcaattcctcaaggatctagaaccagaaataccatttgacccagcaatcccattactgggtatatacccaaaggaatataaatcattctactataaagacacatgaacacctatgtttattgcagcattatttacaatagcaaagacgtggaaccaacccaaatgcccattgatgatagactgaataaagaaaatgtagtacatatacaccatggaatactatgcagctataaaaaggaatgagatcatgtcctttgcaggcacatggatgaagctggaaaccatcatcctcagcaaactaacaaaggaacagaaaaccaaacacctcatgttctcactgaaaagtaggagttgaacaatgagaacacatggacacagggaggggaataacacacaccagggcctgtcagggggtggagggcaaggaatgggagagcatcaggacaaataccttatgcatgtagggcttaaaacctagatgatgggttgataggtgcaggaagccaccatgggtcacgtatacttaagtaataaacctgcatgttctgcacatgtatctcagaacttaaagtaaaataaaaaataataaaaaatagactctagtgagagaaaagaagtaagtaccaccatattatttctttgcataatcctcaggctcatggtggttctggctataggtttttcatttcctctagttttgtatttttctcctcctgttttgtagtgagcctgaagatctaaattgcacacgtataaaggctgtctcttctatatactatgaaggatactctataatatgagtactttattcttgagaggtttcataataaatgaagaattcatgaaattcatttttctctgacaaaggctggctttcaagcctgtcttctcaactcaactcaactcaactcaaaatcacactttgataggcaaagcttgaactatttcattctctcttcagtgttttatatgaacaattcctgttctaatgcctatgtgtgtgtatatatatgtatatatatatatatatatatgcataaaggatgatagtaatatgcataataatgcaagagaaaagtatcacaaaacaaaacaatttaattttaaatatttgtaatttagacttttaactacttcaccttgaatattcctatttatcttttaggacttatgtaaggtgtctatccttggactgcttttacagtaccccttatttttagaaaatcatttctgtttgctctgagcacgtattaaaataacctatttatatgtacctgtccccacttatctgaaggtgtatagatgtatgaaccttgtctattttgtcttctcagccccattacctaacacagtgcctgggacatagtaggtaatttaaaataaaaacttcttaagcttaaattaaatctatttattaggtggagattagtattgagctctgtgtaaaagatttaaaactgtacacctgtcaaatgaagagaaagcatttttctgtataaattcactctgaatttattgaagacattattctgatataagaacaaatcaactatcaaatcaaaaaccacatttgttatatcaaacttcatgtaaaaaaatttcattagacaaaacataagtaaatgatctagaaatatataaatactgtattttgctgccatgggtaacagcaagagaattagaggtcagattagaagactaagtaaaagttatgactattttcggtcagattagaagactaagtaaaagttatgactattttccagaagataaattagaatttaaggtataaaggtcagcaacataatatgccccccaaaaaggcaaggaaagaaagagtaggtacactgctcagcttatgctgctacaccaaaatacccagtggcttaaacttaagacttggcttagacaacaggcatttatttctcacaattctggaggctgagaagtctaagatcggggtgctggcagctttggttttgatgaaagctctttttctagctcacagttggctgccttcttgatatatcctcacatgggaaaaagagagagacagacggagatttcacgtctcttcttagaagggcactgatcccatcatgagagcttgacttttcaaaggccccgtctccaaatactatcatattgggggttagggctttaacatatgaattttaggggggacacaattcagtccatagcagtaggtggaagactgaaagagtaaaaggaattaataataatacagaaaaagctattggcaaagagtcttatatgtaaatttgaagtagttaggaagaattaatattcaacagttattccaaactttatttgaaatatctttcagcactaaaaaattaaaggaacaaataagcatagaaacagcaatccttttcttaaacacccttgcaactagactcctaactgtggattagatgtagtcaattaggtaagatttaaaaagtgagagagacgaagaacctatctttctcacctttcctgtgcttttggtcatgaagacaagcgtggtcatcgggtttctctgaaggcaaatccctttgtccagtcatgacttcaagagcactgatttttgaatggaagtctttattgatgctaagctcaacttcttgatttccactgacctaactgtggcaaaggtacattcatttggtagtttatttcttgctattcttatagtctctcctagaaacctgatctagcatctgctcttctaaccattgcaacaatttgttaaccaactcatttggtttaaatccctttctgcttaaaatgctagaaatttttttcttttcttttcttttctttttttttcccctgctttcaactgatccttgactgacacaacaggttaggggaatgtcacattcaaatgtgacaaattcaaatatgtaggcattctacccaaattatgcctcaaaagatattaaaatcctctacagtgaaaaccaagtatcacatagttcacctacaaaatgctcgttttccaaaacttaatattttaaactgtcctaggcctatacggaccctacatacatgcgaggaatcacattcatttgcatgtagatctaggagtaaactctgaactgagatggtgacactctgaaccgcagcatagtacctatccaggatgtgactgattggctcaacaatcattcactaaaacttccaacgtgccaagcacagtgccggattctggcaatataaataaacgatgttgttgcttcttaaagagttcacagtctagatttcagataaatgatacttggaatacagataatattctaagataaatttatatattttctgtttatacatatttgattaaataatttgaaagcagagggagagagtaatcttcaagagaaatttgtatgactttagtattctgaaattatcagtttggaatgtatcctcatctcccaatttcactgtatatattgtttcactttctacaaaatctagttcaagtctgaattcatttctgaccctacagtgctttaacagtagaacagggtctatcaagaagttagtgtccatatatatggttaaatgccaactctagattagagttgctcagatcaatagctcaatgccttacctgtagtagatctcacaagtatcaattacagaatgtttccttgacttgttaatcatcatatatatgctgacagctttgatatgtgaacaattggaaaaatcaccatgaaaaactgaatctatgtgacttatttgacctcagtaacaatcacattagaaatgttaaaatattggccgggcatggtggctcattcctgcaatcccagcactttgggaggccgaggcaggtggatcacctgaggtcaggagtttcaaatcagcctggccaacatagcgaaaccctgtctctactaaaaatacaaaaattagctcggcatggtggtgggaggcctgtaatcccagctactcaggaggctgaggcatgagaatcacctgaacccggaaggcggagtttgcagtgagccgagatcctgccgctgcactccagcctgggtgacagaacgaaagagaaggaaaaacaagtatttgtcaatgataacaatttcacaagctgtatttttgatctactaaagatacctcgtctagacttttactaatgcattgttccttgatgcattcctgttttgtcagcttttggcactatttgatagtagagaaaagaaacatcgagtgaggccttagaactatttttgttttaatgtttcctacattttgacaaccagcgattagcctcccaaatatcatcagaagttttgaagggatgatattaatatatttgatgtgtgaggtaaaacacacatgtacatttctcagtattaaacaataaataacactacaaatgcaagaatatgatttggtcaagatgcagggatcttgcattggttagagttcatattttgaaatctgaccttcttgtgtttgaaatattactctgcagctttcaaaatgtatacaatttggggacgtaacttcactttttttaagcccattatatgaaaaaaaaatccatacataaggctgtgtagggaattatattaaatagctcacacaataatacatcatcagtacaaatcattattgggataatctagaaggcagctggtgttaactctgctaaaaattcagtgaaaagagaaaaaaaaaaaaagcaagggaactgttccagaggaaaagataccaaagagacataacaaacaaatgcaatgagtgcaaattaattagatcttaggttttttaaaaaaaaaggctataccagacctttttgggcaaactgggtatattgaaaatggattgtacagtagataacattggtgattgaatgttaattttctaaacatgatattgatattgtggctacttaggggaaggttgttacgattagaagatgcttatgtatttacgggtgaaagcacgtggtatttgcaccctactttcaaattgttatgcaaaaataaacgaataagcaaataaagatgtgtttctgtgtgcatgcacacgagcctgtgtgtgcgttagcgtgtgtgtgtgtgtgtagtgtaggagggagaaagagtgaaacacagaatgccaatgtggcaaaatcgtaaaaactgatgaatctaagcgaagaatatgcaagtatactttttcttattctttcagtgtttctgaaggttttaaacttttcaaaatagacacaaggaataaaagactcagtaaaatgaggaattaattcacgagctacagaaaataatatgtgtataaataataatggtaattatgaaacatatgatgtgtcacaatttaagtgggagtattaagatgactcacttgtaactgaagatcaaaaatcacaaaatatgttgggtttttgaaattatattttcctaaatttataataggcccaaaaagaaacagaaattaacactttagaaatctttagatgacatatttttgtgagtaacaagcaggtcacattagtcatttgttgacaagtagcaaaaaaaaaaaaacctgttcattaaggtattgataaaacgtagtgttaaattgtcagttcaaaaatctgaaaatcttaaaatgtaataatcattaacctaagtatgcaaaatcatttgcatagcttggagtagatattaacacagacagaaagaaaagccaatgttgatattatagatttcctaacttaaaattatgactactcattttcttatgaattttcttgccaataatgacagaacacatgctattcctatttcctaaggaagaaactatcctgtcactgtgcctccaatgggtcaaaatagttcagaacatttctcacaagcatttccatctatatttgaaaccagttcttgtggtgagtatattagatttaacatgtcacatctcacactcttgaaggcagcaaatggcttagttgatatatttcattaaagcgtaagataaattctcaaaatcaaatgtcaacaacagtaacttttctatgttgccaagaagtggggctattatttttcatgattatcagcagaaattttgttttcagagttcaatacactgcattacatgtgtttcagaagcaataattagctcatgttaagatgggaaacaatgaggattcaaagcagaagctttggagtcaagctacctaggtttaaatcccatctttaaatgctgacagcataactttgggcacattagaaatcacggagacctagttttatcatccctacaagaggaaacaaaatagctacttcattgaattcatgaaaagattaagcaaggtaatcaacacagcacacagcatggtacatactaggcacaccaatgcagttatttaataaatatgtattgagtacccactctaagccatgtattgttctaggcactcggggcatagcagtaaatgagagatcatccgttcactccccaccttggaaaaaaaaaatacctgtccttttggaattcatatttcagtgtagagagacagaaaatattaaacagacataataaaattatataatattagaaggtaataagtgctatggatgaaaaaaatgaagcagaatagggtaactgtggagaggtgaataggttccaatttttattatagtgagtaagtaggcagccttggaaaatggcatttgagataagtcatgaaaaagttgaaggggttagccatggacatataagaggaaaggccctaaggaaggaatatgtctaagtgaagaagagtgagaatgaaagaaaaatggtggaaacgagaaatcaggtatagttattgccttaatcctggtgcctgatgatagtgggttgaccaagatattagcagtagaggtggtgataaaggattgaattccagacatgttttcaaagtgaagccaaaataatttgctaataaatcatgaaatgatgagagaaaggggtaaatcaattatgtccccaataatgtctgtctgagcaaggggaatgatgaaatttctattaacttagatggagaagactagggaaagcagtttggtaaaaaatcaattaagttaagtattcgcatacataacttggggaattaggtgtccaagtagagatttcaagaaagcagtggattgtctagaggtccagcagcatatttgggctggcagtgtaaaatgtgagactgcatacatatgtggcatttaaaatcatgcaacccagaggttattgctgaaggagtgaatgtgagagacaaaaagatgatgaagttgcattaacattaagtgatcagacagaagaggagaaaacaatgtgacaggagaaaaaccaggaactgaaaccctcgaataaaagtaatgaggaaaactgagcatttagtgctaagataaatactgctgatctgtcaagtaaaaagtatacaaagaatccactattagacttagcaatgtagagaacatttttgactttgccaaagaagttttgttaccatagtagtgaaagtctgtttggaacaatgggtttgggagggtctggaaagaggaaaatcaaagttagcaaagatgaataactcttttgagcaagtttgcagcaaagagaagcaaaaaatatatggcaataactggcagggaaagtggggtcaaaacaactttttttaacaaagggagaaataaatccatgcttttataatcatagtcccgtaaagatagaaaacatgactaaacagaaaaaagaagggaggctggctaaactaaaatcttagagtaggttagaaatagtggggtttagtgtgctagtggaaaggagtagctttagatagaagcattgcgacttcagttatattaacaggaagaaagtcaccaaaaacaggcaaagattttgactacctgtgtagatctggtagtagatatggcatatagttaatgtcatctaaaataaaatccatattaaagggaaatgtgaatgttaattagttcctttaaattgtcccatagtagttcaaatggaagttgattcaatccaaattaataaactctaaatcatggtggtataacatctacaaatgactttctaagacaaactgaaatatacttggcttttttacttttgtatatatgaaagggagaattggctagaaactgcttttatttgctcttataatatcaatgcacagtacctcaaaacttgttacctaatttggaacaaagagaaaaaatccgaaggatttttttccaattaactgtgactcaaacggaagttatgaagtttgaattaatttgaatttcaatccataaagtatttatttcttattaactgtttattggtgaaatgaaacatagacatgagaggagaaaacatgagattgcaacctgtgtatgaatgctgtattagtccattttcatactgctataaagaactgcctgagactgggtaatttataaaggaaagaggtttaattgattcacagttcagcatggctgtggagtcctcagaaaacttacaattatggcggaaggcaaaagggaagcaaggcaccttctttacaaggtggcagaaaggagaatgaacgcaggaggaactaccaaaaaattataaaccatcagatctcttgagagctcactcaatattaggagaacagtatgtgggaaaccaatcctatgattcaattacctccacctggtctctcacttgatacttggggattatagggattatggagattataattgaagatgagatttaggtggaaaaacaaagcataaccatatcaatttctctgagcatgcagactgctactttctgctgaaaaataactatatacttgcttgttgtttaggtaggctaggccagtgatatacattagcatatcacctctgcttcctcctaagcttagaatgcattctaagtacttagccaattattatgtacttggcaagtagtaaagataattttatgaagagcaggaaatggattagcaaagaaagtagttgaaggtggttagagaaggtatatatataaaagagaagatcatatatttttctaaacctagtattaagcagagtgttaggtgcatagtatactcagaccagtgtttgttaaattacatatggagcttggatttaggctgtcttttggaagaagagacattactcatccaaccaacaggattttagcctttcctattttgaaattcttccttttctcataactttatttgcaaagttataacaacaacgtaatgaaagataatccaaatactatagatgcgtcattaaatttttaaaaagatacggaaaaaaggaaaatttgattattgatgtaatgtattagatttaatgcttgatcaataacactaagcaacaaaatgatattacatcaaattagtaaatataagaaccaatgggaatatgattcaagagaaaatgactgattaaagctcattttatttctcaatatagttcatgaccaagcaaagaattctaaaaaataaagacaaaaatgactatgcttcttaaatttatttagcctcattcttcaggtatttatttctgaacaacaaaaaatacagactatattaaaaaatctcatatgctgttaaaatctattatttttctggaactatacaaatgtataattattttgaataattatagaattttcctgatttgtatcatatacagtaaacatttcatatattgtgttaagggaagttttgatgagttataaagttctcaacaaaaatgtatcaaaaagataagtcatgaactgcgtctgattttccacaaactgaatatactgcaattaattggttgtagtgctatagatatgagattatgagcaaagcaacataaacataaagggtctattttattgagtggacataatcttctatggctcctttccaactctgtctagtgtgtgaacaagatattttctgttgaattaaactaacaaagagggtgagtgagcatttaaaccccaaggactattcttggagggtgttacacactgcttcaagattcttaatgacttcagtttaaatggcataattttctttctcagtttgcaaattggcttttaaaaaatactgaccatcagcctatatatatatctaattaaaaagaataaaatcaaaacttaatatttccatttttatatgaaagtcattgtatactatctgtgattttacaagtacaattactgtgatctaggattgattattgatctattttatgttactttttacaataagtatattttacccatatcttattcaaaatgaagtggaacagtaaaatactgtcggattctaaatggcatttttaaactgtttaaaatgtgaattcattctatgtgaagtaatttcattaaccaaaaaacatagcgtaattttgaaaaagtcaaataattaaatcttagtgtctaaaatttgacttatcatattttccagactgtaaactcttgtgttacattggcaacaatttgaaattatctggtgtaatgctaatttccttttccaacaggcattttcttgttgtttatcataaaagacaaaaggcattaacactatagttaattaggggtagtcatgtgatagaaaatgcagattgttgggaagaattaaagctttgtcagctagatttctaactccccttcattaagattagataaagtgctctcaagacagtaaactgattatgacaaccaaatttttcaagtaaatttatttagatgaatagcttaggaaattgaacaataaaaacagaggtaacataaagttccaaaacactgaacaaaaaaaatatgagttagatgtaatttatatgcttataattttactaaaaacaataaagaattaaaataagttatatatctatacacgtatgtatgtaaatatcaatagaggttaattgttagaaacaaaatggacatatacaaaaccaaaacttcctcctatatttctactttttgagaacgaagactgttaacagttttactctttcagccttattcatacctatattctgttattgttgttttgaacaaaaatgtgtcacaagtaaagttctacataacaagaccacctttgctagccaagccccttcttctcctcctcccataatgtattttgccatgatacaagcccccattctttctgtaacttcaagaaggaatatgagtttctgaactccattgaggaatggggagtaatcactctgtggttctcaccacgtgcacattaataaatttgcatgccatttctcctatttaaaacaaataagtaaagttctgcttctgatatttgtttgattatttcggcaattatggacaccatacaatatctatatgtacaaattattattcatttttaaaaattaaaataacttttaaaattgcattacataatagacatcagcaaactgagggaatttaagagttacatatacatatatacacatacatatacaaacacacatatatatattttacatagtacaaataatgcttcaaaaactgacatttttatttttgttaagctgaatatttctgtggaacaagtttttgaaagtaaaattttgaatcaaaagttatgtactttttctgtttgttttaatatattgcaaaactgtatctccagatgattttgtcaaagtacactctcaccaaaagtgaatgagagtgcaggaatgagaaggtgaaaaggcatgagatccagagcaaaagaacaagagtgttcttagagcaggggtgagggaggaggggccaatctttcatttaacaggaaggatgaacaatagaagagtagtgatagtaccagttttgaaaaaagctgaaatattcttgactgattgttgttattttcctaatacagtgtgaaacacgattatcagctgattttgagtggtcaatgatgatggagtataagcaatttgaaattgtaaaagaaagtataaaataatagcgttaaaaagtgaaacaaagatttttgctgtggcccctcaaaagatgtctatgtcaatctctagaatttgcaaatgttaacttttcggaaaaatgatctttgcagatgtaattaacgattttggtatgtgaagataatcctgaattatctgtgtgagccctaaatgacatcatgtgtccacaaaagagagaggaaaaaataatcacaacctgacagtgtacctgcttaaaagggattattttttcctctctcttatatggacacacagaagagaagacaatcaaaatagagagtggagtgatgtggccactaggacagaaatgctggggcaaccactataaactggaagaggcaaggaactgattattccctttacaaagcccctagagggagagcagccctgtcagatttcaaactttttgcctccagaactctgagagaataaatttcttttgttttcagccaacaagtttgtggtaaatactaagaaactagtgtacttagaaacaaatatactattgaagtattaaattagcatttgagctttgtagttataaatctgaagtacaattatttagtggaaaagaggatacttgctttcaattgtggttggaatatttgtagatatagtgaaacagtaaagaaagccattttccattttgtttttgtttgtgaagagattaattataatgaaagactaaacaaggatctagacttaaaagagaagggaagggtgataaatattatttttaaaaaggatatatagattgcatttctcaaagaaattgagcacacatcttgtgaaatactaccataagaaaactgtaaggaaagaattaaggtcactgactgagaagtcgctagtggaaatgtcacaagaaatagaattactgatgatgataaagattgtcattatttcatacatggtcaagctagcatgatggaaaatagttggaagtgagtaggtgaaggacatagatgttagagttttcatatgcactgtcttcatctatgtttgtaacatgtatttagctatatagcttgcagtagtttgacaatattaagttttgaatatttacttcatttgtttgggcttaaaaaatcttcctagcattaattccctctttttcatgcaaccataccctgatgttgatatgggaaaaccccgttttctcaacttgctcacggtattcaaccaaagctgactgcaccaccaacaccccttcaacctgactgtgtacctgcttaagaggccagatcaattgttttttttgttttccttgtcatgcaatgattctgtgatgggcacgaaacacaagtcaagcaaattagatcaatttagggcttgctcttgagctataaacgaagtgggtgtactatttccagctggaaataaatccagacaactgtatcccaggaaactgttcacagtgctcttgaaaccacacgggagaacgtacctaagagtgtcatgatgctaaggaaatgtatgcaaagaatgaaagcaaacaaacaactcccagtctgtaatttaaacaccaaattaaggtttctctgaccctttaattatttagctgttcagagaattttaaaaagtcctttgtttgaattaatctagttggagtagcattgttattattattgtttttgtgacatatgaagtacacatttcagatatctaatagttttctctaagactaccacatcaatgttgctgataatttcattttaagaggatagatctacactaaaaggaaagtaagtgcaacaaattctccttatatactgaatttctgtcatgactacgtccacaagtgatagtcattttttaaaaaatgagaaaggtcataccatagtaatgacatcaaatagcatagagaatctgtgcaactatattgaattctgcatctgtattatgtgaattaaaatcttggtttcctacaactgatgctttatcttccatcagtatggattttcatgctagcagtaaaccatcaaagacttacaagttgagtaatgccatttatgaacatggattttagataaattaacttttaaatgttcttcttgacttacatttttgtattttcttactgattacaatcttcttttgtaactcttctaaatatgcatccccaacctgctttttgtttatagtactgtagggtaatatcaaatgccaatccttattgcatttgccacagtgtatttcagagcttgatatgtgattttcccaggagatttttgtttcagaaaaatataccctttttacttctttggtgaacaatttgcagtaatatgctcaatgagtatttgttcactgaattcaattatcaggattaaaggcagctatataatataaagtaaatctacaaggtatattattgaaagaaaactgtcaattttgaaagatatattatatcaacagtaggagtcagttctataaagtgattaataggattttccagacaggcaaaaatgtatttggaatgtttccttgtctatgccagcaacatcataattctgattcagggccagcgcatgaaaggtctagtcgtgttgattaatttaaaaggcattgtgtgagtgtgtgtgtgtgtatgtatgtgtgtgtgtgtggagtgatgacaatagcagaaacaatgtaaatattgctcatgcatttgtattttcaggttgcattgatactcagctatactctagagaccacaccactgcaagagaaacaagagaggattcatgattattctcttgccttcaagatgctaaggaagtaaactatcagcataaactaacttaacacagagatagcccacaaacagttaagttgtctctcttaactaagatgggaagggagtgagaatgcttatttgttaaaatgggttagtgttcactaactgatagtggttttgtttccttttcattctgtaattgtttaattatattaatttgagaagacatgaattaaaaatagatatcgtggctgggtgtggtggctcatgcctataatcccagaactttgggaggccgaggtgcaaggatcacttgaggtcaggagtttgacaccaacctggccaacgtggcgaaacctcgtctctactaaaaatacaaaatattagctgggcatggtggtgcatgcctgtgatcccagctacttgggaggcagaggttgcagtgagccaagatcatgccactccactccagcctgggtgacagagcaagactccatctcaaaaaaaaaaaaaaaaagaaaaaagaaaagaatagatattgtccgaatagacttattttagaattcctgatgtcaaacagtaattattcccacaaattattttaattcagtcttcacttgacagtaaaacttaattgcataaaatctggcaatcaaaagaaatattaaaaattaccagtgtaacctaatatgtggttaatcacaactaccaaacttatatgttacaacagactaaatgcaatatgaaaagtaaacacaatttatttcaacttaacttgatctaagagcagaatgtcttttaaaatgtatttttaaaacacacaataatttttatgttgacctctttcatttaataatatgttagaccttttgttttcaccaaccagtcctcaataagaatgattccacctccctattatgaaatatttggagagtagccatagcaaacaatattatgcctaataaaataataatagctcttcctctaagaatcatgactggcttcccccttattcaacaaaattgtaaaatgaaaaaacaggcataatcaccacgctagacgaattaagcatcatattgacacatactttattttactacttaaaagtgtgtttagatttttgttttggctaaataaattagaatttgaatgtaccactttttcacataagtgcttgttagtttttttttttaaattaacattaagtaaagtctttaatgaaaaaagtgcatctatgtaatgtcaataaaactgctaattaggaaactcagtatttataaacatagattgcataattgaaaataagtataaagcttaattatgcaaaaatgggttaagcaactttgataagaaaaactacagacataaatataaaggtaagtaatttgtaagttagatagtaactgatattgatgtaataaaaaccataagaatacatgcatttacaacttttattaaacattgtattttgaaaggaccttttagtcaatatgataatgcaattatgttagttctagtaagaaaaagaccagtgagagagatatagcaaaggaagaggactgactttaaaccataataattaaatgctaatctcagtataaaaataacacttttctttgactttgggcaacacataatgtctgtgttgaagtttgcatatgtaaaacatacataataataataatacctcagacaggtgctgtgagacttaattaatttctccagagtgctatggacatgagaaaatgtatgcagtctggacatttaatcattattatcctccaagggttttcttttgatattgcttagggaagctagatggaagactgccaaattaccaaatccctggaaggagttagaaacacattatattgaagagtaagacaaatgcaataaaagctagaccttaaaaagaaacattaaacaaaagaagttggccatttgagaatggcagggaggattaaatgaattaacattataatttaaagttaaaaatatatatatacatcggtgccaacagttttgaaagagaaagaagaggaggaaggaaaaaaggaagaagaaagggagagaggaagggagagagagagaaaagagggagagaggaggatgttaaatttctctttaacagatgaaggaaagaagaacaatggagtggttatgagttaaggtcattgttaaacactagtaaattggcaaaaagtcaattcagaaggttacaaaaaaattttaagtgttgggagagctgtcatatttcctaaaaatcaaaaagaaaaatttctgctgcagaattaagattaatatttacacatcaattttttgtgagacttttgtctcagagaaatgatataacattagttcttctaatcggggctgaatttgtaaagatttttgtcaggaaatattgaaaataagaagggtgcttaacaggtaagaagtactcaatacatttttaggaattattattattcaaattctaataatgcatgaactgaaattccactgattttttgctttttatctttaaatattttatgtttaaattattaactgtaaatgtgaataagttacatttgataaatgctatataagaataggtgtcaagtgatatgaaatttctgaagatatatttgcaatggcaattcataagagaaaaaacatccttaagaaagtacttccttctatcatactcatttttctgtactttttacagcttcccaagcaaaaggctgcacagggaaaggtgcccccatttgtaacaatagaaagacgtagtaggaagagctcattggactatctctatttgtctcttgttttgaaagtccctttgattgtagcagagaacatgaatttaaagattaattttaaaaacaatatccaaaagattgtttggatattgggacaaaagtgtccaactctgagacaaattcttaaatgaaataataaaaataatgtatattgaaagatctcaattactctaccaatctggcttgttctgtatatagcgaagtatgagctgaagttggttatttaatgactattgagaatcaaaacatacaaacattgaaaactctgaagtcagtagagcacaatgtgagcagagcagaaaattaggtataagtttgttacttcatacctcaaaaccaccctgtaaataaacaacttgagtgtatcagatcccagtgggagttcctgatcttactaatgataaaaaatattttagatcagaggttaccacataagtgttaattgaaagtattctgtattcatctctcagatacccagttatcttagttttatttgacaaacttataattttatgttccagtattgtgttctagactggaaatacacaaagataaagacacaattcttcctcacaagacacttacagtccaggtgaaagagaggacaaataatacttgctgatccctgcagcttgctaaaaagtgcttgaaacttgagatcagctatccctttcaaagggaggccttggtctttcaggtcaatatcatgtcagaaaaatacatgtttcaggcaacgtcattctcatattgatcactgtgagaatctcactttatgaaaagatctccccagaacaatataacactttttttttactgtttttattgacttatcaatccatctttgattctttagatgggaattatttgtggcccaagatagacaagttcaatgtaaattctcattcatgcatcatcatcaaaatctaaaatttttaattatacatctcaagaatcatgttaggtagaaaacagaaatcatatttcaattttcagttttatatagagagagctgtgtccaagtcctcttctgtttaaattatactttaggagcctagttcatgtttggatgctcactagctaacacaatatttggcacgtaagtataaaatatatgtagactgaatgaataaatactttcactgttgctttttgattagttaaatgccaacttccttgtcattgatggactttcattaggccctcaagtttcccccgtgtatttctgcaaatgctttccacactgccagtagagttagttttctgggttaaaatttgattatgactgttcttcaaaaatacctttgttggttcctggtaactcagctaaaatccccttcccatgttatctaggtttaatcatgctctgacctcctgccttgacaggctttctcagaacacaatgggttcctgttctggttgcatgcagctgctcacaatctttaggataccacattctcttctgtgcttccatgctttaatgtgaactctcatagtctgcagtaacatttctccatttcactgcttggcaaatgctcactcatgcttcaggattcccctaatctatgaactctttgaagctttcccagatgaagaagtcctttttaatgttctttggtgttatctttgctgttctatagagttttagttaaatctataatattgtaattccatgtttgtgtatttatctttcctgctgggctgtgagatagaaaccatgtctcctttcattttgtatttctggtgtagtgctagactgtaataaatcctgatgaataaatgaatgaacgaatgaatgaatcactcaatcgattaatatatttttcttagggaacaatgggagaaaatctctggatctatatcagcgtatactgccctgacagaaattagaacattttcatctaataggttcacagaaatagctgagccagctttgtaaaattgtactgctttgctattttaattgttggttttatctttaaaatgcttgtaaagtactttaatattgttaatatttatctccgtgctcactttagaaaagttgaggcaaccttcagagagaaagaaatctgagagagacataaaatttgagataaggtacaaataactaattggataagccatcagatggctttctgtacttagcacaatttacttgaaggtaaagagtgggcaattatagataaaagaatacaacatatataacacaatatattttctccagaaacttacacttttgagaccttgtcaggatactaaatttactaacagctggagtagcaagcatttaattagcaccatttcagcaccatctctggatgatgtttggaacaatccaaactagagcttcatctctttaaggctttaagtttttgttaaaatcactaagactttcacagaggtgatattttgattacttacaggtgtttgacattttaaagtgattagtacctaaaggcagattttcctggaaggtgaaggatagaggttgttggtatggaagttttaaagaaaaagtactgtgactagagaccataagtcctggtttgccctggacagttccagtttatgcccattgtgtgattggagtcattaatagcatcccatatcattctcagaagtgtcctggtttgaacaataaatcatattgtcaccttaacaatgataaaaaagaacagtggttgtgatgagatcgtaagtggctgaatgtgctaaaaacaaatctggacaacataacagctgaccctgatttcttaggactgatgcctacaattctaaaggaagctttacctgcaattcagaatttatacaattccgaaatgtaacaatgaagaaaaaccccttttgatctttccaaatagtgagtttatgaatccattactccagcttacatttctacgattgcaaatgaaaacacttagtgtcccaagtagattatttattaatgtaaatcattacctaaactcatttatttttagaactgtgattacattctgatgatagtttgattgacagctaggtgaaaaatagtcttgatcagtaaagaacatgtaagcacacagtgataagacctgacgttggtttatagattatggtgtcattgatgcagatataagcagagaggtggggggaagaaatatttcagggatccataagtatgcttatatggcattctgagggcttttttgaattagaaaatcaaagaaatttttaaatgcctaaccattcattttataaagttgaagtctgcatctcaaagattgattaaataatcctttcgaagtggtggaatgtcaaagacgcagctgttttaccgaattattcaggaaggtccttggtatgtaagtgttcaataataacattcacataacaaaacaaaatcagatatgaaattattcactaatgaactatttatataataattattatgcaagtagaccaatacatgtgagccaatttagtgcacgatattttgcaaatgcaattttataaatctttcaaaagaattatgtcatgctaggtacttcagaagagaaatattttaatttcaaagatttgagagacccttgggaaaaggggaaatccttaaatatttctcagaaaaaaatggttctcaatataatcatgctatgcaagtcaaacatgagaggaaagatgttgtaatgcacctaataaaattttgtcaaaaaaatgcccaaaaggacaaatcagcacttaactcattctttgcgtattttaagaacaattttaccattgcaattaaaacttaaattctgtctaaaataaaaagcaataactttattttaatgaattttatttatttttaagataaaagtcttgtgtagttattttcattcaccacttattgcagaattctggacagttttaagtggattgaatttaaatggaattttttccagtgccctttatcttgaagtattaagactttctatcatttcattattcacttactgaatatatagtaattgaatatccttctggaaatagttctatactgcaagcttgcaaaggttcaggaaataaaggttataaaaattagctagatatatccaagtaaaataaaaatgattatatgataaaaacactgagtgtaagggcgaaaggttaacataattaagaaagtattttgtaaccatgaatgttaaaaaataatagaatttgaaatagaaaacccactctttgaaattctatatttatttaaataaatcaacagttctaattctctccttaatatcttgtgttttcttgagctttcatatataattttctgcagtttcctattcttccataagaaatgcatttgacttcaaatctgcttttccttcatcccattacagtcatggatgaatagtggctgacctccttattaaggccataaacctagagcaccctgcactcttcagtttgccattatttccacaaatagtttttactggtacttctttaattcatgcatcctgtaaaattcgttgtttgtgcaggaagaaacaatgagaacaaattcaatttggcatttccagactaactatactaaaacctatcagacctccaggaagagtcttttaacttctttgagtagaaatttctcacatataagacaggaaggatgaattattgtgttctagctctaagattcaatgtacaccattacagttagagcacactcataattatcagagaaaaaattgaggaaaccctagtccatgaacaatattatatgtattgtatagcattgtatagataatatcgcatggtgttttttcttacataatataaatatacatttaagtgtttgaatattaaatgttaataatccaattttaaaataagttttgtattatgtactacatttataaactctcctgtaatctggatattatgcatattaacactaaactctcacataattacatattataaggaaatgtgataccacaggagcataattagaggaaatgcaatccaaatctcattcagtattcttgctaatgctgatatcaatgggcacagagaattccttggaaggaatttttattggtaacagagattacaggttgggcatttccaaaatatctgtatacaaatattttgaattttaaaaaattctagtctcagagctttttggcataacttgttcatggcacatcattatgacacaaaaatataaaaaaaattttaaaatatttatttccgtcaatatatactgccaagtctatttctacatattttatttccatttctaataagtagttttccttacaacctcttggccatgttttgatgaagacctaaaaataataaaaaataatttcttattcataatataaagctttgatcttttttgtgtttttttcacttaaataatacatgtcagaaattactccttatcatttatattgaccttcctcactcttttttatagctgaaacactgaagattctaaggtgagtaaaatataatttccacgagatgtgtagtgaggatgatacacacctaaacaaaaacacttagtaacattttaaaagtgactttattgaaggtatgcactctgttaaattacaaaaaagaagagttttcatacttccgcaaaggaagtctggttgagatcagtagagcaggccatgtttaaactggataggaaggtaggggttacccaagaaagaaaagtttggtgaagtgcttgacagacatggtgaacagcacgccacacgtaacaggaggtctagactgaatgtctttgcagagtggggagtagtataagttcttcacacacagaggtccttccaacatagttgataaatttaactcagcaaaagtaagagcaacaggtttaggaatgttgagtatttctgcatgtttggccataagaagtatggaggggaaaatcacagactataaagctagataagtagatttagaatagtcaaaggagaaatgtttttctccttattcttttctgacatggatttatgaggcagtagttaaagccattacaatgtataacttttcccagcaagaggtcagaggataaaaggacagaactgtagtgaacttctctaacaggacagaaagaaggcaaggagtcagcaaaagagatgaagagagtgtctagaaaggcagaaatatgatgtgtcatcaagaaggaaaagacaacctaccagatagtagaaaacatttacaaactgtatatctgataaagcgttaatatccaaatatataagaaactcctacaactcaatagcaattttgtaaagagcaaatggtaagagacttaactagacatttctccaaagaagacatattagtggccaatgggtatatgaaaagatactcagcatcactaatcatcagggaaatgcaaaccaaaatcacagtgaggtaatctgacaattatagtaattataaaaacaaaagaaaacaaacaaagaaagtaaaagataacaagagctggcaggacatgaagaaactggaacccttgtacattttgatagaaatgtgaatagtgaagccaccatggaaaaccgcccaaagggcccacctcctaatactatcacctcagaggttaggattttaacatataaatttgaggggatagacacaaacattcagaccttagcatgcagttaaaaattatgttgacaagatacatctcatgttatctgttcttaccacaataataatttaaaagccccccccatcaaaaggttatttgagcaatttaggcaatatagataaatgatagatagatgatagatagatagatagagagaagatagatagatagatagatagatagatagataacacaaaaagttgatcctaaattgtagtgggttaaggattgaataagaattaaaattagagaaaccagtggaaaatgttaagtatattgtgaaatagaagaaaactgttgaagagtggtcttcaagcaaagaaagagcaatagaattaataggcttgacagaaataaacaggaataactcttcttaagagataggaagaaaaaagtcttccagcttatgtacatttctgccactgagatgctcagggtgtaagacaagagtgtgttactacttacttttccacctccaccccctccgcactcatctctcacaacaaacacacacaaacgctaaggtagaagtggtttgaggagaatctggactgctagtaatttttattaattataaaacaccatgttagtaatttctcatattgaaatgacttctgcagaagattataatgtcataagcctatcctatcacagtcttaagatataacatttctccttaatgcctccttttccattatcagcagagaaagaaaaaatctttgataggctattctggatgcaaatagaaatacacaaactatctagttagaaaatctgtttttaagccattagagttcattccttacacactgtggaaagctgtaaggctctttttttctcatgagagtgcgatctgtacaatgtgttaaaagtacagtttgaatactgtattttaaaaaaatacattatttttgcctatcacttgattgtgttatactccagagatttaataggtcagagaagttatttaagaatcacatataaagacagttgtgtgattttgctctgcccaaattcatgaaatagaaacatgacccatctgcctgtctcgatgattgaaaaaaaatatcccatagctgtacctgatcataaaggaacattaatagcagtcactggtattttattaccatatatcctcttttttgagaactgattctactgcaaggaaatgaagaagactgactactgagtatgattgacacaattttcctatagagaatgggaacagcagggcagggcctgcttaatggatgtgtggcctgtatagtcacacagggtccactctcagaaaggcctcatttttggtttagtgcttttctgctgtgaccctgaaattcttagtaattttaaataaagggtccagtatttttattttgcagtgggctctacaaatcatgcagctggtgtctgggagcatgaagacatacttagcacatattcttaagtgactctgtgtgtacacacatgtgagtgtatttgtgtgtgactgaatgtgtgcttatttgtacatgtagttgaaagaaaaaataaaaatgatattaaaaatagcaaactaaatcttaagagacaaaagcaattaagcttgcagtggaaaatagtttaaaataatttcctcatattataaatgatatggcagtaattaaggcttacattctcaccaaaaaaaaaaaataaataaataaaaagaagacatatgagcaatgattttcaaagtgggagatcagaagatgagtattttccaacctctcatatgttttaattaatagcaagagcatatcagtcttaatgatgaatcattccttttaatttctaaataacgctatggattaaggcagtcttcaacaaggaaaaaagcctaataacatctcagccatcgggatggatatttccttgtgattcttgtgattatgtatatgtatacaaaaacttaaaaaaatcctttgggaaataccaaaatagatattattataatttttaatatatagcaaagctttctctttttctgatttttagagaagacagaattgcctctctagtaatgtgaaatttcatttaacatttaagatataaactggatttttaaaatgtgtttctttaaaagggaaaatagtttttaccatgtgctttttcttttaaatacttgcatcatataaataaaatcgttctgataaacacctggttcaattttgcatacctcatggaatatgccaagtaagacaattgcctctcactggtgccaggatatttcattaaaaacatatgattaaacaagataagataaacagatgtacaagcaagcaaatctgatataaccgccaggtaaaattatttcctgaagagaaccttaaatctatgaaatggtctgttaggcaatgttattatatgcagcatactaaatataatttttatgaaaaggttgtcatataaaaaaagacagaactaaaaaggaatgaacatttaaaaaaattgtctcagatgtacttctggaaatttcagagtattaaatgtactgcaacaatttgtccataccacagcaagctctgtctctgttatattgaaggattactgttgaaagaatgtcattgagagcctaaactaaatctaagaacttctacatcagaaagaagtttacagagatcatcagatcttaaagaatgatgccttactctcaaaacataattcccatgccatttctggatgtaacagtttaatgcatagatattagaacagtactgatttgaaataagtaattgaaattatttctcatttttaacttttatttccttgggaaaaacataggaagactttttttgtgtttaaaatacagtatttatctttcagtaatcacatttactaatataaaatacctattttatagattaaatgattgtaattatttataaattgtatgacagtaagtcatggtttcaaatggagtactgaaagggagaaaacaactctgtccttaatatagagatttttttttctatttttctttcttatttaggcagttatttatttttaattattaaataaaatgaagagacgactttgggcgtaggtgacaaaataaaacctcacagatctgggtgatttagagaatgaagaaaagtcagctaaacaagaaatgagacagctttccaagtgcaaatagcattacaaacaaagataagagacagcaatgggcaagatgtgttgcaggtaacctgtgcagactggtctggctagagaagatgattcggcggtcaaattaagaagctccagctttatcttgagcacactgtaaacctatttaaggttcttaagcagggaaatgacttggtcacatatctgatttacaaatataactctgaagatgatgtgtttgaggggacaaacgggggtgtgcacgtagttagtgcaaaatgaagcacagttatgatacaggtaagcgtggtcagctgctgcaaaacagacctgaaacaaactggtgaattgtaaattggtacaatttgatagtacccttaggaagtgagagtgggaataactgtgacagtgtgtacttaacactgttgagtgttttctcaagagtccaggtagttatagtaagttgtaattgagagaaaaatatatcatgttgggagggctcactgaaaacttgtgtagttcctaggttttcttccttttgaagaatgcaccccatatcatatcaaacaagagaaaaaatagtttctactatatatcatatgttccaaattataaaaataatgcaaaataatatattttaagtattttttcaaatgtaaaaaaataagtaaatgggtttgtatattgttttggtcttttactactgtacaatttacttataattggctatgctttctgtaaaattattatgcatactcagaaatgcttggttgataaagttacccagcatattaatttcatagtaataaacttttactgaatattaaattcagcaattaatgaagttataaaatgagtttgtgtggatattcatgcaaaaatttactaatgtcaattctaagtttcttttttttgtttttggagttgtttttattttttataattttcaaatatttttatatactactgaaaaagtttagagtccttaggaaatatgactataatgcttactaatacaaaatgcccctagataatgtagggtatttattttataatagatactttaaatgtctaacataacttctaagaacatgtttatttccaaaatcacagaagaaaaacagggaggaaataagaactaaagaaacattttgctaattttttttcttaatacaggtaattattttgtttttttgcagggaaaataaatcgatgggcagtgttatgatcaaacggcagttgacagttattcccacaaactttgaactcaccttttcagtatgggaaactcataaagcttaaaactgtatttatcagattcccttgcaactatagttttatatgctaatcagattattccaattagatgtagcctccagatatttggaataaataagagaacaatctcctgacgcttttggctatttttttctgttgacaagtaagactgtagagataggagttcacccctctctttgccagcattattactgcaataactgttctgctccactggtgttagaaaagcactttaaatggaagtagcttcctggtcttggtttcttggtccctagatcttagctatagtgagtggtgtgtctttgctcttagtgatttcagacagcacttaattgtctaccttcttgattgtgatagagtcagtagctccccatgtggtattctgtgactcatccctggaggaccatcttccagcttgctcttccagcctgtctacaaatttgaaagcacctaatatgctttattaaaatcctctctccttaaaatatatagtgttgttctttcttacactgaacttgtctgatgtaattagtacctctttctttatggctgttttattaataatagaatagttatatatattatttatttttgaattatctctattattacatttgtatattttgcattctactgccttagggtcttttgtgagcatgactataaagaaaagttgcctaaaggcaacccctgtagcaaccacctccagcatttgtatctgacaatataattcaacatgctgtcctaggagtggaaggagagagaaaaagacttggaaggatagaaattcctttgcttctaccactagctacctcttcatgttgtcattaacaagtctctattcactatttttctttctgttgatttcaaaattcatgtagacattctacccaagaactttttacttgacctcctcatttccaaggaaattttattttactccatcgcaggcattcatttacatgctcaaatacaagactgtgtcatttccaagaaaggtactacccttaaaatttccatatcataattctactctttcctctagttcattattcccataatgttctctcatttcttttatttcacatccatcattatgattatttgtctgcacacttccctttttttttttttttttttttttttttttttttttttggtgttgcttcattgttttttcctgtaaaagtcgtagccctggtgaagttcaaatttcaatatacttcaagagtagacctactaagttaaatgtggttggagaaaaacttcaatagtgctaactgcctcacagttaagtgtataatcaataagaacagggccaatccaaccactgtaaaaggaaagaagtgagaataaatatggacagatgaaagttgatagatttggagataggcaaatacgaaagttactttttagctgtggtacctaccaagggcaaagtaatgggagtgatggtggtataggcattgtctgcaaaaactttaaaaaacatagtaagtttttttatcttagttctgaacagaagttcacaaatattttctgtaaattgtcagagtaatttaggctttgcaagcatagaccacgaataaacatggctgtgtctctataaaactttatttataaaaacaggcggccgggcgcggtggctcacgcctgtaatcccagcactttgggaggccgaggcaggcggatcacgaggtcaggagatcgagaccacggtgaaaccccgtctctactaaaaatacaaaaaattagccgggcgcagtggcgggcgcctatagtcccagctactcgggaggctgaggcaggagaatggcgtgaacccggaaggcggagcttgcagtgagcggagattgcgccacagcactcccgcctgggcgacagaacaagactccgtctcaaaaaaaaaaaaaaaaaaaaaaaacaggcatcaggccatattagatgcatgggtcaaagttttctagctcttgttttaagcaactgctgacaacaggaaaagactgtttcccacagccctagctttggtaggagtattattgccttctggttattgctttttgctcagtgaaaagagaaagatcattatctaagagtgagaaagaggagaagagatagaaaatctgaggagagagaagctaagtaggaaaaaatcagtaaggctgatgagaaattgaataggaaaatatatgatggctcagcagtgctctttgaataggagtcctgaagatttttggaagaatagtgaaaacaatcataatataacaaaacttattttaaattttaactttattttagttttgggggtacatgtgaaagtttgttacatagataaacaggtgtcacaggggtttgttgtacatattattatataacccaggtattaagctcagtacccaatagttatcttttctgcgcctctccctcctcccaccctcccgcatcaagtagatcccagaatctgttgttttctttgtgctctttagttcttattatttagctcccacttataagtgggaacatgaggtatttgattttctgttcccgcaattagtttactaaggataatagcttccagctccatccatgttcacacaaaatatatgatgctgcttttttttggtggtataatattgcaaggtatatatgtaccatattttctttatccagtctgtcattgatggccatgtaagttgattccatgtctttactatcgtgaacagtgctgcaatgaacatttctgtccatgtgtatttatattagaatgctttatattcctctggatatatacccagtaatgggatttctgagttgaatggtagttctgcttttagctctttaaggaatcatcatactgcttttcaaaattgttgaacttatttacactcccatcaacggtgtataaggttttccttttctccacaacctcaccatcatcttttactttttgactttttaatagtagccattctgactggtgtgagatactatctcattgcagttttgattcacatttctctattgatcagtgatattgagctttttttcatatgtgtatcggccgtatgtatgtcttcttttaagaagtgtctgttcaagtcctttgcccactttttgatgggattgtatgttttcctcttgtgaatttgtttaagttgcttatagatcctggatattacaccttttaagatgcatagcttgcaagtactttctcccattctgcaggttatctgtttactctgttgatagattcttttgttgtgcgcaggctcttaagtttaattagatcccatttgacaggttttgcttttgttgcatttgcttttggtgtctttgtcataaaacgttttcccgttcctatgtccaggatggtatagcctttctatttaataaatggtgctaggataacagaatagccatatgcagaagattgaagctggaccccttgtttacaccatacacaaaactcaattcaagatggagtaaagacttaaacgtaaaacccaaaaaaatattttaaaattagaattagctcttcagacatgaggagcactctagtactaattttatccaataaatgaatattattgtgcagcactgtggcctaagtgatggatgaactgtgatatgcctcagttgctgaagctaggaaaatattcagtggttttatttatgaagttttatgctcccttggtttgatccaaatatgaggacgaacatgtctatttgcagttttgactattaaaaattcaaattataactagaagttttcttcctaccaaaagaagactaaaatatttctctgtcagtcacagagaaggattgaagactgctgcacaaagattagagtacactcagggcagaggggtcaggcaataagcaacaatgcatcaaaaatagaaagaaaagagaatacccagtagtaattattcataagcaatctgcgagtatgttgaatggaggaaaccccctgacaataaaatttataaagaagatactaaaaacgagccttctgcaagcacataagtcgatgtagagtgtggtccctattacaaaaataaaacaaaatccaatcttagactagtatggcataagaagagctttgtgtgacgttaagaaaggaattagtaattgttcagtaaactttctgggaatcataataaaaagaaagataactattgattgagaacataatttttaaaattatattattgtataaaatgtataattttataactaattttataagtataattccataattataatttaataattttattaaatatcaactatgggtaagtccccttggtgctggagttacagtaatgaatcaggctaaaatccctgctttcatatgccaggagaaagactacatagaaataaataagaaacataacaacttgatgataataaattctatggagtaaaataatgcagaaaagaagggaccatagatgctttgtatatgatagtaaaatttttaacagtatgactgcataaaagataagtatatatgcaagtttagagaagagaaagtataaactcttacagcaggcaggtcctggcatgttcatagaacagtaaaaaggccagtttggctggaccagaatgatccaagggtggaatagtaggagacatgatcagaaagatgacagagttcagatcatacagtgttaaaacaattcaattcctgctattacaaatacaagtttattaaaaaaaagttctaatggtagaaggccaattaaagtacagttgacccttgaacagcacagatttgaactgtttgagtccacttatatgtggcctttttttcaaccaaatgcagattgaaaatacagtattggaggtatgcaaaatctgtgtctatgaagagcttatttttccaagacatctgttctgcagggctgactgcaggacttaagtatgcatggatttggttatatgccagaagtccttgaaacaatcccctagtataccaagggatgacagtatagtagctttgtattaaaaaaaaaaaatagaattattttgatgtttactaaaaatattctttctttctgagagaatatgcatgcatataatcctccccagccctgcagaactgagtccattaaacctctttcctttataaattacccagtctgaggcatgtcttcataatcagggtgagaacagactaatacagttcccaacatctagctcagtcacaattcctctgacatcctacaacctaaagaatgtatgaaaaggataaccacacccaatataccttatattaaatggtggagaaagaggagaggaaagaacacaaattaattgatatataaattgcaaatatgtccataagaaagcaaggaagaaaatacttataagaataaatactatatgattgaaatataggtccatcaattaaacctcagaatctgtattacaaggtttacgattgctcacatatattttgatttccttttctttttgcaaatattcttatggatctgattttcaggtagtaaaatacctattccaatcactatacttttttcaaaataagaagtttaggtttttttttttttttatatattttacctattctcctctcacctgtttcacaaagtcacaagttggtaaccttctatcctacttcacagagaactctgaatcaatcagaaagaaatttccacagactcacatcattccctttctctacctaccaacttctatttaaagccattatttctttttattattattattttattttttaagtttcgggatacatatgcaggatatgcaggtttgttacataggtaaacgtgtgctgtggtggtttgtaaagccatcatttctacttgagcactaaattctctatgatgtcccctaatccagtacatcattccaactattctctctcccacatcatgtttccaatttttcctcttccattcgcccttaaaaccacccttgttaacctctctcccttcaagtccatggaaactgctgttgtaaggaataccaatgtctttcatctggcaaaactaaataagttgtttgtccttatcttgtggccctaacacactatttaaccttgttgactatcctctccgccttgatttcctttcttcataaggcttccaggacactatactctgttggtttttctcctccctcactggtctctattcctaagcctctttactaacttcggtatcacagtgcccaatttcagcccttggtcctctttttatttcctacttgtactcacttcctaggcaatctcataatcttatgctttaagtaccatccatctgctgaacaacccccaaatttttgtttttattctaaatgtctctcctaccttcagactcatgtatccaactgatcagttaatggcttcacaaagaaaaagctaaagtttagctaatagaaaatctggatgtgaatcagggactaagggaggagaaaagggtagaggatacaatatcatcatattgcaaagtgaggagtcattagatactatccaaatttattgaaaccttagactgatgtcttaaatattcattctgaagttataaagctaacaataggataactaaagaataaaaacataaaaaggagtcaagaaaaagaaagacaatatgagtaagattctatttttttagtcaatatatattctctaaaaataaatacaaaatagagatgtatctttattatctagagttgttgaggtaacaacctccaaaaggactgaaaatgaaaatagtttataaatgtttcctatagtgtaagaaggagaatttttattttttctaagcccttcagtatttgttaccgcgtgtgtgtgtgtgtgtgtgtgtgtgtgtgtgtgtgtgtgtacagagatagggtctccctctgtcacccatgctggagtgcagtggtgcagtcatggctcactgtaaccttgaacttctgggctcaaatgatcctcctgcctcagcccccttagtagctgggactgcaggcacatgccaccacatccagctatttttttatctactatgtatatttatttaattaacatatattaattccataatttgctgacatcaaaagatattacctaactttgataaatcaatgataagcagaaatagtatatgagttatggtggtgttataaaaaaataaaaatggaaaatgacaaaacctattacttttgggcaaagggttggagatgaaaagaggacacatattttcttgttcaatttttattttgtataatgcatctattgcttttacaactaaaataattcattttttataaaggaggactaaataaaattaaaataatacattttataggaggaatatatttcccttcctatttctggaaagaatgaacataattcggcagcagggtcagggttgataggcaatgccattaaattaaattgaattaaattgggaagagaaggcctcattgtaaacacggaaaaagtagtgtgcagaaatgtttcaggagcctctatatgccaggagttcttcctgactgtctaactggttttaaatgattttataaaagatcttttcatggaaagaacatcaagggagcattagaggaaatctatatagagtgtgagcagaactgttaaattcctgttaggagttaccataggaaatgcctgtacaagttccacacattgtcaactttatgtagtaacagcaaagagtttgctcacccaatgtatgaggagttttaaggacaatcagcttcagagttctaacttcctatcccaactttgtttgtgctaataagtcatctagtttttaattgactgaatcattttgtttttgtggtcttcatgaaaaaagaagttaatacaaattgccaaaatttatcttgaaatattaaagaagtttgagaaagaagaatggagctgtgtggctagagaaaggctgaataagagaaaagtctgatgaataatgcaaggtgcacatgcagaaagcacagcaagcttgacagaaagctgttagaaagtggccagacctgagcaataggaagtatacatcctggtattctgcagattatgtaacaactgaggatcctttgttcacttaggatggtacacagtacaaagtagttgagaaacctgattttaaaaagaaaaaactgctgaacagagctgtaaggccggatgtaatcaactctggtctccctctctcatggtgaaacctattatattggtggagataagagtcacttaaggtctcctttcgaaatatacaaatctcaaattttgcctaaaagatgaggagaggctgaagttttaggaatatgaaatatgttaagaagagaacccaagccctgatttggagaaaatcatggaggcttttattattctcccagcagtaatttcaagtgttttttaggaaaaaaaaaatagcaattatctctttttcaaaaagggttctaacaggaaaacagaaacttttgtcatttaggcaacaaggattaatacaggaaattagacgttaaaaccagaaaagagcaggaaacgtgatggtcaggatgggaagtgactttaagcattcagcaaatcagaaggtccaagaataacagggaatttgctgctgatttacttcaaaataggaaatctccagggcaaagtgcctgaaacctctggcaaacctctgaaatatctgtcatttgatgaagcccctaaacctgtctgtcccgttgaggaataacagcaccttctgttacccttttgacttcaaagtctcatatgagcacttcatattggagaaattgatactgaactctatagatgaagacatgtttaccccctccacaaaaggagaaatacatattcttagcaattactgttagttccaatatgatttggctatgtcctcactcaaatcttatcttgaatggtacttcccataatccccacatgtcgtgggagggacctggtgggaggtaattaaataatgagggcgggccaggcgaggtggctcacgcctgtaatcccagcactttgggaggctgaggcaggcggatcacgaggtcagcagatcgagaccatcttggctaacacggtgaaaccctgtctctactaaaaatacaaaaaattagccgggcgtggtggcgggcacctgcagtcccagctactcgggaggctgaggcaggagaatggcgtgaacccgggaagcggagcttgcagtgagccgagattgcgccacagaactctagcctgggcgacggagggagactccgtctcaaataataataataataataataataataataataataataatgagggcgattacctccatgccgttctcatgatagtgacttctcaaaagacctgatggttttataagagtcttttcccccacttcgttctgcacttctccttgctgccgccatttgaagaaggacaagtttgcttccccttcggccatgatggtaagtttcctgagacctccccagctctgatgaactgtgactcaattaaacctctttcctttataaattacccagtctcaggtatgtctttataaacagggtgagaacggactaatagagatcctaacacctaattccatcacaattcctctgatatcctacaacctatccttgtctgtatgacaaggataaccacaaccaatatgctttatatttaaatgatggaggaagaggagaggaaagaacacaaataaattaatatatactttgcatatattatatataataaatatataataaattaatatatactttgttaatatgtccataacaaagcaaggaagaaaatacttataagaataaatgctgtatttattttatttagttttattttattttattttattttattttatatttctgcaactggtcacaagattgagattatttgaagaacaatcttagccacaagggaaatggaattggtgctacatatcctggtggaatctttgcttcttgaggaattaagaactgcaaactaccagagcctaaagacgtggggattagaaacaaatatcgtctgagtgggctattaggtataatcgtgagggctgccacttccattttaacacttggtatccaggactccgttctgggtatgtgaaaaatcaggtaccatgtactggtcacttgttccaagtatatatttaatgcatgttttagaacatctcattaaacttgcaaagggttgattcctaccaggtgcttggaccaactgcagggctttctctttctctggtaaccaaacaacaataatgacaacttaaaactatcttcaggtgttcctaataggagtattttaaagagtagctccttacctaaaggaataaatctcaaacagcataatttcactggcaatattatggaaacagggaggcattctctctcaagttacttgatatatgagccctttcactaaatctgctttaattttccatcatggaagaacactttccagaaataggaattgtaagaaaaattcccaagaatataatttattttaccatctgcttttcttagaaaacaatcagttaataaaatcagttaataacataattgccttggcaccatgttctgagttgtacatgtactacgttagaatgaaaaatgcggtttgttatggattgaggaaagagttccttgaaatcgttttttctccctcctttaaaaaaaattatgtattaattttttttttttttttgagacggaagtctcactgtgtctctcaggctggagtgcaatggcgcaatctctgctcactgcaacctccacctcctgggttcaagcgattctactgcctcaacctcccgagtagctggaactacaggcacacgtcaccatgcccagctaatttttgtatttttagtagagacgaggtttcaccatgttggccatgctggtctcaaactcccaaccccaaatgattcacctgcctcggcctcccaaagtgctgggattactggcatgagctactgtgcctggccctcccttcttattttgagttactttttggaaatatattttattttgaccttcaccataaaaaacttttaatactttattttatcctaaagaatttggcaacattttagtatattaacacggtggataataatgcaacacattgatctatggaaagctttttttattaatgtttaaatgattgtttttgcttatatttttcatagaagtttgcaaaataatgcttggtttaaggaagttatcatagaaggaaaataacttgttacttcaagtgcaaataattattgtgacgatgttatatgtgcatatatatttagatgtatatatatacatatatgtaatattgaaaaactaagaaataattttatttctgtatgcttacatataagaggtcttgtattatcttctttcattcttttttagcaaacaaatatagtaacagaagctcccatcatcaatatagggtaattatttcatttaaaatattttttgtatctggctgtctcttaatttgggggaaaatagtttgctctgtgacctcagttctttgatggatctaagaagagcagttgatttttagtttgttcagtatttttctcttatgcacaggagaggtgatccctacataccagacgagaccagaagtctctaaataagagattttcaagattgatcctttgcatctaaggaattatataatttttaggccaggcatggtggctcacacctgtaatcccaacactttgggaggctgaggcaggaggattgcttgatcccaagagtttgagaccagtctgggcaacatgacgagaccccatctctataaaaaagtttaaaaaattatctgggcatgatggcacacatttgtggtcccagctactcagggggctgaggcaagaagatcctttaagcccaggagttccaggctgcagtgagccgtgatcaggcaattgcactccagcttaggcaatggcatgaaactccatctcaaagatttaaaaaaaggggccgggtgcggttgctcacgcctgtaatcccagcactttgggagcccgaggcgggtggatcacaatgtcaggagttcaagaccagcctggccaagatagtgaaaccccatctctactgaaaatacaaaaaattagccaggcatggtggcaggcacctataatcccagctacttgggatgttaaggcagagaactgcttgaactgggaggtggaggctgcagtgagcagggatcgcgccactgtactccagcctgggtgacaaagcgagactccatttcaaaaaaaaaaaatttaaaaaaggaaaaaaatatgatttttaaagtgcaactcccaaaatttaaaatattcttagcatatatctaattttacttcattatatttctaatataaattaagtcacaaaatatagctaacattaaatctttggtctaatcttgacacgagtccagtttctgcaggatcaatttcttatcatatattttaagtaactactcaaatagagaaactgaccaggtgagaactatattgtaaaatataagctttgtggttacaccatttgaattcaaactttactgttcaacttcataataataaggtattttccaagttatttaagctattcaagcctcatttctttatatgctaaacagaaaataataatttctacctcatgataacatttaaaggagataatgcacatgaagattttaacatggtatctcacacatgaaaagtgtttgatgaatactagtttttaatggggatggtatttattttattaacaaacttaagcaatgatttgcatttataagatacagaaataaatgcaaaacagaatttgtgtttcctatttgtatttgtgttgaggcaggattatataattggtttgtgaaattattacacaaaataataattcaaagacagggtttaattttataactctggaaatagcatgttttcgaagatatatagatttctatcagagtaatactgttcttagatttatagttttgcattactctattacacaagctttggtttaattaaggcaagttagtgataaaaggcctaaatttacagctgaagaaattaataaaagtcctccttggttctgactttcaggaggaagacaggatcaataaaataaacatctgtgagataaaggaggcttttccaattatattaagtgatacacatatcatgcctttgatgacccatcctaggaaaagctctctgtactatagaagagttagtgatattatcatcataaataattataatatgcttcaaaaattctctattagtgtcagaactcagggttcgtaaatagttaaaggtttatacaacctgaagagaaaccagaatgtagatttgagtcttgagactgataaagaaatcgtctatggtgattcataacatttatattacattgaaatgtacagaaacaatttttgaaattctatttggttcttactacatgatttgatctttgctggcaatatttaaagattagctactaaacagcaattgcatatggtgatagaacataatattgtgatagaatacccattctgtatttgattaatgtatcaagtaccatatgctattcaatttggaaactataaattgattttattttcaaactattattgtaaaatgtgttattttcgcagccttttagtgatctttttgctattcactgtaattttctttgtcagaatataatcttgactgaaagaaatcctatttttaagcaagattgtgtctcataattaccattctcagaataatagctattatttatttagtgttgtgggtgtcaggcacttttctaagtactttaaatgtgcttctttcaacaacactatgagatactgttatgaatcatatattccaggtttggaaactgaggcaaggtaagtaactcttcaaggtcacaatgctaataagtattggaatccaaataataaaccaggccatgtgactccagtactaaattcttaaccattgcattcattgccaccacactcccaaaacactattctataatcaattttgctaaaaattttcagaatcagatattgtgacaaataacaatcaatatagcaagcagacattagatcaaacttttaggaatgaaacctttttatttagcaaagtgagatgaattaatatgtactttttattcttcaagagcagtcactgacagggactaggagaatggggagaagaaggatttctcacttccttttgtaaagatagacccagatgacttcaagcaggcactttatttcagttatttgttgggacaacgtaaaatatttcaatgaaaaatgaaatgtgtcagttgtcacattattttcttcatttatacttcatgctaaacctgactgttaaattatcaataaccaaaaggttttctacataacttctatgaaaagttattacatataaatgtaaaacgtccattaataaaagatttataatatttgctaatggaaattgaagcccattaaattaacagtgcatattgcattgcttggatgcaatcagttattgtacaaataaaaatattcttatcatcacatttccccttgaacttcaatgagttttaaaagcaatttgtaattaaaggtgtttttacattttggtagacttattcccaccataatctccagcaccaatcttcatcttgaggcagaacagccaggccagtgctgctcttttaggggagggatagcccagcagatctgcaagggttttctagttcaaatgcattctgctttgagttaaaagtcttttgaggcattgtttctggatgaaactcttctttttaaagtcatagtaaaggacaagattcccttggagaagatgtgattattcaaatgagcttcaagaatcgtgccctccgaacatggtctttgtcagtacaagaatgtccatgacaaaaaagctgaagactgattaagagttcacttatatcccttttcaacagaagcagacacaatctctgttccaattttccatgggacaccttcaaattaccttttcaatttttctaatttatttactaacatagagccaactcgagatgtagttactggtagtttcatgccatagtttcttttatttctcattaaacatgccactgaacagtaatatctctatcatttaaaaaaagggaaaccaccaatggaattatttcaaaagttgattctagtttggtttgaaatacactgctaaattcttaacttcaatattatgaatatgtttttagaaaagtatgtagaatgtatttttacattacttagctaatttattcttttagctccttttcattttactgtctgatccacaatattttcaaagtaagctactaggatctatctataccagagataaaatatcctgtaaatatttttcatgataagtgttacccctcttctattttcctagtcaagcataaatcaagatgttaatatttgccaaaattctggctcttgtaatttgtatgaaagcagtttaaaaagttgtgaaccatatttacaaaaagtttttttttaagtctgtgcttaattcatgtctttaaaactatactatacaaacattttttattttgcatctccatcagtgaaacgttgtgcatgcacccatatttatttacttatcatttgtgcaagttgtgctagtgtattaatacaccatgttccatatacatatgtatccatgtgagtatatatgtgtatgtgtatgtgcatgtgtatgtaagtgcatgaggaatcaatgcaattggccttgtggtattgccagtggatcctgactttactgcaaccgaaaatcttgaaggtgaatgttttagttcacaaagacagctacgtggacaatagtatatttataagattttcacctttaatataatctatcatgcttgaaaagttgttattatgaacctcaaccttctggtttaccttctgccagcagtagaggtcatttaatacagatgctttgcgtaagtcaccaccagatggcattcttgtgtctttgatcatacacacttatttctgaactaagaactactttattatgtgaagtctttaactaaaatttatctgcatcatctttttaattatgagaacgaggcagcagatatgttactttgcttacagagacttaagttctagttttggattctttacccatattgggaaaattcttttacttttcattgtacatgtattgtcataaataaaggatatcggattagatgattcaattcaagcatgtattatcaagcagctgttctgtccatagcactgtgttaaatgtgatggaggatatggcagtgaattgtcaatgcttttaaatagtttaagctaggcaacagatatttagtagacctctttacctgacttctatttaattaaattgccagattctctgttgttttatattttcttggtaaacacactgaaaataagaggtgggcagattgtaaaaaatacaatatggcatacgaagaagtttgtactttattatagaatagattacatgaaataaaccacttaaagttatcaagttgttattgtttgtttgaattttggctggtttctgttaatgacataggaaattacataatcaaagttgtgtttcataaagataaatttgaaaggaagaaagcatataatagggatagagagaccagtgagagggctatagtgccagaaataacagaaagacaatacagcatgatatcactcatatgtggagtctaaaaaagttgatctcataaaaacagagagtagcatagtggtaaccagatgctgaaatcttagcgatggtgtgttgggaagatattggtcaaaggatgcaaagttttagtcagatagaactaattagttcaagcgatgtattgtacctgatgactataggtattaacaatatttctagaaaaatgctacgagagtagatttaaagtgttctcaccacaaaaatgataacattgtgaggtaacatatatattaattacctacattcattcattccacaatgtacatatatttcaaatatcatgtcgtagatgataaatactaatattttgtcaagttaaaaaaataaaaatctttggcatctgctcaaaaaattacttattaaaatgataaaatgaaaaaatcttgttgtgcatgtaacaaatttgacttggacaagttaagcttaaaaatttgtggtgaacctgatgaaaatattaacaatttggtacagagctcaagaaagaggcaaaggaaatagattacagagtaaaactcctatagaatattgttagataaatggatagtaaatgcttctactttttaaattatcctaatatatttactagtaccacaaagattattttaaatttaatagcatcaccattttattcaaataatatttgaacatttgaacattgaataatatttgaatatttgaacattttcattttaaacaactattcagatccagatgctaaaataatgcatcctagataaaaaataagagcttctacttctatttttattcctatgaaactatattattatatgttagttacttcgtgttaaaagaaaatggagtttgctattataatttttttttattttatttattgagctttgcttctaaatgaacagaaacaaaatttttggtatagaggataaccctctgtttcatgtgggcactaaattactttcaaaatgtaacaagaatacacattgggctctggacaagagtatgaagcatagatgcttctcaaattttcctagcaacacatgaaattctttagctttttttttcttgctggcagctccatatctaaaaaattccaattaagccttttcttcctaacttataagtagctgaaaatactgaatttccctaaagttttaaacttttatatcttcaaaatgaatttattagtggtccaacataatatcttactttttctacatggtttttaaaacgaaccacttccaacaggattaatacaagtgacatttcagcaatttctatactgttgaaatgaactaagaaatggaaattttagtgggaaaaaatgtcttttagaaatacatccatggcttccattgctatatttacatactggggagagatgtaaaggttttattcaatgagtggagggaacagcattttcattttaagcaaaaatttaaaaacttcttgtttctgatcttattaaaatcaacatatgattctttggagttttaataaaaataccaaaattagaacaaagtaaagaaaaataaacagtgagtttcaggatttaaaaaaaaaagtacttatttccaaacatcggtgaatttacattttaactaaaagtaattgagtctaattttaccacacctttaaaataaaaggtgtctttcaaatatgcctttaaaattcaatttatcatgtttaggctcaatggtaaacttgagggctaagtgtacacagttcaaaaacttttcatttgttatttctcttaaaagtaatggctaagcagttacaatgaaatggtttatgaagagtttttattatattgttaaaaattagtcaatataacttactatatacatagtaagtaaatacatactcattttttaagtattcctgaacttgttttttaatatgttgtatgttcaaaaaaatttcaaaacctttgctgttagcattaataagtttgaaagttaaggtgtctttacaaatgagattagtaaataattttgtttagagtaatcatttagactctgggaagtgtagtggctatggttgagttgaggggatatcagaagaagattacaaattatatgtagagaaaagattagtatataaagcaagcaaggaagggagatataaagtagcatggctcattcaagaaacaaaatatttctggtgcacatagtgaatgagaggtaagaggaaaaacaaggaaaaaaggtggacagcgtcataagatctgatcatgaagagcttttaatacctttataaagatattagattttacacaacagatgacggggagtcactaaaagtaaaaaggagaaggaacaggtcagaattatatttcagattttattgtgagcaatggaaagtatggttttgagaaaaacagggaaatcagagggatgatttttaattgtcaggcaaaaaatgatgaggtcttgaggatttggctgaaaaaaactaccaataagaggctgaatttggatttgagaaatacggaagggctggtggaagaaggaattagtgagagtcaatgcaggaactaaaacaagggagggatataggatgatgccaagatgaatatcatcattaggtggttgaatgtgtgcgactgaattcttttattaagtacctgattcgggacactgtttcatgaacagtgaaataataagacagtataatccagcgtgcaggaggtgattacatcgttttctatatgagtgtcaggctgcagcttcctaacctaatttctaccactcatgttcaatatgtttcttgactattcattcttcacttaataaacattttcaaaagccttaccatggctaagttcttatttgctagaattttttcccatgtcctcagtctcaattgtttttcaatttttcattggaaaacatttgttagttcaagccagctcctttctttgcatctggattgcaactctgcggtcctgtatttctactcggaaagatctcctaggtatatttttcagatgctcgttgaacatcaaggaatattgcatgcttcacctgactctaatatataataattttggatggtaattagtggagagactagagttttccattgcctgtaagacctgatgatttggaccactaacttttccctaaagtgtttagtttcttttatgcctcagagctaaccttccccatactgctctcacttcctttagcctttccctcactgagtttccaatgaaggaaaaaatttctacaggatcaatgattgtattgaagaaaaggtctcacttctctctactctccacaggtggagaggagttggatacagatttactttttgagggaaaaaatataatcacatacattaaacaaagtaacttcaaaaaatttaacctacctgatttaaatctaatccatgtttctccatactgaaaaaattaatggtaattaaattgtccagaagaagaagagatattcttggaatatatttttttttttggtcagaagttggaatgtcagatgtagcacttagagtgaacagagacctctctctaaatccaggaacagaaattaatctctctctcataatttgctgtgtctttctttatttttatattttctaagcacttgaatttgttaagttatatatttgataatgaaaaaatacatatatttataaagtagcaaaaagttactgctatagataaagatgtctcagcaactcatacctgagaagatttactaatgagggctatgctgtcaatttttaacaatcagcatctttactagcaatgtaactataattcagtggacaataaacggtaaaagcaaaaccctgagaaagcatttctgctgcacttcatagcccaggggtagaaaggctgatttcctttgatagttggccactttgctatgaccagggggcaagttaatgaaaaaggagaagcagcagcagagaaacagaacttatgttccaactttggagatcagtctttctattggcacagcaaactgtgatcattaagaactctggaattagaaatggggggtttaaatccctgctcaaccacttactagatttgcaatcttgagcaggatagcaaacctctgaaacaactacaaaatataaatagtgacttagcttgtaagacttttagaaagacaaagggaactcaacaataactgactatgcatcagggtttagcttgtagaaatgtactataaatggtagagtaatcactgataattgttttctatagtaaattttgggattcctgaagtaaaaatgaagtaaggagtaataatataggaaaacaatgatgaaaagtagagattatgaagctgtacatgaagacaatagaaaaggaaagtagagaagcaaattgagtttacaaagatttacagaaaaatgcctcagaaacaatattacaataatttgacattgggctacttggagagagacagtggttaatttgagcagagaagcatgaaggtagtgtggagcaacataaactaggacaataaatcaagtttaacagaaccaagatataggatgatacctaggcaggttggaaaattaccgacaatttattagcaagaaatagactcaagttttgaacatggacactgaaaccatatggcctggaaccaaaccttggcttactagttatacatccaagtacaagttacttaacctctctatgcctcagtttcctcacatgtaaaactagtgagtaataatacctaccccagtaggattgtttggagtttaaataaattaatataagcaaagcactagactcatatttcatacctactaactgaattgtaagtatagctattattattatttttaataatgtccaagggtatagtttccttgaagatgtccaactcttctgtatatgattatccacttatgtatctactcctaattttatcattaatatcaattttaaataccctcataaatgaccttgctgtttaacacccattgaatgaagctatttatttacaagcccctttccctctgctagaatgttaattccttgagttcattgagcaagccttttatatctctgaattcttagcaaagtagtttccaagtctggctgtacattagaataccctagggaaacaagaatattaatctctgggcccaatttagatgaatacaatcaaattatctgctgggtaggatatatttttaaagtacttcaggtgaatttaaaggacagctatgactatctagtgttttgcaatgaatttgacatatagtttatgttcttctttcttttaatcaaaactcagatgatttacaaagccacataaatatgcataatataaatatatataaatataaataaacagtatatgcataatagcaggagagtttgatatccagaggcattaataaagatttaataaatatgtcagtcaggatcctggcaggcaacgaatggcacagaaaacctgggtgtggtgagagttcgtaaaaactaaaaaacagtgaagatttactaatgagggctatgttgctttcactttttatacctgtcctttttccctattgcttaaacaattttattccttcaacttctttgatgagactaaaagtaaagctcaccatatgtctgttataatctcctacaaaataaggacttcttccagaatgtaaatcaatgatgtccttaaacacagtgttttattgtcctgacacatttttagagtgaagctttgtaaatgaaagaaatagtgcactgagttacattctggcacaaactcattgtctcctggtggactgctcacgtacagcttgtagaacagtactttgagtagtagtggactagactttccacatcaacatgagaacttgctgaatatctttcatacaaaagacaaaacaaaacaaaacaaaacaaaattcctttgccccatgtttccctccaattcttttacagggttgtctgtgtttattatgggtaactcctctttcaccaaccattcataaagccattcccatcaggctttgtcaaggtcacctattctgttaaatcagtagtcagttttcagtcttcatctttcttgatttctcagtagcatttggcacaatagatcatctgtggcaacctcaatgttcagctatttattcacatatccaattacctactccatatgcttgcttatttggatataaatgggcatttcaaagtttatacatgtaaaacataatttttgaattgtttttccctgaacctactcttctcacattcttagctcttctgactcttaccaccttgctctaatatggaatgatctctcacctagattcttggaacatcacctaactactctctctgtttttgtgcttgccttcttatgatatattctcaatatatcagccagagtgatctctggaaaatataaaacacataatcacttttctgctcaaaaccctccaatgacttctgaattcagggtaaaatccaaacacttctaagacctgcatgatctatacagggatgctcctatctttgctactaactctgtgagcttgtctaccaccgtcccttccagacactgttaaggccatgagatccactttgctggtctatggaaacattttgatattagccacatttcagggatatgtaaaaggtaattacattttaaatttcacatttgcaccatcaattaaaaacaaagtgctgaattttaaatcttatgaataccatgaaaatattagaaaagatttgaatatcatatttgtggacattgtaggcctgtaaccttcactggacataattggctaataatatttttaataagttgcacctcaataattacacttttagaaatattttatttaattagatattttggttgtcttgtaatgaatcatcatttgatttattgagagtacataaaagattttttcttttggctaccatcagagttataattaaaaatcccatattttcccacaatccattgaacatttatttaagttgaaaaaattataaaatattttttcacacacatacatattactaaaataaagggaatctatggcagtgacaacctaaaattaatgtacaatagtgtaaatatattactctcatgtgtaactgaacactacaatgaaccaaaattaaattagatttctactaaaagcaagttgtatgttaaagatagacagttttattaataataaatcaacacaaaagcacaattttagctttcaaattattgcaaatatcttgaaatacaaagtggtctgtcttattaatcttcttttatttcaagtacatgaaaaattaaaaaaagctcatacaactcgttggctccatcaagtaaactgttgctatgttttgaatgtttgtccacctccagaattcatgttaaaatttaattgccaatgtaatggtatgaggaggtaggacctttaaagggtaaaggtgggtttaatgcctgtgtaaaaaagctcatgaagtgggctctttttcttgacccttccaccttctgccatatgaggaacagcattcctccccttcagaggatgaagcgttcaaggcaccatcttggaaacagatactttattcccactagacaccaaacctaccaatgccttggttagacttctcagcctcagaactgtgagaaatacatttcttttttttaaataaaatacccattctcaggtattctgttacaacagtacagaacggactaagacaaccacatttcaagttcattgggtgttgcctcattgtaaaatgtactgaaaatattaatctcatcagttccaatatctctattatgattgttactcaattacgatcttgatcattcattattttaaggatcataatgaaaactaaaaatattgatttaaatttaatatacaaaagcattgcttatctatataatataataacatacattatatttctacatactgacatcaatttttgagaaaagaatgagacttgtaataagaaaaccatttagtcagattttacctataacagctatttgactctgatctattcacttaattttcctggcctcccacttcttcatctgtaaactaggattttcaaactgatgagttctaagctgtatgtcaattctaatgtcaagattgtataataatgtctggaaaaaaatggtggttgcctgtttccaaatttcctccacactccctctaaaaatctataaataaaatcaaggatgaaaataaaaccatacatgcatgacatataccttcaacattaattggaaaaagagaatgctatactcttacttgtctggaaatagagaaaaagaaaaattcccacagagtccacctgcaaggagaaagtcaaacattcaatgttaaagtaccaaacacacttggtagttcacagcactgattaaatgaggagttttaaagtgtgtgggggcagagtgtggtggtttacgcctataatcccagaaatttgggaggtcaaggtgggcattcacttgaggccaggagttcgaaataagcctggccaatgtggcaaaactctatctctactaaaattacaaaaattagccagacatggtggcaaatacctgtaattccagctacttgggaggctgaggcacataaatcacttgaaaccaggaggtggaggttgcagtgagccaagatcgtgccaacgcactccagcctgggtgacagagtgagactctgtctcaaaaaaagaaaaagaaaaagaaaaaaaagtaaagtgtttgggattgaaagtagcagtctcagagagcaataattaatttctaatgagtgctactctttctctatacgtatgtatctccctcacaataaaaataagaaccacaacaaaaaaataaatgaagaatcccaaagaaacaagaaggaaacaacaatgtgtcttatccataccaacacaatctataaaataaattgtagagaagagtacagaagagggcattcttaaaccataaacattgttcatgaaatgaataggaatagaaaaaagtcaatcacatctacacaacaatattgtggtaaatcagaaatggaaacgacgcatttctgaggaaaacaattttccccctgaaagcaaccgaatacagtaaatcaaatatactcaaacacacaattgaagatataaaaacttccttgaatcagaaatataaatactagaattataaatggacataaaacagattttaatgaaacaaaaaatgaattaactcaggaaagatacagaaaaaatgacaaagtcatatcagaaataaagataaattataaggggctcaaggtagaaggtttcaaatgaaaatttaataaagggcattgactaaaaactgtggggaaaagaaagagagatcagattgttactgtgtctgtgtagaaagaagtagacataagagactccattttgttctgtactaagaaaaattcttctgccttgagatgctattaatctgtaaccctaccccgaaccctgtgatccctaagacatgtgctgtgtcaactcagggttaaatcgattaagggctgtgcagggtgtgctttgttaaacaaatgcttgaaggcagcatgcttgttaacagtcatcaccactccctaatctcaagtacgcagagacacaaaacactgcggaaggccgcagggacctctgcctaggaaagccaggtattgtccaaggtttctccccatgtgatagtctgaaatatggcctcgtgggaagggaaagacctgaagttcccccagccctacacctgtaaagggtctgtgctgaggaggattagtaaaagaggaaggaacgcctctttgtagtggagataagaggaaggcatctgtctcctgctagtccttgggcaatggaatgtctccctgtaaagcccgattgtatattccatctactgagataggggaaaaccgccttagggctggaggtgggacatgctggcagcaatactgctctttaatgcattgagatgtttatgtatatgcacatcaaaagcacagcacttttttctttaccttgtttatgatgcagagacatttgttcacatgtttacctgctgaccttctcttcactattatcctattgtcctgccacatccccctctcctggaaacgcccgataatgatcaataaatactaagggaactcagaggccggtcccagcacaggtcctccacatgctgagtcccagtcccctgggcccatttttctatctctatactttgtctctgtgtctctttcttttccaagtctctcattccacctgacgagaaacgcttacaggtgtggaggggcaacccacccgttcaaaaacaggaaaaaatgctaacagaataaaaatgaaataaagaataaacaaaatggatcagagagaaagtagctgacatggaagagaaataaataagttgatttagtatccttgaaaaagcaagtaaaaatgatgaaacagaactattatttacaagtataatctataaaagttttcaacaataaagaagtctccagtctagacttgaaagggattactgggtactgaagaacattgacctggtacaatcactctgagacaaattctaataaatctttttgttacagaaaattaaaagaaaaaatattaagagcctccaggtaataagttgaaataacacacaaaaagcatgagaattagaaaggtatctcaactttccaaagcaacatgtacagcaagacaacagtgaaggagtatttttaagaaacttaaggaagtaagagtgccctaagctttcctttgagtgaatagactacagaaaaaagctttgaacctgaagaactaaaggaattgtacacatgtgctcttctaaggaatctaccagattttttagagctttattcaaccaagagaggactgggaaagttttggcaaattaaccgatagtgagaaatttatattttaattttagaatgaagatgaaataataggtggggttataaatagacgaaaagtatataaatattatatttcctgccaaagtagaaagaatgtaacaaaaaaatagtaacataggggaactctgcgtgagcttttaggaaagcaagatatagttttccaatctacatttggacctgaggcattgtgaggctagagcaactacctccatcttggtactgtcttcacctacttgtcctcttgttttaaatgttttaagcacaccttgtttcttaattcaaataaaagagaacatatcagctatggaaactcatactttttttggttctttctctataaatttatctgcatcaaattcatcctgacacattaacttctggtacatgacgacatgcctatccctgctcatgattattctctccatctacaaccttgaaatgatgccttataattttctcactgacacctgggtgcactgttgagttttcagttacctaattgccaccaaatctatcaaaatttatatttcagatatgtaacacacctctgaattgtggaacttatctacacaacatacggacatccaccttttagctgatagtacctacttgtttctcaaatcttcctgtgagaattttccgtactttattcccaggttttccatataaagagcccaaatctctttcttgagttccagctgcaaattaacagctccaattttatgcctcacggtgaaattatatgcactgagtcgaaatctactttatttttctacttcacaccttatcttccctctttacattatatttttgtaatgtcatagcagctgttcacccagtcactaaagaagaaagctgtatgttatctttgattatcccctatacttcaatgctactttcacacctgtttgggcattagagacaattcattttgtcttttaaaggtcttcagattctattggctttaaaaccccaactgtcaatatcttgggtaagggcttctatcttttctgtataattgcagtagcctcttaattcacatttcacctttgattcactgtctatacaatttacagaataatcatatccaaatataaatcatataatacaactgattgcttaaattcctctgatgacttcctaaggtctaaagccacatttttaatctcatctgctggtgctccctccttgttaccattatgcttcagaaataataagtacttatagataggcctttggagccaggctttcaggattatacactgctttttatgcagtgtaagatgcccaccacttatatgcccccactttgctgacctgatatcacctctcatctgaagactgccctgataccttgtccctttgtcaaattaattacagggctttctccaatgcactaccatcataatataatattattatatgatatattatcataatagaaacttgtactaaaacttctattattatgttaatgggtatacatttttatttgttcatatccatgtctacctcttgtctaacaaggcagaaactgccttaaaagaagaactcaagcatatagcatctgtcatagcataaatccaaaaactagaagtatttaataaatgttagttgaatgaatcacataaattgtgatttaaatatcactgaatcaagcttttatcattttgaattccttgttacttatattatatacaataatttataaattaagtttcgttttttagtaagtcaagttgtaatcattcttcttttattttaaatcgtagcaaaaaatattttggtgaataaattaacatacttgaaaatttacacagactttctagttacaagcaggcaaaataaatcaattattattcacaactgagtgggcctcaaagtcatatgattatttaaatgtaagatgtgacaaactaaaaataaaagtgagtctcactgtcatggatctacttaacccactttgccaatctagttaattcacaaagcaatatatttgtatttcctaagcacccattgtgtgttttaactatcttccatctttgcataaaatatacatatttagaaaatgtgctaattttcacaatagtattctaaatctgaatcataaaaactaataccttttatctatatatagaaagttacctttatttgctgtagttttacaataattaggtcagtattttgtaggattacaactaagacagcacatttacaacttctagcatgatacttgatatataaaaggtgcccaaaaaaatgttaggatctgtctcattcctgacaattgcaagtaagccacataaggagaaaatagatttttcagaggacagcttatcttttagaaaatgatagagcctcatttacattttcctattgactccttatttaaaccatgggaaacataacagccgtatcacctgtatatgcacaataaccataataatttacattgtgaaaggaaattcagtggatacaacaaaataaggttcttacccaatgttgctttttaaaattattattgtattttaccccattattgaatcatatttctcagtttttttattatcttcataaattttcctactaaataatccaccaaattatttttcttacgaaaatacatcatcatcttataagcttcaacttgactaagatttaggcaacaagaatttgaagtgtcaaaaagatataatttactttctttcatttacttttggtatgctgctgtctaaatcctgtcttctagactaaggtcagattttcaaatctcatattttctatggtgtcttgcaattctccattttcttgaacattaatcttctattttcagatctaaaagggttggaaaaattgccttaagacatattgtgagcagcaagtttgaggtagtgtgagcttgaccaaaaatcctattacatattcctggatgctaatgaatatttgaattaatttttaaaattgtcttttagttctaaagcaatgaccattatattgtttccttacatttccctcagaagtttctatatgttaattctatatcaaggctgtttgagaaacacatccttgggtaaggaattttagttgattcactcgtgtgtaaagattaacaataaatatacaatttaatttattttaaatctcatcatatatttttattgacctcccaacctctgctgtaaaaggatccgaaacataaatgtggctctggatagaatgattaagcatgggaaaagcttttgtacattttttagtatgttatttttccatcttcattttcttcttttaagctgtatttctggagggttatgcatcatttgtgaccaaaatttggagatgctgtgcccaaaaatgaaagacaagcaaaaataataagcacacaatatatttacaaatacgtgttattgataaaattcagcaaactttccaggctttgtctggttctttcatttaagtaaaagcaatatgaaatttttctcccacataatttcacagaacacaaaccacggaaagaaaagtagtatgtttaatgtaaataaatattggttgtattttatactctattttatagcttgtgttgtttgaatttttctatttgtataaggcattttcatcctgtttaggatgcctatttaatgtatctaacagctttaaatgcagatacttcttaataagtattagttgttgatgatattatttatgaaccataacaattgccagtatgttcaaacacgattattttaaaaggtgtaagccaagatatttatacaaagataattcaatttgagtttctattgttcctcaaagaaacaaaaaatgcattttcttctatttgaggaattgctttgaaaatgccatgacttggtgaccacgactgaattaaaagacagagacaatattccatttccttatcgctactagggatatatcaagcagaaaatgaagacattattattttgaatgagtttttcaagtcagtttgagtcaaagtttgcctccaacatatatttaatgtagtctgcaatgttgtgaaagctgaaataaacatgaatgacacttgagagcactggccagaatatgttgcttactgatgccctgatacttttttttaacctaaaacattgccatggaaattgagtagtagactaaatcagaaaatcatattaaatatatcagtgagaacagccaccttaagctttccaatgcttctactaacacaaaataaaacattttataaatatttgtggacaactttggaagtagtaatgactacttttttaaaaaatcaataatctttgtttttagagcagttttgtgttcgcagcaaaattaaacaggaagtacagagttttcatatactccctgccctccttcacgtacaacctccccaactaccaacatcccacactactatggtacattcgttaaaattaatgaaactacactgacacatcattatcacccaaagtccgtagttcacattagaattcaggcttggtgttgtatattctgtgggttttgaaaagtatgatggcatgtatctactattgtcatattatgtatcatagctttactgacctaaaaatcctctttgctctgcttaatctctctcgctcccacctaatccctggaaaccactgataattttattgtctcaattgccttttccagaacatcatatagttgaaatcatatagtatgtagacttctcagattgatttctttcacttagtaaaatgcttctaagtatcctccatgtcttttcatggcttgatagatcatttctttttagcgccatagtttatttatccattcacctactgaaagacattctggttgcttccaaattgacaaatatggataaagctgctgtaaacctccatttgcaggtatttgtgtggacataagttttgagttcatttgcgtaaatttcaaggagcatgactgctggattttatggtaagagtatgtttagttttgtaagaaactaccaaactatctctcaaaatggctataccattttgcatttccaccagcaatgaaacagaatttctattgctccacatcatcaccaagatttgttgccatcagtgtcctggatctgggccattttaataggtagctagtactatctcattgttttaatttgcaattccctaatgacatatgatgttgaacatattttcatatgtttaattgccatctgtgtatctttttccagtctgttcatataatttgcccatttttttaaataaggttggtcattttcttattgttgaattttaggcactcattttgtattttggatagcagttttttataagatgtgtctttgcaaagattttctattagtctgtaacttgtcttctcattatcttgacactgtattttgcaaagatgtgtgtgtgtgtgtgtttgcgtgtgtgtgtgtgtgtatatgtatttaacattgacctcagcagtagctcaaagtttttcattaatatgtgggttaatctttgtggcaaactatattattattttaaaagattcaccctcttccctcatatttgaggacagaatctactttcctgtcccttaaatctgagcttgacaatgtgtttgatttaaccaatagattttaggaaaaaaatgcaagtagagctttaaaaatagttgtacaattaaaattttagcctatgaacttttttcccttgtcagaaaaagaccatgcatggctttgcctactggaccaaggagaatgaataattcatgggtcaaaattcagcctttaaattcaaaattcagccatcttcagcccatcacagagttgtgaaaaaaatagttgtgttaagctattgaatttgggatggtcagcaccatcaaagtgtccatcaaatgatgcaatgccatatttagaaaatgacttattcatataaataagtacctctttgcatgtagtcagatcagccctattctaaaattctaaattctaaattttattctaaaattctgaatgaaaattatcaagatttctttctcatgtgagataagcaaaaagcaaaaatcacattgggattttatttaatcaaatgaagaactctgatctcctctgctgttaaaaaatcaaattctgtaaacctaaatgtcacacatatatcctattttatcttctacttacagtaaataaggaataccattttactaatatttcactaatgtttcttccacttgaattaatatttttctttgatttagaatttcttccccaattagatataataaataatcaccactatatcatatttaaaattaaatgattattgacattgaggggaaaacacattcttttcataggaattgtggtgattatagattatttgacaaagttcttatacagtaacgcaaatgtatttgtcaatgtgacaattacatataccctggcgccatgtagaaacgcaaagtgtgaagcaatatagtacaatataaagtggcattctcagatacaatagtgtatagttccccattggctcaggcactacttataggaactataagagaagtcaaacaatctttttgagtctcaatttccttatcttaaaggaaatgaatatattcaataaaattatctaatcatctctaccagattgaaagggcaaagtaaggcagctgaatagaatcctccagtgaccgtcaacatctgacacacaaaatcatcaaattgaacatctatccacacaagaaagcacttctgtaagaaccaaaaatcaggtgagcaaccacagtacctgcttttaatatcatgtcaaggaaagagacactgaagggggaagtaaagacagccttgcactgcctacaccacacctcccacatcgtccagcagcagtggggcacacagaatctgtgtgcttggagtagggagaacacaacaattgcgtgactttgcataggaactcagtgttgccctgtcagagtggaaagcaacatagggcagaattcagctggtgtccatggaggaaacatttagaccaatcctggccagaagggaattgtctatcacagcagtgggaatctgagtttggactagccctactaccataggcgaaagtggtctgggctctaaataaatttaaaaagcagtctaagccatgaggactggaattccttgacaaatcctggtgctgtgctgggctcagagccagtgaatatgaggttcatacaacctagtgagacaccagctggggcagttaaaggagagcttctgtcacccacccctaactccaggcaatgcagctccaggagagtctgttgctgcttgaggaaaggagaggatagagtagaggatttgtcttgcatccagctcagccatagtaaaataaatcaacaagcagactcctaaagtccctgattccaggtatttatagacctgccctggccagaaggaaagcacttctctgaaggaaaagacccaggcctggaaggattctgcataatctgactaaagagtctttgggccttaaataaacattagtggtagcccggcagtacttaccatggttgtagaacagggatggccatgaggtgagactccttctacttgaggaaaaaagaggaaaaagtaaaaagaactttgtcttgcaacttgggtaccaactcagctacagtaaaataaggcacccaataaataactaaaattcataactccagatgctagctcacagacaacatttctagattcaccttggaccagaaagaaaccaaccacctggaagagaatggcactagtctggtaggattcatcatctgctaactaaagagcacttggaccttgaataaacaccagcagtagacaggcaatagttgccacaggccttcggagacagccagtactgtgatggcttcagctgtgacccaacatagccccagtggtgctgaccacaggagtacttgtgtcatccctccaccaactgcaggcagctcagcataaagacagagagactctgttgggaggaaagtaagtgaagagaacaagtgactctgcctggtaatccagggaagtctcctgaatcttacctaagaccactaaggcagtatctccataagactgcaagatttatagcgttactgggcttggggtgccccttaatgcggatatggcagtagtcacaaaatacttaatcacaatactcaatgctttttgattacttggaaagtcttctcaagaaggacaaatacaaacaagcccagactgtgaagattgcaataaatacctaactcttcaatgcccaggcatctacgaacatccacaaacatcaagaccattcaggaaaacatcatcttaccaaatgaactaaagaaaggaccagtgaccaatcctgtagtgaaagatattcaaacaaagaattcaaaatagctgttttaggaagctcaatgaaattcaagataacacagagaaggaattagaatcctaccaaataaaaaaaaattaacacatagattaaaatatctttagtaataaagtagaaattatggagctgaaaaaggcaattgacatactgaagaatgcatcagtctcccaacagcaaaattgatcaaacagaagaaacaattagtgacctggaagacaggccatttgaaaacacagagtcagagcagacaaaagaaaaaagaataaaaataataaaggatgcctaaaagatctacaaaatagcctcaaatgggaaaatctaagagttattgcctttaaagaggaggtagagagaaagatcagggtagaaaatgtattcaaagggataaaaacaaagaattttccaaacctagagaaatatgtcaatattcaagtgctagaaggttataaaacatcaagcatatttaatccaattaagaataccacaaggcatctaataatcaaactcctaaaggtcaaggataaagaaaggattttaacagcagaaagagaaaagaaacaaatagcatacaatggaactccactatgcctggaatcagatttttcagtggaaaccttacaggccgggaaagagtgacataacatatttaaagtgctgaaagaaaaaaaaaatctatagtagtatacccagtgaaaataaccttcaaacatgaaggagaaacaaatactttcccagacaaacaaaaactgagggattttgtcaacatcagacctgtcctataagaaacgcttaaggaagttcttcaatctgaaagaaaaaaatgttaataagtgataagcatttatataaaggtaagacattcactggtaatagtaagtacacagataaaaaagaaaaacacggtaattgtggcgtgtaaactactcatgtttttagtgggaaggctaaaatatgaacctttcaaaactaataactacaacaaattccaagaagtagtataatgacataaacagacataataaaaatttttaaaatgtgggggataaagagtagagtttttatcagttttctttctgcttgttaatttgttttgcaataagtgctgttaatagtttaaaatcatgggctataagatattatttccacatctcatggtaacaaaaactacaacagatacacaaaaaaatagaaagccaagaattaaaacataccatcagagaaaatcaccagcacataaacgaaggaaggaaggaaggaaggaaggagggagggagggaaggaaggaaggaaggaaggaaggaaggaaggaaggaaggaaggaaggaaggaagggagagaagggagggagggagggaggaagggagggagggagggaaggacggagggaagattataaaacaactagaaaaataacaaaatgaaggtagtgaattcttacttatcaataataacattgtgtgtaaatgggctaaactctccaatcaagagacatagagtgactaaatggatttttaaaaagtcctaaatatctgctgcctagaagaaacacacttcacttacaaagatacacatggactgaaaatacatggatggaaaaagatattccatgcaaaaggaaacaagaaaaaagcaggagtggctatacttatatcagataaaatagatttcaagacaaaaaaaaaacataaaaagagacaaagaaggtcaatacatgttgataaaggggtcaatccagcaagaggatataaaactatacatatatatgtactcaacaccagagcactcaaatatataaagcaaatattagtgctaaagaaagagatagattctaatacaattatagctggagatttagcattcaagtttcagcatcagacaagttatccagatagaaaatcaacaaagaaacactggacttaattagcaggataagccaaatggtcctaatagatatttgcagatagaataaaactagaaatagataacaagaggataaatacatgataattaagcaatatgctcctgaatgaccagtggatcaataatgaaattaagaaggaaattttaaaatgtcttgaaacaaatgataatggaaacataacataccaaaacctattagatacagcaatagcagtactaaaaggaaagtttatagcaataagctcctacatcaaaagagtaaaaaaacttcaaataaacaatctaatgataaatcttaataactagaaaagcaagagcaaaccaaacctaaaattcgtagaaacaatagagatcagagcagaaataaagaaaattgaaacaaaaaaaatacaaaagttcaacaaaatgaaaatttgtgtttcaaaaagaagcaaaataaacaaaccttatgtcatactaagatacaaaaagagatgactcaaacgaataaaatcagagatggaaaaggagatattacaactgataccacagaaattcaaaggatcattagatgctactgtgagcaactatatgccaagaaactggaaaacctaaaagaaatgaatcaattactagacacatacaacctaccaacattgaaacataaagaaatccaaaaccttaatacaccaataacaagtaatgagattgtggccataataaaatgtcttccagcaaagaaaaacttgggacccaatggattcagttgattttaccaaatatttaaagaagagcaaatactaatcttactcaaagtagtccaaaaaatagaggatgagggtatatgtccaaactcattctacaaggacaatagtatcctgatatcaaaacgagacaaagacacatcagaaaaagaaagctataggccaatatgtttgatgaacattgatgtaaaaatcctcaacaaaatactcccaaacctaattcaacaatgcattaaagagatcattcattatgaccaagtggcattcatctcagggatgcaaagatggttcaacatctgcataccaattaatgtgatatagcatattaatagaatgaagaacaaatctatatagttatttcaattaacaatgaacaatcatttgataaaattcaacatcctttcatgataaaaacccacaaaaatgagtatagaaggaacatacatcaacagaataaaagccatatacaacagacacacaggtagtataatactaaataggaaaaaaatgaaagcatttcttctaagatctggagcaagtcaaggatacccactttcaccactattattcaacatagtaccagaaattgtagctggaacaataagacaagggaaagaaataaagggcatccaagttggaaagaaagaagtcacattatcttcatttacatgcaatataaatttatatttggaaaaatctaaagagtctaccaaaaacctgttagaactgattttaaaattcagcaaagtttcaggataataaaatcaacaggcaaaaatcagtagcatttctatctgccaacaatctgaaaaagcaatcaagacaagtgaacaatctgaaaaagcaattaagacagtaatcccatttatgatagctacaaataaaataaaatacctaggaataaatttaatcaaagaagtgaaagatctctacaatgaaaattataaaacatttacgcaagacatttaaaagaacaggaaaaaaaggaaagatatattacatttatggattagaataatcagtattattaacatgtctataaagcaatctgcagatttaatgcaatccctatcaaaataccaatgacattcttcacagaaaaagaaaaaataatcctaaaatgtatatggaaccacaaaagacccagaattgccaaagccatcctgagcaaaaagaacaaatctagaggaatcacattacttgacttcaaattatactacagagctatagtaaccaaaacagcatggtagtggcaataaaaacagacacacagaccaagaaaacagaatcaagaacccagaaataaatccatacatttgcaatgaactcattttcaacaaagatgccaagaacatacactggggaaaggacagtctcttggataaatggtgctgagaaaacctgatgttcatatgcagaagaaggaagctagacccttatctcttgccataggcataaaaccagatcaaaatgaattaaaggcttaaatttaagacctgaaactactaaaaggaaacactggggaaactctcaggacattggtctgggcaaacatttcttatttattaccccaaaagcacaggcagccaaagcaaaaagggacaaatgaaattatgtcaagtttaaaagcttttgctgtggcaaaggaggcagggtgaagagaaaacacacaaaatgggagaaaatatttgcaaactatctatttgacaaaggcttaacaactagaatatatatacaactcaataggaaaaaaaaaaccaataatctgaataaaaaatgggcaaagatctaatctgaatagatatttctcaaaagaagacatgcaaatggaaaacatgtatatgataaggtgctcaacatcattgattattagagaaatgcaaatcaaagctacagtgagatatcatgtcactctgataaaaaagactttttttattattatactctaagttctgggatacatgtgcagaatgttcaggtttgttacataggcatacacgtgtcatggtggtttgctgcatgcataaacccaaaatctacattaggtatttctcctaatgttatccctccctagcccctcacctcccgacaggccctggtgtgtgatgtcctccctatgtccatgtgctctcgttgttcaactcccacttatgagtgagaacatgcagtgtttggttttctgttcctgtgttagttggctgagaataatggtttccagcttcatccaggtccctgcaaaggacatgaactcatccttttttgtggctgcatagtattccatggtgaatatgtgccacattttcttaatccagtctatcattgatgggcatttgggttggttccaagtctttgctattgtgaatagtgttgcaagaaacatatgtgtgcatgtgtctttatagtagaatgatttatattccttttagcatctacccagtaatgggattgctgggtcaaatgatataaaaatgaatttcttccaaattttatccaaaaaacaggcaatagtgaatggtgaattctggcaaggatgtggagaaaagagaactctcatacactgttggtgagaatgtaaattattactatggagaacagtatggaggtacctcaaaatactgctaggtatgtacccaaaagaaagaaaatcaggttatttaagatatatctgcactcccatatttgtcgcagcactattcacaatagccaacatttggaatcaacctaagtgttcatcaacagatgaagggataaaaaaactgtgctgcatatacacaatggagtattattcagccagataaaaggtgagctcctgtcatttggaacaacatagatggaactggaggacaacatgtaaagtgaaataagccaggcacagaaagacaaacttcacacattctcactcatttgtggaagctaaaaattgaacagttgaactcatggagatagagagtagaatgatggtaaccagaggctgggaatgaaagtggggtggtcgggagaggaggtatgtggtggtgactggatacaaaaatacagttagattgaatgaataagatcttgtatttaatagcagaacagggtgactacagtgaaaaataatttaatgtacattttaaaataattaaaagagttttattggaatgtttgttaacacaaagaaatgacaaatgtttgaagtgatggataccccacttaccctgatgcacttattatacactgtaggcctgtatcaaaatatctcatttatccataaatttatatccctaccatgtacccataaaaatgaaaaattaaatttttgttttaaaaaagtctctttcagctccaatgttctatgattcccctactttaataaatactgacccttgtcttcaggggaaaattgggaaacctgcatacatgaaaagggaggagtgttcttttgcctgcattggagaaatggacatcttttgtcatcatagctatatacatgccttttacaccaaatcatggcatgttctttcctgtctttcagctttatctagtactactcctaaaacacctctctctccattcccaccacgcatcctagaattctctcagctccaatggaaccacttgcacacattggttatgctgccccagttcccacctcctacttagccacaggtctcattcaaagttcaccgcctctggaaatctttccttgaaggctgcattaggtgtcttattatagtctccaaaaaacacattctgtttttcatttttagtattaatcgcacttaaaattatttttaagtatcagtctttgtcccactaaactgaaaataatgactaagtcttttatattttacaatgtaccctatccccttcacaatgcctggcacatagaggaaactctataaaatatttttaaattgacataacttttaatattctactaccactcattctaattcttggcatgtagaaacaaaaggcttagttctcacagcaggttgggacaaacaaaattaagttagacattttagaagcagttgttttctgaaagaacttggtatattgaatgtaaaataaaataaacctctaagttaataaagagcaagaacaaacagaatcaaccttactcaaatataaacattttcatgagtcatgcttaaaagccctctttattctgagaggcagatggaaatgttatcaaaaaattcccacacaaaatatcacatgtgacttggtaatttttcctaggcaaaagaaattgtgtcttacagactccaggatttgttttttaataaaaattatataaagagacatctcaaaagatacaaaaatgtgaaaacccaagtctttcttggctcagtgctaagagaccatcatcagacaataaggtatcaaatttgtgcagcaagttctgagagagagtgtctcaggattcatacaaagaacatttgtcccatttaagatatctcagtttactacaatgaatcaatattgagtgcaatatttttggatagcacaataaatatatcaatatcaaatttaataaaagtatgctagaactcaaaagaaatgcagagactacttaatctaagcttctagttttaggatatggaaactgtccttacagcaaacactaaatcagcaatgcatatggaacactacagagaaaaacaattatttaaataaatgagttttgactccaatctaattgtatgaacactgaaatgtatctgtgtaacatgcttatattatgttagtatatgacagataattcagtcactgaaatgtatctgtgtaacatgcttatattatgttagtatatgacagataattcagttcctaagaaactagaaatttcagttttacttttcacttaattaaacaaagtttttattattgacataatgctgttttaaagaaacgtcaaatcataattttaggattttctatagatgactttgatcccactaaattggatttcacttgagttaaaggatagaatatggggaaatatttgtaaaataaaaaagatataactatgccttacataattttattttactaaattgatttgtaccactagaaaactaatgaatgcatgggaatattggggaattacaaactttaaacagtcctgacagatatttattattcattcattattagttttctgctttaatacacatttttattattaaaagttaagaatcaacttttaatagtacagtaattatttaatattaaaagccatttgggttttacattaaccaatctcttttacagattacagattgatatatttatttattgtggtaagtactgtggggttgcaatgatgtatagtataggatctctgtttatatgtgctaactagacaaataaatatacataaaaacgactcttgccagatatcatttcatttctccactatacaaatatatggtgaaaacattttttaaacctgactctaatcaggaatatagcaaaggtaaatcttgggattctacaaatggtaggattttttgagaaatactctaattaagttttggaaaatagcaaataaatggaacaaaagtgaaaaaaaatcatatatatggagaaaaagaaagatgtttccagtttcaaaaaaaaaaaatcagttcctcacaaaagagcaagtcagatatttcttaggcatgtaccatcaggattaagtggttgattataatgaattttcactttgtacaactttgcataagcctgagtattttaaaggaaaatggaaaaatgaatgcaattttcagccctttgtttggtgcttggatataaatttcccctatcgtaatctctattatatctttgacattcttgtttgtaaccgatataacctactgagaaaaaaaagaacaaaccttcaactctgcagagtataaccacttcaacatttaaaaaatgaattgtgagaatattttcttctcttctacttactcattttgaatgaaacattgttcttgcctttttaattgttgaaaatattctgcttataatctttttcttattctctcaaaatagaaataccattgaaataatacagcttacactagcgttcagtttgaaatgataattggtaatattaacacatttgtttacagattcattgagatatgatgaacaataaaccactcatatttaaagtatacagtttgataaattttcacacatatatgcattggtgaaaccatcaccactgacaagataatgaacattaaggccaggcacggtggctcacgcctgtaacctcaggtctttgggaagctgaggctggaggatcacttgagcccaagagttcgagaccagcctgggcaatgtggtgaaactccatctctataaaaaatacaaaaattagccatgcatggtggcacgtgcctgttgtcccagctactcgggaggctgaggtaggaggattacttgaggatcacttgagagagtgcagtgagctgagattgtgccactgcactccaacctgggtgacagaggcatatcctgtgaaaaaaaaaaaaaaaaaaaaaggaactaatgtgtctatcacccagtaaaagtttctccagcctgttgctaatctatcccttccttcatccaagtgcccagaaaacataatctgctttcagtcactatagattttgttagcattttctagaattttaaataaataacatccttctctttttcatctggcttattttactcagcatattgatattgattttcattcatgttgcatgtgttaagagtattttcttttttattgatgagtagtattctattgtgtagacatccccaatttttgttatatactcacctataaatggacatttggattgtttccagtttgtagaaattttaaaaaatctactatgtatattctcatacaagtctttatatggacaattgatttcatttctcttgggaaaatgtctaagagtaaaaaggctgggttgtgaggtagacatatgtttaagaaattgccaagctgttttccaaaatggttataccatttttatcttccttctaacagtgtatgagagttccagttattccgcttccttgccaagccaacattttttaatcttcaccactctagtgggtatgtagtagtatctctttgtagttgtaatttacattaccttaataacaatgatgttgaacattttttcatacactttctagccatctgtatctcttctttgtgaagtgtttcatcaactcttttactgattttaaattggtttgtttgctttattctgaatacaggtcctttattaaatatgtttctgcaaatattcttatccagcctgtgatttgaaattcatttgcttaacagtgacttttgatgatcaaatacttttaattttgatgaagtccaatttatcaatttttttaatatcttagttttctcctttactattataaaattccatagcctgagcagcttatgtgacaaaaatttatttctcacaatctggaggctgtgaattccaagatcagggtgccagaatagttgggttctggtgagggctctttttctggcttgcagatggttcgtttctagctgtatccacacatggtgaagagagacagagtggtctctggttcatataagggcactaatctcatcaagaaggactcattcttatgatctcatctaaacctaattctttcccaaaggcctcatctctagacaccatcatatatgggggttagaggttcaacatataaatttgggaggaatataaatattcagctcataacagatagcatgcttttggtcccctaagataatttttcctaagctaaggtaactaggcttttcttctatgttttattccaaaagttgtatagctttagctcttaaacttaggtctataatacattgcaagttgattattgtatattgcatgagttaacagttaattttttttgaatgtggctatacatctgtttctgcaccatttaaaaaatatgtatcttttctgattcaaatctctagcttctttgttgaaaatcaattggccataatatgtgggtctatttctgaactattcataacaaaaatcttaagggtgaaaaaatcatttaaaacatttatagaaagtttacagaaaacatttactacacaatatggtttgagtgatgagaaacaattgtttctttctgccattatcaatcatataaggacaaaggaattgatgctacttctgaaacacgttaatttttctcatgatttgagaacaaaactgaatgggaatacaacttactgtgtgtatataaatatgtaaacatatttatattgctaatatattaatttaatatattacatattaaattaatatattaattaaatatattaatttatatactatataaatattatatataaatatataatatacaaaatggcattaagacacaggtgctaagataaagaaatttgctcatgatgaatatatactggtagcagaaggtaatcctcatatttctatgtttcctttgctgaaaaaaaaagagcatagtgaacattaattaactcacatataactgttccttcctgtgggtacacattttttcttgggcccatctgcactgtatttccatgttaacatatttttaaaataaagaaagacatgtatctgaaagcattgaactatagtatagactatttcttcttactgttgttaaaataaaaacttgcagcaaattaaaattaacaaagtttaactgagcaaagaatgattcgcaaatctggaagctcccaaaacaaacaaacaaaaaaaggtttgcagagacttcagcactcctgcatagtcaaagatttatggacagaaaaaggaaagtgatgcacagaaaatggaagtgaggtacggaaatagctggattggttacagcatgactgtaataaaaccttatttgaacgtggtttgaatagttggctgcctttgattggccagaactcagtgattggtaaaagaagaagtcacatcctgtttactcattcaggtaagttatggttcactgtgtatggagaaacctttaagctgaacttaaaatatgtataaagaggaagatttagactaaacttaatttaacactgtgttgaaataattaaacaaagacataacaaatgtgtttatcagggttcatttagttgagaggctaatttagtgacagaaactgaactcaccatgtcttaaaaaagaagtttatagcctcacacaattgaaagaccaagttcctttcaggaactgctaaatttaggagttccaattatgtccacaatgctatgtctttctttctattcattggttctgccatgcctctatcagcaagttattaatattaaaaaaaagttataccagtatcaccaagtgaaatcacccttagaatttaccaccttagaaaaaatattttcttttacccagaaactatatcaattgccccagatgctggactgataaacttttttttttttttttttttttttttgagatggagtctcactgtgtagcccaggttagagggcagcggcgcggtctcgtctcactgcatcctccaccttcccaggttcaagcaattcttctgcctcagcctctggagtagttgggatcacaggcacgcaccaccacgccctgctaatttttgtatttttagtagagatagggtttcaccatgttggccaggctggtctcgaactcctgacttcagatgatccacccacctcggcctcccaaagtgctgggattataggtatgagccactgcgtccagcctggactgataacctttcaaagggaattctgattagtttggcccaaacctgtagagctgtacagaattaggagaaataaggtttatcagagtctagaatagttcagtcactagtacaaaaagaaagaactgccagtcagggataaaagcagatgcagtcaaagagagaaagagaaaaaaattacccccttgaaattaacgtacccataagtaaaatatcggtatgctatatctttattatttttttcaaagaaacttttgttaaaaaagaaaatgtacatgaaatgtccatatatttgaaaattattgtgtatgacctggaaatttttctaacaaaatataagtgaccagcattaattgaagaagagatctgaagagatttatagtcaaaggaacaaaaattaaatttgttaaatatttacttttaagtaaaaacgtccagatagttttatggctagggtctttcttactctaaaaaacatgtaacttttatgtttgttattcatactattccaagtcactgacaaatttcctgactcattctttaatactaccatattctaaaactcaaattttataaaaccaacacaaaaagaaactctaattcaaattcacaaatataattattttagtcaaactgttagcaaattgatcccagggtgtactaagggattggtcatcatgttcaaggttttattacagaaatgaaagtttgtcccagtactggaaaaaaaaactatgaatacagttaaaggagagacataattaaatacatgattgtgtcaatggatacagaaaaatgtttgactagaagttagatgaaatgtatttgaactctctgcagttggtaaagattcttttccacatacccttgtcaaatatattaaatgttcaaatataaattcactgccatccaaagaagaataagacagaaatgctagctctcatcactataatttaatggaattttgaggggtccaatcttctcctacaatagacctctggcaaaaattataagattgaggatgaagacaaatatgctgaggatggtagagggaattcaagaacgcacctgagtctcagataaaaataacattggtgtataccctctagacatgtcatgtggcaacagtaaacacatgtttgtttaagccacaattagttgggttttctgtaatatgccaatacatgtcttcctaattattacaatgcctaatcatgaaataattaaaattaacaaaagcattaaatactgtggccaaataccacacaagtatacaaaaatcaaaaatttttctttataaaagtaataatcagttagcattcctaaataattcaagtcttaagaaataccaagtaactatatgaaaataaaaaaaaatgcacacatctcctatgtgaaatcagatggtttttgtctgtgtgtgtggttgtgcatgtgcacgtgcatgcctatgttttattttgatgtgtacctgatgagctaaggggagctcagtaatttaactcagtcttttggtgttctcctgctcttcacactgattagggtttccagcttttcctaaaaatctctcaaaatcacttaggatataatattgcataatggaaaaaagaatgaagtcagtaaactcagagttgcaactatattctgcaatatgattatgattaaccattcatgttcattcatttattcaggcatcccacaaatatttgttgtttgctttctgtatgttaggcatcaggctagattctgggaatacagcaataaacaaagcagaccaaacttcctatcatcatggtgcttaaatcctagtcagttttctcatctgtaaaaatgagtaataattcttacctcttatcgttctaatcagatttaatgagttaatgtaggcaaaataattggaatatgcaaggctcttcataactgttaattattgctctaatgttccttaagctaagacaaagttgaaaatatatccaaaaagtagctcaatgttaatggatgttaatgtgtccattgaaaagaactctctttttttcttgcattctgattaatacgcatttggaataatgaccctataaaaacaacaaaacaaaactaatgtttctaagggaaatggggcaaggtggacagctaggttatacttccttttcagcaagacatttagttcacatcttaaataatagttttggcaaacaaaaaaaatctcctgtgaatcagaatggccacgactttgttacatctacaaggatgttactgatttttaaaagttaggaatatcattaactacccaagaggttggtggcattttattcatttatgctatggtatacagtaatcagcacactgtcatgaacagaaacacgaaatgaatcctagttgaataaaaattaactaaatttagaattaaggactgttttcttgatttgcaacatttgttgctttttatgttttaaaatagacattttccaaactccatagaaaaaagcattcatagttccacagatttaaagcagaagttctaaagttaatgacaacttaatcaggtaattatgtactattttacattcatacataaatttttgttcctctctcaatagtacagtcttagaacagtcattttcaaactatatgttttggagtcctaaggttcttcctacatttggagggaatgagaagcaatcagatcaactgaaggtaccaagtcttcttcccatccttgttctaccagagaagcccagcttttaatcttttttctattttgagtttctaacagaaaacgtcatttgaaattatatttcctttaaaataaagtttcaaaaacactctcttaattagtaaaacacaatttaggaataaaactatatcacaaaaaacaaggactaaattacacattttagtcactatgtttaaaatgttaaaaatttgagacaaactactcaataaatagatatatttaatttagaggacatgtacatttaatactgtctcatgcaaaatctacagattacaaaaccagaagatatctttagacaaatctggaaaggtttttagcaggtgttccatttagaaccaacacactactcaacaaagagcatggtaattatgaaaattatttttagtaggtgaacttgctaaaactatgtgcacatcaaaatttgtaacttctcaacgtgaaccctacttcaactatgagctcaggttttaaattatgtagaatgcaaaaacatgattttcacagtacaaaaaaaatcctggtaaactaaacttttgaggacatattttgcttagtattacctaatttatataggcctaatataaatacctaatttatataggttcatttattcagtttaattgaacaaataattattagctacctataatgatggcatggatattgctagcagaaatacaaagacaagtaagatatattttctatttagttatataatacatatgattcacggtttataaaatagaggaagtggtcttctgtgatgggtagagctaacgaagtcttcatagaagagtaaatatttgaactttgccttgaaggatgagcgagaaggtgctaagttaaaattaaaaacagtgattcaggtagatttactgaatgtccaaagaagcagagttgtgaaacaacttgcagggttcagagagttatggataatttggtaaaattagagtttatggaaaaagaaaattagatggagaaagctggaggaaatgatgtatggagattttttattttatctctagggataaaaaaacagaattttgagcatgagagtaatatgatcatcattctgatgctggaagattatcattagtaatgtgcagcaggttggactgggagagacacttccagtctaaggaaaaggagggagaaaaagtagggcattattcatttagaatgtcctgggttggtttcaaatatatcatctctgtgaattgtttaattactattgttgaaaactgagcagacggagaacaatataatgtttaattgtgctgctctacaatgtacttccagctcttgaaccgcagcagaggggagaactgtgtaaatatcgatagaactccctgttgctccaacctattcatgagttttaataaatgtttcttgttcaagcattatcattaataattcatacagtttctaatgtttaaatcactatagattttctgacaggtaaccttcgtaagatggagaaaataacagaaacacaggaatataagaatgccaggtttccttagccatttagagggagaaggggaagaaacagaaaaagatacatttcaagaagtatgacgaggtgagaggatctgtactccaaatcagcattacacaatatttccaagtaacaaatgtgcacacagaccccctgcatgtaaaatacaagttgccggaaaaaaaagacagataaatacatgtaacataagccaattgttctttaaattttgtaaccttgttttatttactggggatagaggtggattttaaattgaggaggaatatattaaaactataatcaagctaacctttttaataaactggcatttacatagatttcttgaactattcaaattaatacagtaccaaatttagtcacacaaaaaaaaacacagaatgaatgtgttctgtctctctgacaacatcatgcattcattttcatgtgtccagaatcaaaagcatgacagtgtttgtaagagaaaattctaattgaaaattattatgcaagtaaaagaatttttcacagtaattatttaattggtaagatagaaaataataatttttaccacaatagtaatgataattcaagcaacataacattctgatgatctcttgtatatttttgtttttaaaaaatagatttttaattgagcttattagtaattttttcagtcagaattgcaaatttgcatttctaatatgcacattgtgtgtatgtattggttttaatcaaggtccaacatgtgtggaagatatctatgacctcacatgcttgcatctatttctgataaatgaaactagaataaaatattttgttaaacacacatagttaatcattgatctgtatctttactgacactgggatgggcaaaagcaatttcacaaatttgtgagctatatttatatgtttgatagattacaaaaaaagatttgtacattggaatatttagggatttcagacctttactgttatatttaagtatttaataattagtagaatctttgccaggaaaattacttaaagtacataaaatcacatgtctattttggggaaggctaggagtctacagtgattgaaacacaaggatagtataatatactgggagaaagatgaggtatgcaaaatagacacattttaaaggaaaaactcattttatttaaagataagtgtaattaacatttgtagttaaattaaggaggaaatgatctttgttgaaatgtagcatgtgttctgcaaaacttttaattttgtagatgcaattaaacgtgaatttaaaaatattctctggtggtattaagataacatttcctatgtagaaattaatcattacctttgtagttaaccttgaaaccaacagatccaacactttcgtccgtttgaaggtgcagccacatttggctactcatgctcactatcaagtctggtacaaagcttccagtcagcctaaaaagagatggacaaagaagggagagatgggttattaaaacatcctctgcatacaaattataagacagatgtgtttctcaatactttctttgctagaaaaaaaagtcagataaacatagaggagtatgtgttgatgtgacagaagaaaaaactacacaatttagtgatcaaggttattataaaaatattattctgtgtttaactaggaaagatctttcatgttcctgaggcaaggtcatgatattttagaccatcaaaaactcctacacagtacttgtcttttgaactgaaaagaaaaggaggatctatacaaatattcaagtatttttaacaccacaaatatatcttaacattcccagtttcacagaactttgttctagagaaatattgttaaaatatttctgtgcaaaacaataaagtggccaagagtataaccgaaccctttgcaatactgatgtcgaatacacaagccttaaaatatagtacctacattataggctgcccatgtcacatatgtttttctgtaaatagttttatttaaagaaatatgctgcaaatctgatgcagcataactgtatccattcattactaatccctcattcagtaatgcacagttttgtaaccataagaagggaaattacttcacgttttgtctatcatcaatgatattgtaattgcatattagaactgaagccaaaggtcattagaaggatgaaagcaaattagtaaataagaccttaggttgcggggaagtccatcaagaataggaaagaggaaaaaatggattcactgcagagtaaatgtccacattgataagagattctaaattatatacagaaagacaggtttccaaaggaagaaaatactgaatgtttgcctactttattgctaaaaccataaggattgctggaaaattacatcaggaaagtataaagtttcctttcattgtaaaaacctacgagagtgtttagtctcttaaatagtggctctactatgaatacaccagcagagggcagtgtagttgaccatatcctggaagtgactatggcagcaaaatgccctgtgcgtagtcaactattaaaacaaacctcatttgcagtacaagtatctaaccagtggccagtgttacaggatttatgggaatttgtcacaaagaaacttggtaaactactattatttaattatgggattatatattacactgaagaacaccataagataccaagataccataatgcatcatggaacttcagattatcttcatttccttcttcctgccaaaaaccattttaaattaccataatataaaacaaactcacacatatatattgtctatatatacacataatcatttgaaacatcttttaattaaattttggggcatgtgaactttcaaattggtgattcttaggtagcagttttttgagctactgtagagaggcaggtgcaggtttatgggaaagggtaaacactccagcttggaggcagaatagaaagtaaagtaaacccattattaaacgggaatgagagcttatatttacatagcatgtacatcagctataccatatcaaacataccagcaaactacctcaaagagaatactaagagttgtttttctgggaaaattgaagtattgctcttttttacatcctcctataacattcataatcctgaactgttctattatcctgaaacttctagaatggtattttgtcagttcatgaagaacaactaacacttgcaagctaaattgttcccttactaacttatcctattgccctgatttcacctagttcccaactcattgctggtgtaagggtatatgtcatctaaaaataataataaaatatatatatttttaaattttctgatgtcaaaaattaaaactcccctcaacttctctttagcatttcttttagaaaacttgaaattataagttccatttattttagatgtatcaaaatattttaatagttaaatgagacttttgccagtttttcattcctggaatttctctcttggtggccttggagccacctctttaaactgtgaacatcaaagaggatgatgccctgtctctacttttctggggagttaaagcctaggtacttagtacttagctctttgatttaacttcctgcttgtcataatgataggaaatgttttattttttgttttgatgaaggcaattaacatgtatgcaatggattgtatattcctagctatatattatttctcttttttgcaatctccttagcagatttcctatgatgcacatcacagtttggtttaatcctattcaacagaaaaactgtttcatttttccctccattttatggagagcttttactgagctggcaaaagattttatttttaatcacatttccccaactacttggtaaagaggattgggatatgaacggtagttttgaattgagtagaccccacagcagccatattataattataattataaaagttctcccttcttgatctttgcttttttgaaatagtatctggatagaccactctctccaaactcaaattttattaatttaaaatttattaatttaaatttaaaattttaaattttattaatgagtatgcatgggtaatctggactcaaatcccatcaggattacaattaactttgatggtggaaaaataggggaagccaaggatattgcctgcaattctttctcctaaacagctaatatctctgtcatatttggaatacatacaagtaccaaacctttcagaatttgttatgattctttgacctcatccccagcaaatgaactgctggcatttattggatacatattattcttggtggaaacttaaaaagatctgcataactagaaggaaagattgagaagaatggaagaggaaatggataaattaaaggcactttcattgattcttcttcctttttctgctatctctgctctttctgcatcccttgtgtctctttatccttctctgccttagtagactcctgagaagatcaaagcaatggtgttttagacctccagttctcctagttagtgtatttccctacaaaggacaaggccacaacttctttcgctgataatgaattatctgccttgtttgaggaaacagatttgtgtgcctcatgccctaaccctgagcctactcaatgttttagcacatactgtgcccccaaaagtcacttatcatttatatttcatgtatttaggaaagcagaaattatgaaggaacgtgcttggggaataattgggaacttgtataaaagactgtccccacatgaagacaaaaagatgtagagtggtctcacttgctatttggaaaaaaaatagtcttagtctaataaacagtaacatggaaaataagccaaaaagtcatataattctacatttatcttgtcacaatgtgagaaagaccagctcttatttgatcaccagtgaagctgatgccattgagaagttatacagacctccttgccagctgatatatctcaaataaaagcttcttttccctgcttcccagaagtttgcaggcatcctctgcagcatgttttcagtttacagtcccgggcatggagatttgcacaggatacagtgtggagttctgcaatcagcagactccactcatgtgatggaacaagcacactggggaccagaagatcacccattgaaccaagaggtagataactgttcatcaccctccacaaataagggataactaagagatttggagactcactgaaagtaactccttgtagctgtactcgaaatctttcctctaaaagtgagctgcgtgaaactgcaatggtgtatccgaaagacaagggagtctgccattgatttccattagcagtttgttgaggctttctcagaatctaccggtatggatccaagggtagttcaaaatttttgtctcaggtcctttgatgactatccaaattcaaattagaggaagggtattaggatggcaaggacagattcaaatgttagcagcagttacttagttttgggacaatctagagaaatgtgaagaagaaaataaattaaaaaaaaaactgatatgttaattatccagtaagaactatttagtaaaaggcataacccctattctggccagcctgtagagtgagcaaagaaagaaaacaaaaccatatgccatactgcgagaagccagatgttggaggcgggactggagaaaagagaatccagaggatacagcaactgcagaaataagggaatcaggaaagcccagaaggctgggaaataatttgggaatgacctaaaactgacagattgaggggatctcagatgtgggaactgatgatacgtacatttcaataactttctctcatgctaactcattgcatttattttattttattttattttattttttttgagatgaagtctcgctctgtcactaggctggagtgcattggcgcgatctcggctcactgcaacctccaactcccgggttcaagcaattatcctgcctcagcctcctaagcagctgggactacaggtgtgcaccaccacacccagctaatttttgtatttttagtagagacggggtttcaccacgttgaccaggatggtctgagtctcttgacctcgtgatctgcccgcctcagcctcccaaagtgctgggattccaggtgtgcattttctagtagttgctggtgctacttattctgtgatttccccagaaaagtcttactttccatctggtgttaatgaacacacgttgttggtattttgagttagccttctacttgctctttttcttctgcagttcccacacaaatagggcctcatattgggaataggttttcttagttttctcctgatcctcctgtaaacctattgcagggagacctgctgggaaaattaaagactaccatattctatattccatagggagtgtctgtggaactccctggaataaaaggaatctgattactgtgtaccttctgaaagaaaaggggtattccgaaaagcagctttctcacactgtgctggataagtgccctgaactgaaacaagtcaattcatcactttgggccctagcaagtggtttagtttgaggtgtagaatcaatagaaattctttacaaaaaacataagcaatggccatggtcaaacaataccctttgtcaaaggctctactagaagaaataaacacagttaaaaaaattcaaagacaagtggtaattttataaagacactcaccctgtaatattaatactgccatacttccagaaaggaaagaaggtaaatgtgataaagatgattgacctgtgtacaagatcttaaagaagaaaataaatttattgctccattcacgcctttagtttctaacatcagaaactttagtactttgctaccatcctctgcaaagttttttctccgatttatctatgatctgttttttctcattgctctagtaaacaagtttacatttctgttgctgtttgctgttttacttagaaaggagttcagtatttatgaaaaagtattcaaggatttcctgactctccttccatttctctaatcatttacagaaaaaacttaaagaaatttgtcccagtgggggatctgtaagtcatcagcatgttgatggtttgctggtaggctcagaaactaaagagcaataaaaaactgacacttcagctttgttacaactcccccttcacaagggcataagccttcaatagacaaattgcaaaattgccaaactgagataaaatatttagagcatctgttgatgctgaaggcattatgtaggccttaaaaaaaaaaactattttgaggactagtagaatattgtggacagtgaatttcagttttgtaaagtggccaaaactctaatgaaataactgtgtaataattcctcggatccttttatttggtcagtagaatctgaagaagtgttccaattaaaattggctatagtataagctttgggagttccaaattttgcaaagactttccacttgctttgctatgaaaataaagcggctacttttggaattttaactcaaaagttgggaatagatgacacattaataacaaatttctcagtttccttggaggtagtggcactgttgatgacaagattctgtggaagtagcatataaactttttaaaaggctcaagcccttacctgcagtcacttatatgcgcgtcccacatgctgtgacagctatcttacaagtgcaaaaaatccagaatgtgtgggtatgccaacagactagttaagaacaagcattgatcccagtattgtgcttaggagatgcaatatcctaaatcatgttactcttttaccagatcctgatcaaatagatgatcatgattgtattacaggggtaagagaagacactaagctctgatgaatttatctgatattcttgtctgtaatgaggcagagaaaggatggggcctcgcttcagctcacctccactagaacatcctttcttgcattcccccgatcacaaacctataccactacttcactgataacatacctgttagtagtcatacaaggaaaaaagccattctatgttcttcttctgtgctctcataatgtgtaaccatgccgtttgtttaaataattccagaaactggccttaggagattcgaaatcaaaccaagtttgcagtttcccaccttgggaaggaatgctgcacaattgatttacagccctgttgcctctggccagaccaccaggtggcccactgctcaagataaccatcacaataagatatgctgacccatgtactctaccacttatgtgctgtgcacagaacagtctgtgtaccttacccctgatgtcaattcccatgagttacctagtaaagaaaatccctactggctttttttggagagccagctggaggacccttgtgactctgccgtctccctagtgcttaagcacaagccctgaaataaataccttgtctgggaaatctgctgggcctcatgttaatttccattacatagggagccaaagagcctgtggtttttagcaatgacaatttaataatatttactggtggacatgtacttgggataaaaatggccctatttaaggttttgtatgctatgatgacctcttatacgacattttgaaagcttatgctttgcctagaattaagctgacacaagcagcacagttaatagaagttactggagttgcaattcttgataggtaggtaggtaggtaggtaggtaggtaggtaggtaggtaggtaggtaggaaatacatgtttggtgtccatcaaataggagagcaaatttggagaaatagaagcttctcaactttgaggggaagtaaaatatctcatggaaaactgatagctgattttttagaagctgtacaactgtcctgtcagatcagtaaccatttgtagagctcacatagagcagaatgacacaatttttaatgcaactattttgctgacagagctgcaaaagcaactgttaaaatgtaacagattgtaaacttggaagcctcacttttaatacaagaaacttttgttaattttcaaaaatatgcttcacaaaaggaaactgatgaatgaattataaaggaggataaaacatttgactgaactatgaaaattacctaataaagtaacccctataccatacttattattcatttgattaatagtgtgtcattgacatactcatctaagtaaaatggggactttaaagaccccagactattactgtacttacataaaaataaaattattccaaaaatattaaagagatgagctgtttgtcagaagaattatttacagtctattcctaaggtacatgtggcagttttccccaaccagctttcccagaaattaagtggcagttggatttcatagaattaatgtctacaaaaagtaagatattttgtctagttatagtatatatgatgtttggatggtctgaagtctttccgtctttaaatgtgaatgtgcaagcccggtaaagtatcttttaatacccatgatttccactttggggctacagaagcataatgaatcagagaaaggaagtcatcttattgtgatatcctaccttgttttaactggaattgcctctcccttagctgagagagccggacagactccattttggttccttcacttgcagccccttacccacccccacttttcttcaaggacttaacttgtgcaagctgactcccagcccatcaaagaatgtaattactgataagatactgtggcaagctatatccacagtttccaggaatttgcccagtcgatagtaccctaagcccccgcatttgtgtccggttgatagcacccaaagccccgcgtctatcaccttgcgatggatttaaagcccctgcacctggaactgtttgttttcctgtaaccatttatctttttaaccttcttttgcctgttttacttctgtaagattgcttcagctaggctccccctcccctttctaaaccaaagtataacagaaaatctagccccttcttcgaggccaagagaattttgagcgctagccgtctctcggtcgccagcaataaaaggactcctgaattagtctcagagtgtggcgtttctctacaactcgctcggttacaacattattatcactgtcacctagtaattatgcaattatttatagatttctataagatgaatggaactcatttgctgagattaggcaatatactggataaaaatggcctagcattttactgttagcattgtcaaaaattagaatgacatctgcaaacaagcgtgatatttttcccctttgaactaatggttgccagacctatgaaattcagtcagaaaccatgtcctgtgcccaatttaactgaattctctcttaatcatgttcatacttcaaggtgcttctttctttcctagaatccctaagacacaaaaccataaggacctggaaggacctgttgaaagaaatttgccaccctattgaccaggagattcgatttatctgaaagtattccagaggtaagattagctgatcctgtgctagaaggatcaagtgctcttgatgatccacatggctagcaaagtgaaagaaaatctcacgcagattcatgtggagccagcacctcagaagaatttgacaatagttcctacaaaggactcaaaaaaattttctagataagtaattttggctctgaactcaactgaaagaagaaattctagtgagcttatgctcatagactgctttgttgtcctattcacagtaacattatttcaattactttaagaaccacattttattaaaaaaatgttatttgttacactactttttctttgtgtactcctggtaataatagttcccacaatcacttatttccaaacagctaggaattggactcccagtgattaagatgggcttaatgttccagtcaccctaactaaactttagaaaattttaggtgggtttctttctgactacaggttcctgacctactgtttcttaaagcatttaagttaaaaaaaaacttgcaattataaatccattctctacccctttggatgtaaatattcaacaaagaatatctttctcaagaacctccaagccattcctttgaaatgtaatcattgaaggaggtagcacctgtctcccagtctctatgggaggataggagcttaacttcaacaagaaacaattgaaacgcagatggtctgtatacattgactaatctctcatctaaagctttccagtgattttccactaactcactccactgcttaaaaaccctcccactttttgtttcagcagagttgagttcagtctctctcccctactgcaatagttttaggaaaagtcttgtttgtttgacttgtctggtgcaatttttcttttacacaagaataggtatgatctgcttataagttcaacagtccaattattggcagagtaaaagtgagaccatcttcttactaattttttaataatcccaaagtaaaagtaactaatatgtgtctaaatattaatccataaatttcacacatacaggcacacacaattttttaactgatttaaatggaaggataatttagaatgaaaaacatctaattaacagacaaatctgacgtttataggtaagactgcaaatgataagtctaatataagttaattagctttgggacacaagtctctccagtccaaatatcaatatagaaacaaaagtaaatgtctattatttgcagagatttaattgactgttattataattaaattattgatttgggcttatgtgaaacctataggctttttccacaagaattgtaacaattaaagtcatgtatattaaatactggaagttcaatctgtacccttaagaggtgcctcataaggatactagaaaatggttgtgttttccatctccaaaaaaattggaaaaatgaaataaatgctaaaagtcctagattatcttataaatgtaatattacttacgtgattgatgaaaactctgaataagtattttggccctccaaaaaatattttatttaaaaatttagatatttgagttctagggttaagttacaccttaggcttggtttagtaagatgtcatgaggatctacaaaaataatattcaaatagataattatttgaaagtataagcaatgtagataccacaacagtttataaaattaatggatgatggagaatttttgttcatggctaatcaagaatctgcttgaactattcactattggttcacttaaatatttaaaggttattccttcaaggctaataatacaataaatttataaattaattcaattatatttctgataattaccttgctttgtattttacattggatttgctatatattttgataactgcaaactgcccagagaagagtagaaacagcaatacacataatttaataattatcgtgttataaaatagtaacaaaaaagaaaacttctaagtataaatgcaaatctttaaaaaaatgtaaaaattttcttgaaattataaaggtaagagaactcccccaaccccccttctctttagaatttcctatagaaaacctaaagttgtagatgctttctttttctttcagatatgtgtaaatgttttaaaagctaaagaaaacacttacaagttttacattctaagaatgtccttcttagaggccttggagctatctttttgaaataagaacatcaaggaagattgtatcctgtcttcctgtttcactgagtgttaaagcctaggcacttggctccattatgtaacttcttgattattataaagatagaagtgtatatttttcttttgataaagacaattaacatgtgtgtaatggattatatctgtcaagctatataaaaagggtgaggtttctcttttttgaaatctcctctacagattgcctctgatgcagatcacaatctggcttaatttttatttaacagaaaagctgtttcatttctttttacattttgtgaagcggattcattgggttggtaggtgattttattttaattatattttctcaatacttgatgtctcactgaaaaccctgctctttgtataaaacctcaatggccagttcttctcagctccctctcaaacaccttggtttagattcaaatggtagaaaccttcaaccctgacagtaaaggatgctgtgggctacagaggaaagagtcatattcttgtaagactctcaaatgagtctttaaatagctgtgttacagtaagtagtcagacatgagcagggcaggaaagggcctccccacaccaggaatattaggtgatcatcaggtgatggccaggcagttattaaactgtctatctaattgatgcagccagcaggagggaaaggcagtctcccaatagatagaaacacctgaaactggtgatcaacagcttcctgataagatctcaggagttgggtgagtgggcttaaacatgtatgctaagaggtaaaacattggagtttaactgtaacacttgactggtaagaggaaaaatgcctcaagtacacaagcatagaacttcagtaaacacactgggcatgtggcccatcccaagtgctggcaggccactgtgcatgcagacagcccaccccaaggaaaacctggggagaagagatgcaaaccccctggaagcatgccaacatataaaacccaaagtcaaaggtcaaaacacacacttaaatctttcaagtagcctgcttggcccttttccaaatgtacttcacttcctttcattcctgcccttaaagtttttaataaactcacttctgctctaaaatttgcctcggtctctcactctgctttatgcctctctgttgaattatttcttctgaggaggcaagaattgagctgctgcagtcccgaacagatttgctgccacagacagttgtatcaatatttaatacatctttttgaatgtattatttgttaatttaaaaaatgcttctttaatacatgtttatttacaggctgagtaacttcagtgttcatagttcattctagtcttcctagtcagtcacttcctgctaaaatgagataaagtcctaaataggtgcgctcaaaaatatttttcaagaattgaaatagtatataaaataaagaacataatctattacacttttattagccttgtgcagatgaaaggccttagcccacttcaaaagttcattgaaaaatcaactcacaataaggcagattaataagagaaaatgttgtagaaaaaaacgagttcttgtcacacgaccaggaaagattgggctcatagagacatctaagtgttaacgcctaaggttcttgcctagccacgccaaagaattggtgtggcggctgaccacagtgagtgatagagacatggaccaagagagagaaaaagctgtaggctttattgagcagagtgaaagtacaaagctcccacagcatggaaggggtcccaaacgaatgggtagccagagttagattatgtgattgccttttaaactctttaaggcaggaaatacgtggggcaatatgttaccagagtgaaaaacaaaggcaattaaccatttgtgatatgtcttagatcttgaggaaaaccggaattgcaacttaggttttatctactttatggcaacagcatggcaaaagagataggattgtacaggactttacaaagtatgttcacaaggaattcaaattgggaggatagataaggcccactggtcacaggaaaacgggcagttaacattacttttaactttagttttgcgggagggggaagggagagagggagagaaggatacagggaaacttacagcaaaattttcgctgtttatagctttcttggggaagaaaatacatgcacaaatcctggtgttaggaatattttaagcatttatcttcaatagtgttcattcaggaccaaagtaagtcctgatgcaggaaatgagtgagtttcacagtttctgagcccctactcgacccagaaagcccagctggcacctcctcttataagggtgagtagaggaatttattgggcaaaaaggaaaaacaagtcagcaaaatgatatggagtcctgtggttcttcacctgaccaactgaatcccacgttgccatcctgggacaggaaaggccaggctccaccccctgcaaatggtgcaaatgtcccaaggcttcgccccgtcctcccagtgcacaagccagttggaaatgctttggggaacttcccccttatctgcctcttgcacttatcaaataggcatacacatttatttaactgtgagcacaaggagaatcacagagtgattgcctgatgtcgaagtgagttccagaagtttatatatcatcttgaggttacagaaagaatggggacttggatcctggcaaaacaggttaggggacagagagaagaggaaattgattcaggggcaataagtaatcactagggagaatgattgaatagaggaacagaagttaaaataacttgtaaatagttctttttggaatttaaatgatctttggagacagtcattgtattgaaaaagggtgtgttcaggtgtgcttacattcctggtcttctctcttataatgtttaataaaataacagggagggaaacaagaacaattgttctccttagtgggtcagtcttatctttatgtagatatagggaaaagtctcttccagcacttgatctctaaggccatttaattcaaaatgctcattatggctgggtgcagtggctcatgcctgtaatcccagcactttgggagaccgaggtgagtggatcacctgaagacagcagttcgagaccagcctggccaacatggcaaaaccccatctctactaaaaacagaaaaattagtccagcatggtggtgtgtgcttgtaatcccagctactggggggctgaggcaggaggattgcttgaacctggaaggtggaggttgcagtgtgctgagatcataccactgcattccagcctgggcaacagagcaagactccatctcaaaaaaaaaaaaaaatttttttttcattataccaagggagccctattttggggtgaaatttcctgcattccttaagacctattgcctgactttctataatcactcaaggcctttggatgcatccattagacatgagaattgtagtcctatgttctaacatattttttgtattatacaaatatgcaactttcgctttttatgaaaaatgcatttaatatttttccttctagtacaatgttataaaaagtaatgtatatgtttatttgaagtacacgaaattcactaaaatgacgatgattagaaaagttaagttaaaaaaaaaaagaaaaaaccctaacacatcacagtagagtgacagttcagaatgtgggccaatgcagtggaagaataatgtatggtttttaaaatcaaaatgtataaagcattatggaataatgggacaatataaatgttagttcacttagctgagttgtcaataattgttgttttaactttatttagggacataggattcagaagttttaatttattggctaattcaaaagcataataaggtaggataatgtttgtcatgggtcttattacttttacaaatagatttctatattgagttttatttttagaaaactgaatttgaaggccaaatctttagcatacacatctttgtattcaaagttggaatatggatacttcattgtatatatttaagactccaatcaggtcttgcttataacactcattatttgtgggaagaaatccagcttgtttatatattctttctatattttcccctaatttcttcttctacagccacctttgaaatgcctgctacagtgcaaatattcctgagaacaaaaggaaaaacaactaaaaattactttagttcattttaaacaattcaatgtattcaaaaacaaatacatatataaaacaaatgcaagcaaaacagaagtaaacccttttttcagggaaatcatcagttttttaacattagacatatgtagcaaaaatcacaatgaaaaaataatgatgaaccacacagaataaattattccatatatttagtcatttgttgccaataaacaaaatgacaaagattatttttgtattgtggtctaaagtaattctgcgttccaagagcatatatttattattgccctatagcagatcatatggataactacatgtgaaatctcatccacatgatgagaaaactgctcccatcagtttggttgattttcctggaagtggtatcaatgagtgctaaaatccctaggtgggactacagagctctacagctcatggcatatctacagctcatgactaatatttacaaagataccctttctgttgacatgtctcagcagatgtgtcttggagtagaatatttttccctcttcctttataattgctgttaacacctaacaatagtaacacaaggctttctgtaaggaattcaggaaaatctgagatgaatagaagatgattgctgccctcaagggatgagtgtgtatgtttgtaagtatgcatagtgaaagaggaaagcgagggtgcaagatagagaaaacggcagtaagaaaacatttatttttcttgtcttaataattataacacaaggggctaagaatttgtctgactggtcaattctccaagcccttttcataccgtggcaattaatctctaaaaaatatcacctttcgccatatttagtatatgctcttctttcattagcccatggtctttgtcggtatttgttgaagtcaaaagcaaagttaggaaagtataactccttggatgcagaagaatttgttcaaggcaaatatcatgtttactagtatgttgccaaaaggagtagggcctagattttaaaaaagaatgttgctgaatagtaaaaacaatagtatatatctgacaaaatatagggctcaacaaactaagagcaatgatagtcatctatttacaagcctaacagaaaacagaactatcttttccataaagctagtaagaatattatttattaaaatactattaaattcaataaataaaaaatttatttataaattattatattaacccagaagtgtgtgtgtgtttaaaattaaaaggagaataatcaggaaaaagtgttgttagcctaaactaacatatttctgagaatgagatttgacattgtactaacttatcctggagaattcagaattccaaagtgatagaatgaagaaggtttagatatccatacaagcattttttaccttctttaagatgtttgctcaattcgatgtcatccaacgttagtgcatactcacaaaattttcagaggtgtcttaatagaagatattttaaacttttatgttgcttgttttcatttagttcttacagtgttaccatgaatctaatgagtctaatagtgacacatgcaaaagaaaatgcagaaaaatgaaggagtatcacatatctggtagaattaatgtctcaccctcttggtctgctgtatgcagatgaaaagggtagactaataatcaacatctcctggagagctggaagtaatctcaaggccagtaattgcattaccatcactattagttctctccaataaattatatacatttccactatcagatgaatttatacgtaagtgtaaaaatagcacatgggaaagaatctgtgaaacaaagttcttttgatatcctttaaaagattaaaatattattgttcaaatcctttatctgaattattatcaaatgtcaagttcatattctgatctctattgacttttgtcactagacgactctgaagttgccaggaataaatgctatttcaaactttgggaaaaaacatcctccaagtaactctaatggtgtgaaaatgaacacagagatacagaaagagataatagagatagagagagagagagaaaagataaaatgggccatagatatggcacaacaaatgacagatgcaataaatctctgaattgtgagtttaaatttgcagtttaaattttcatcattttagaaatttttatctatatggcaaatttagcatggcgtatgatgtccaattacaatgctttctctattgctaaataattttattggtcataactttgtaatgaatatttccttggagctaaagcctcaaggtgaaaagatatggcacatttcaattatttttaagttagcaaattacaaaaaaatttctttatacttcataaaaaaagaaattttataattaatatttttttatgctttgtaactgattttttttttgcaggagtattttagctactgaatatgttatgactttatgaactatttttttatggaatagaataagtaattgattttaccttttagaacctaaatactgaaacaaaatgaaacacaaaaagccttatatttacaatacttaattcaatactttgacggaattagaaaatgttagaatgttccataacatgttaaatatgtatcaaagtgatatattatgtgtttattaaaataattagaacataaaaattgaatataggctgaagtcatcttctaataaaagacttaaatattttgatatgagatggcttcttcttttggctatgtgttcttaccttcagctattcaatctttttaaatcaatttacttgtaaaataattttggtgccaaaattaactctctagcacatgaattaaacttaaaaagcaaaaaggaattcacagacaagtaaagagattgctgaataaaatgtctaaatgaaaactagtgttaactgttagaaaagcattatttaaaatacatttccttcagcttaggttttaaaatacatttttgaaaatttaccatgccctgtgtttagtactgttttgaaatgtgggcaagatgggccccttctctgattcttcccctgtagaaggccctcctctgacctttctctagtttaactcttgctcaggaatgtgcctgcctggctgaaatctgtgtcccttctccacctcccctttgagaccctgcagtagcttccagacaacaacatgataaatacagaaactgtgtgttacctttcaacatttctagagccatttgaaaaagtaattttatgtctggtgaatttcataatgaaaattaatgagcttgtatttattgtgttttatttcttttttttctagaaacttgttataaaattatcagttcaagagggatcagaaatcaaaatcaaatctattttactgtttgtttgcaaagcactgttctagaacacacaggtatgtggtacccggaattccctgttaccaggaccagcataggccttttttccaggtccatatcccacaagtagaacacacacctcacctgtgcatccctaggtgcaatgaaaggctgtttgcagggcgggtggaccgtttgaacatgcaggctgggctgacatgggttatgatgaatgcagctgaagttgagaggaaatgaaaggctgtttgcagggtgagtggacactttgaacatgcaggctgggttgacatgggttatgatgaatggagttgaagttgagaggagagggtggccaattggtctctgggtctggcagagggactttccaattcctccacattccagcagagaaatcatataagtcttaaaattcaggttcactcaaatttatgtcagcttctttggtgattataaatccaggtaattctgctatcacagagtcctagagttcgaaggaacttttgattcaactctaagtctgtaaaatcttttagccagtcagccagtcctattaaaacacctctaggaggtgggcccaagccaagttctgtcatatttattcctacttgaggaaaagagagttacattttcagagaagtataattttgtttctgagggagaacagaaagttttagaaacacattctctgattttgaatggaagaatacagaacaaaactagaaatcacagatttttcaaaattaatataacttctcagagtgacgacattgtacatgatgaagtatttatactttgatagactacacaaactaatgacaacatgacaacagtcatgtggaaatataaaaaaaagtaacactattttctttcattttcctaagagtagcagaagaaaactcagctatttccacttgactattcacttgggatgtaagggaatgtcccatcaacatatttgttctttttctggttttatgctgtctagctaattttggcatcaccttcttcaaaaaattagttgcggtcttatttcatttacttaattatccaatccctctagcctcatctgctacttgatctcaattatttattacataattaaattcattttaaaacatttccattcctgccctccaatatagaaggaaagaagggtatcatatgtacttaataatgagaacatttagaagtctgacaaaaccaataataaaaaatatagtagattatttgaggcacttgacatcaaatgagaatggattaaaccctatgagaagtaggtatgaacaaagtgaaaggcttggtatgcttacccagaagtgtcatttgattaagaaagaggtcaattgttaatcaattgctatatttaaaatacatagaggttttcctttcactacctaaaaattgtatagtaaggaccagtgccctctttttgagtttcacaaaaacataatatacataattacaaaaacggctaaatctgaatttctctgtgtgcctgatagtctcatagttttatgattgtttaaatagaactgattaaaaaaaaacttcctagattgctcacactctcactaaagggcaaatttacatccattgaatgaacagcctaaaaggtattggttgtggaatgaggccttaatttttttttttttttttaacttgaagttcgggatacaagtgcagaacttgtaggtttgctacgtaggtatacacgtgccatggtggtttgatgcacctatcaagccgtcatctaggttttaagtcccatatgcatttagctatttgtcctaatgctcttctctcttcctccactcaccaccaccgccaaccagttctggtgtgtgttgttctcctgcctgtgtacatgttcaactcccacttatgagtgagaacatgcagtgtttggttttctgtttctttcttagtttgttgaagatgatggcttccagcttcatccatgtacccacaaaggatatgatctcattcctttttatggctgcatagtattccatgatgtatatgtaccatattttctttatccagtctatcgttgatgggcatttgggttggttctgtgtctttgctattgcaaatagtgcttcaataaacctatgtgtgcatgtacctttatatagaatgatttatattcctttgggcatatacccagtaatgagattgccgggtcaaatggtatttctggttctagacccttaagaaatcaccacactgtcttccacaatagttgaactaatttacattcttaccagcaatgtaaaatcattcctatttctccaagcttcccagtatctattgtttcttgactttttaataatcacctttctgactggtgtgagataatatctcactgtggttttgatttgtatctctataatgatcaatgatgttgattttttttttcatgtttgttggctgcataaatgtcttcttttgagaagtatctgttcatgtccttgacccactttttgatggggttgtttgttgttttcttgtaaacttttttaagttccttgtagattctgaatattagatctttgtcggattgaaagattgtaaacttttttcccattctttaggttgcctgttcactctgatgatagtttactttgctgtgcagaagctctttagttaatttagatcccatttgtcaattttggcttttgttgcaattgcttttggtgtttttgtcatgaagtctttgcccacgcctgtgtcctgaatggcattgtcctggctttcttctagagattttatggttttgggttttacatttaagtctttaatccatcttgagttaatttttgtatagggagtaaggaaagggtccagtttcagttttctgcatatggctagccagttttcccagcaccattcattgaataagaaaccctttctccattgcttgtttttgttaggtttgttgaagatcagatggctgtagatgtgtgatgttatttctgagctctctgttatgttccactgatctatatgactgttttcgtaccagtaccatgctgttttatttactgtagccttgtagtatagtttgaggtcaggtaccatgatgcctccagttttgttctttttgcttaggattgtcttggctatacaggctcttctttggttccatatgacatttaaagtagttttccataattccgtgaataatgtcaatggtagtttgatggagatagcattgaatctataaattactttgggtagtatggccattttcacgatattgattcttcctatccatgagcatggaatcttttttttcacttgtttatttcctttcttatttccttgtgcagtggtttgtagttctccttgaagaggtccttcacatcccttgtaagttgtattcctaagtattttattctctttgtagcaattgtaaactggagttcactcatcatttggctgtctgcttgtctattgttggcgtataggattttttgtgacttttgcacattgcttctgtatcctgagagcttgctgaagttgcttaccagcttgaggagttttggggctgagacaatggggttttctaaatatagaatcatgtcatctgcagagacaatttgacttactctctttatttatttctctttatttcctctctttatttctttctcttcaaccatcctatgttgaataggagcggtgagagagggcatccttgtcttgtgtcggttttcacagggaatgattccagcttttgcccattcagtgtgatataggctgttggtttgtcataaatagctcttattattttgagatatgttccattaatacctagtttattgagtttttaacatgaagaggtgtcaaattgtattgaaggccttttctgcatctattaagataatcatgtggtttttgtcattggttctcttttgtgatggattacacttattaatttgcatatgattgaccagccttgtatcccggggatgaagctgactcgattgtgggggataagctttttgatgagctgctggattcagtttgtcactattttgttgaggatttttgcattgatgttcatcagggatattggcttgaagttttcttttgttgttgtgtctttgccaggttttggtatcaggatgatgctggctttataaaatgagttagggaggagtccctccatttcaactccctggaatagtttcagaaggaatggtaccagctcctctttgtacctgtggaagaatttggctgtgaatccatctggtcctgggctttttctggttggtactctaataattattgccttaatttcagaacttgttattggtctattcagggatttgatttcttactggtttagtcttgggagggtgttatgtgtccaggaatttttccatttcttttaattgtgatgtcagggtgtcaatttgagatctttgtagctttcttatgtgggcatttagtgctataaatttccctcttaacactactttagctgtgtcccagagattctggtatgctgtttcgttattctcattggttttacagaacttcttcatttcttccttaatttcattatttacccaggagtcattcaggagcaggttgttcagtttccatgtagttgtgtgattatgagtgaatttctcaatcccaacttctaatttgattgcactttggtctgagagactgtttgttatgatttcagttcttttgcatttgctgaggagtgttttacttctaattatgtggtcaattttagaataaaggccatgtagcactgagaagaatatatattctgttgatttggggtggagcgttctgtagatgtctattaggtccacttgatccatagatcaattcaagttttgaatatccttgttaattttctctctcactgatatatctaatattgacagtggggtgttaaagtcttctgctactattgtgtgggagactaagtctctttgtaggtctctaagaatttgttgtatgaatctgggtgctcctgtatcaggtgcatatatatttaggatagttagctcctcatgttgaattgatccctttactattatgtaatacccttctttgtctttttttatctttgttggtttaaagtctgttttgtcagaaactaggatttcaacccctgctttttttttgctttccatttgcttggtattttgagcctatttgtgtctttgcacataagatgggtctcctgaatacagcaccctgatgagtcttgactctttatccaatttgtcagtctttgtcttttaactggggcatttagtccatttacatttaaggttagtattgttacatgtgaatttgatcctgtcatcatgacgctatctggttattttggacattaactgttgcagtttcttcatagtgtcatttggtcttcatattttggtgtgtttttgcagtggctggtacttgtctttcctttccatattgagtgcttccttcaggagctcttgtaaggcaggtatgatggtgacaaaatccctcagcattttcttcttttgaaagggttttatttctcctttgcttatgaagcttagtttggctggaaataaaattctggattgaaaattcttttctttaagaatgttgaatattggcccccattctcttctggcttgtagggtttctgctgagagatccactgttagtctgatgggcttccctttgtaggtgacctgatttttctccctggctgcccttaacattttttattttatttcagccttggggaatctgatgattttgtgtcttggagttgatcttcttatggagtatcttagtggtgttctctgtatttcctgaatctgaatgttgggctgccttgctaggttggggaagtttacctggataatatcctgaagggtgttttccaacttggttccattctaaccatctctttcccatactccaatcaatcataggttcagtcttttgacatagttccatatttctcagaggttttgttcattccttttcattgttttttatttaatctagtctgcatgccttatttcagcaagacagtcttcaaaatctgatatcctgtcttccacttggtcaatttggctattgatacctgtgtatgattcacaaagttctcctgctgtgtttttcacctccatcaggtcatttatatttctctctatactggttattctagttagcagctcctgtaaccttttatcaaggttcttatcttctttgtatttggttagaacgtgctcctttagctcagcagtttgttattactcaacatctgaagcctacttctgtcaattcctccatctcatcctctgtccagttctgtgcccttgctggagacgcactgcaatcatttggaagaccagggacactctggccttctggattttcatctttttgttgttgttgttgttgttgttaattctttctcacattcatgactttgtctagtttctatcgttgtggctgctgaccctcagatggggtttctatggggacttttttgttgttgttgttgatgctgctgttgttcctttctgtttgtttgtttttctttcaatggtcaggtccatcttctgtaaggctgctgcagtttcctggaggttcacttcaggccctattcatctggttcactccggcacctggagatgtcacttgaggaggctggagaacagcaaggatgggtgtctgttccttcctctgggatctctgacctcaaggggcacctatctgatgccagtaggaacactcctgtatagggtgtctgagaactcctgttggagggtcttaccaagttgagtggcatagggaacagttcctgtttaatgaagcactttgactgtcccttggtggacagggtgtgctttgctgaaaggaaaatcactcgtctggtctgcctggattgcccagaactatcaggaggaaaaactaattctgctggtccctggagactgtggccacacctcccactagggactcaagcccagggagatcagagttctgtccctgagcccctggctggagttcttggagttcctgcagggaggcccaacccagtggggagggatgggtcaggttcaggtctgaagaggcactctggccacagtctgccacagccagtatgttgggctatgggggatacctcttgagaccaagccattcagcctctctggctccagcagaagaaaagcgtggcctggagctatagagattgctgccacccttcccctgccctgggagcttagtgtgttaggcagctatcagtcccagtgttggctaccaaccctcccccaagaagctcaaatgacttagacaacaggcagccacagctgagatgctggccaccccttcccctgagagctcggcaggcttaagcagattctagatgagtggctattgagaatctgtgtggatctctggttgggaccctaggccctggtggcgtgtgcttgtgactgggatcatccaatctgtgggttgcacagttccatgtaaaaaacatggtttctcaggctgggtagcacactccctcaccacctcccttggctatggaatgggggctcccctgccccatgtggctctcaggtgggctgctgcaccacactgctctttttcctctccttggatcatgctagccacctagtcagttctgatgacagaatctggatatctcgattgccagtgcaggatttgcatactgttgtggttcttttcaatggcagcctccgatctctgctgcttctagttggccatactggccctgccccaaagcctaatttttaatccctactgaagatgcagttctcattggaaactttaaatttgatggtgtaggaacaaccatttgggtacttggtattcttttgaaaaataatacctaatagtcattctatgttacttatacaatgattttctgtccaaaaaggatatcaattggtacatcagaattcatgattgtcttccgaatttttctaacattgaaatagggtgaaaaatatggttcaaacacacattttttttaacattagggattgtacagaccactcctcaatcccaacaaatgtactctttttatatttaaccagttctaatagttgagtatttaagataattttgacatctttcttctgtattttactaggttaccataaatatatatatatatatatatatatatatatatatatatatataatctttctacccacaattgtgtgataccaattagctcaaatagcttttttttgtttttttaagaaaacagcaataggaggacatagcatctatgctcttggatgtcagttggacaagatgatttctaatattttatccaatgctgagatggaagttttttttgtggcagatacatgaatgaaagcttcttaaaaagtattttttagtcaattgactagccagcctgccttttcttgtccatgtttttaagaatctgaacctaaaatccagttttctgtcttaaggagaaaaaggaaaagatatctcatcaaatacatgttttacaattttatctctaaagtgcatgtgataggatctaacaaacatgtagagagaaacatctgcaatgtgtgaggattaatcaccaaatttactatgtatcattaatatccaagaaacttcagtgtttatgagtgtcaggtaaagaaacaaacatattcacttgcaaaacaatgaataaattgataaagaaagcaatccacattttgtcttatatcaggtgtcacttaattagctataggcccaggcaggcaacgcaaaggatcttagaagctcaagtggaaaatgatagagggattagggccacaaagaggccctctccataggaggcagaagacagtcctagccaatttttgccacatgactatgaagatctagggtcaccagttttacaagaagccataaattcaaatttttacatgtaattttcagttccttaaaactctgtatttgacaaataatgataggaaaaaagcacagctaatcatcagagcagctctgttgctgccaatttatatatatacaattttacagtatattgcatgtaaaatatatgcaattttatattataatgaaatctaagctatcaggtataaaactacaataagatttagtagaaactattgattatttctggaaaatgtcagttcagtatggtaatatgcctaacaggctcaaattgttgctcaggtgcaacaaaaatgctgatcattttcaagagaggaagtgttaagaatgaagttacaaaaatgtgagcaacataactgatatagtttggatttgtgtccccacccaaatctcacgtcaaattggaggagggacctagtgggaggtgaatgcatcacaggggtggatttctcccatgctgttgtcatgatagtgagttctcacaagatctgatggttttaaagtgtgtgggacttccccctttgctctctctctctctttctctcctgccaccatctctctctctctcctgccaccatcctggcttcccctttgctttcggccaccattgtaagtttcccgaggtctcccagtcatgcttcctgttaagcctgtggaaatgaaagtaaattaaacctcttttcttcataaataatccagtctcaggtagttctttaaagcagtgtgaaaacgaactaataattgaacatataaagcatgtaaaatgctggcccatttgtccatcacaccttaggaaacacaaaacagaactgtagtaggccagagatagaccaccaaatcatgttgatcaatgatatccacgttgcagacaggggaaagaggttgaagttgaggtcaagagtgcatgaagacaggtgagtaagtttggtttttgttttgttttctagaaaagtaacactaaagagcagtaatattggagcccacaacatactatgtgtgactatgagtttaacccttggtttattacaggattctggaataatagttctaggaggccttcttgtaaaattaaaaagaaaataaaaagaagagggagaagagaatgaaaaggaaaagaaaaaaaaaggaaaaaaaaatagcttacctttagtcaatttacatacaataagggcattaccagtagtagctgtctatgctgatactaatttttttaacatttatatcagttgttctccaactttgatgtgcataaggatcatgcagtgattctgttaaaatatagattgataaattcacatcctggagatgttgattcactaagttcggcttgagggcctaaaaatctacattttcaaatgtgcaccaggtatttgtgatgcatttgtgatgcaaaaagaccctattttgagaagcatcaggttagatgagcaggccctcaccagacgtcaaatctgctgacaccttaatcttgtatttcctagccgctagaactataagaaatacatttctattgtttataagtcacccagtttactgcatgttgttagagaagcccaactgaactgagacaaagtgccttaaatctcattgaagaagcactaacagattctatgaaagttaacaataataactaagttactgtgcatcttctgctggtagtagtgggagcgatcaatgtaaaacaataatttgaaagtaaaattttattagtacccgataggctaaggcaaaaatgaaacattgggaacttacacttggagcactgtcctaggatctccaacttcgcccccatcgccaattgtcaaggtatcatagccaatctccagatcaaattcttcaaaatttatctggataacctagcagtaaacagaaacatgcaccttaaatatactgcgttgtgcaataaaaacaacaaaaaaagcaatgacagaaatgcattctttgtctctctgcacacacacacacacacacacacacacacacacacacacacaagcagttcaattatgtataaatatatatataatttcatagtatggcagcaagtcatgttagaatattcttaaagttcaatcatatcattacatgacttttacttgctgtattgtattttctgcattaaattttcaatgaaattgcatggtttctgtttatagaatactcttacttgaagaatgattaaagcaaatctactttaagaaggctttataaaaagtatatgtaggtggagagtggttttccacatatttgcatatatattttataaagttaacatgcagaaacagagtgtgctatttccattaagtagtaaagcttaaaatttgttagagctaaacttgaatctagattgccagaatggtatcaagtttatttttatgtatcgtttggtaaaagaattcctcaaatatattaaaatgagcggcaaaactgggagcacaatactttgagaggcacactataccatgctatgtaattcagcattatttcttgctaaaatatactcatgtatccatatattgtttatatacctatgcaaaaattcaaatttaattaaattgcaattttaaaaatagctataatattgaaaaaatgtaattaagaatcagtacagaaagaaattacataaaattacataatgtcctgcatagagtcatgctttgagcaaaaaataatttataacaaaatattattcatcacctgataaaatgaatgcctgaagttaccatattatgagagaataaatgaagaagatatttctttagtaatatttataactatttgctactttgttattataaaaataattaaaaataaaggaatttatatcttggcttttttttgttataataacaatttttttttttttttttttagatggagtcttgctctgtcactcaggctagagtgcactggcgcgatcttggctcactgccagctccgcctcctgggttcatgccattctcctgcctcagcctcctgagtacctgggactacaggtgcccgccaccatgcctggctaatttttttgtatttttaatagagacggggtttcaccatgttagctaggatggtctcaatctcctggcctcgtgatccgcccacctcggcctcccaaaatgctgggattacaggcgtgagccactggacctggccaacaatttttgactacacatatttcttgttttataaaatattttaatatttgcattgactaaaacaattgttttggccaagtttaaatacagcatgtgtataaagactttgaactatacattttacatgatcataatttaaaaaatatgtgtatttgttccacttatagtaaaatataaatacttcccattaataattacctgtcaatacagacttagattgtttcccattttctttcttttttttttttttggctactataagcaacatggtcatgagcagtattaaacatcttttggtacacattttcaggtatgtctctaggcagtatacttgctaggtaataacagcaaaaattcattttataacctagtaccatatggttttccaaaattgttttaccaattcaaatgttcacattcgtgtacattgaatgcatttattcctaccactctagtagatgtaaaagtgtttttttttttttcgcattttccttaatactaattgagttacatatctttttatatgtttatatatcatttatatttccttttctgtgacacaactgtttgtgttttggcatcttttttcctcagactgcttgtctacttgttatcatttgcaagaattctttatattggtgattctgaaaacattccattatagcacactttgaaaacaataatatttgtaatacacaaaggtgaacagatgaagctgcttataatggaaattttatttttattttttgcccaggaccttctgttccatagagggagttaaatcaatatcttagttctacctgtggctcactcatagtacaccactggatctggctcactagttgagatcagctttatatattatggatactaatcccttacattatatgtgttgcaatagcttcaagttcacagcttccttgttagattatttataagaaaagttattaattttaccagagtaggacttacttatctactcataaaataatagataaacaaatcctactctggtaaaaattattaatattaatgacacaagctcataaagatgtatcttcatatcttttatcttttgtgaattgacttttacagaaactgcaaagtaggaatgtgtgggaggcagaattctaagatgtcttccaatattctaatccctcggtgtagataacctatataatatcctcctcttcagtgtgggcaagacctatgaaaatgacggattatcaatcctatgattagtttatattatatggaaaaggtgaaggaatattaaagatgtgtaattaagatctctaatcagttgactttaagttcatcaaaagggagattatcctgagtggccctgactaattcaggagattccctttaaaagaaggtccagaaatgagagatcaaaaaacaagcaaacaaaaaatcagaagagatgctctcctgttggccttgaagatacaaactgccatgctgtggaaaggcacatttagcatggagcagtgggtggcctttaggagctgagggcctaagtcctacaaccacaataattgaattctgacaacaagtgagcttggaagaagccctacagtttcaaatgagatcacatcccagaccaaagctttgatttcaccccggtacaaccttgaaaagaagacccagatatccatgcccagactcctttcctgtggaaactgtgagataaaaaatttatgttgtttcatgttgctaattttgggtaattttttacacagcaatataaattagcacaatattcctttcatttttccctccaatatgaacatccagttgtctcaatactttttatttaataaatagcccttctttctccaatgatcagcaaaccctaaacatatatcactattctgtatataagtatgttggattttggattctggatcttgttctcttggtaagtttgtatgtacccgaactaccacaaattggcttatttttattattgctataagataagactgtaccttataagtcagatactccacacacttaatacttttgttctttgggagtattttgactactcttggaccatttgtctttcacatatcaacttgtaaaattcttcaaaaatttattttgggctttctaatggaattgcagtgaatctgtaactgatttggtgagaactgacatcttaaggtattgaatatccctacacacaagcctgacttctctcttcatttatttggatctctaaatatattttaataatttttttagtatattacttcttgaaaatgctttttgttattgaaagtggtattttatctttatatttggaacttttttggtatatagaaaagaaatttattttttgtttattgatctaactaggcactggataaagcttccatattatttaaaaacatttgtaaattatttttagtttcttacatagcaagcatgtcttctgtaaataatattttaggttcttcctttccaaattatgtaattttaaaatcttaactttcttggatatctggtaaaatgtttactagaacagatgacaattagtctcattaaattgtacctcatttaagagggaatgcttccaatatatatgtgtgtatgtgtgtgtgtgtgtgtgtgtctgtaggtttgcatggtattcatacatagttttatacatttcttttgttttcttgtgaactaataatgacatgaacactaccatgtttcttatatttcagtgagagtaactctcaaagtacctcatctgtcatcctgccagaaggataaatcccatgatcttcatcaccccaacctatttcacagtagatatatgagtgcactgtaattaaaattagagaatgtttcctttcatatgacttaaaagtctaataggctagtggatacaaattaggtaaatgactgcctaattgattgctagttctatgccaaactcttgatatccattatagtatgatcatatcctaaagactttggacacccatttaatggtagattttattttgcctaaattgtaactgagactcatgcatgtatgtatgcaacaatgagagctctatctcactttaaattaagtgatgaattaattactaactaatccatatacttttggataagcacttaaccactgagctttcactgaatttttagacacttaataattcttgaacagtttcagtgacatacaattactgagaagctagaatattctgattgaatttttataatacattcattttagtttgattcatttatgcttatttttaacattattattgaaatagtccacagaagtaaaacttgtgcattaaaaaaataaaaattagctttgccttatttgaagccattaatataagtaaggtattacagtaaaactccaacttagtatattgagatatggttaaaagaaaaatatctttaatagcatgtgtaaataaagcttaggaaaacaaaaacaaaatgacaacaaaacttgttcattctataatgtaataagtaacatcaggagtctgatgtaaaattttccttctttattgatactttaataatatgaaagtggccaaatagacatttccacccatttatttttgtataatatagaaaagttaatataaaaaatcaacaaatagtcataagtataataggaatgcttcctctacatgtttatttggtagtagggctgaaacatttagtaagaaaataggaaaaatattatgcatttagtgtaaaaagaatgccatacattttgcctgttttacttcttcctaatcatttgtggagtaaataaacaaaaacataaattgcatttagcacataggactaatgaaagaaaaactggaataataaaatatacccttaaagtatttaaataatgtataattgtcttgatttttttaaaccaagtaagtcactctcttgatttccattgtgaaatggtaattccaactggattgcttagtgttgcttattgaggtttgaattaaaacatttaatctactaatgaagtcaattaaaaataacataatgctttttaacactgactttccagaagtaaaaaatccatagatagcattaaatattaaatacttggtagatccatttctcataaggctcaatacataggtttttacaggatattttgttaaaagtggtacagaagctatgtctcataatctttctgtgaatcttgcacagataatttaataccataacttctacattgtcatattttctgaagccatgcggaattcccacttaatacccattaacatgagttttttaaatggaacatatttatattatgtaaaacactggtctcagaattataaatgcattattttattttgaccctaaaagtctatgttgtgtacacctatacattattctggctgcccagcacctgaatatcctccttttgtctgggaaattaggaatcttggtaggaagtacagcatacctcccaatatggtcagatcctagattccccattattcattgtatccagtgtacaggcatgagaactaagattcccttatcaatcagatacacatcttatgtgtataaataaggaaacaaagattgaattctggcaaagagtgtcaaaagcaacagaaacacagtttcaggggcaacagtggttgtaatatgtagtggcactgaaattctagagcacagcagtcttgttcaacaggtaaaaataaatcctctcaggaatcagagccagaagctgtggagcactatgacaaggtaaatggattctattacattccaagcttatctaggaactcattccatttctagagaaatcagtattcactagtcttatccagaaggacatgatattgttctgtgacccagtaaccactctgtgtagcttcaattctctcttcttctgagtgggagtttttatggagttaccctatttgttttctatacttttatattggatttgggatagcctatgttttagccacagttctttagacaatgaggaactacctgtaaatataatggagaagccagtgtatcacttagggattctggacatatctttgtatgcagtaaatggatgaaattttaggttttctctattaatgtagatagaaagtatgttttacataggtattttttccaaagtgaatgcaggagaagaaaaatgggtctggagaggtatttgataaccaaaggggaaaatgtggcagatgctattgattgcttacccaacagccaccttccgtatttacccttgaccttttcttctcaacaggacatatattttgttctcttgtattcttttctgtacatcctaatactcagggactgctcatccaattatgagtttcctgagatgggtcctaatcactctatgccccattccatttgccagtgattcgattacacgtatttgacctaattctggccactggaagatgattagcaatttgctgagaggcttttgcaaaatgatttcttggttttcaaagaagtacaaaaaatcagtctgctttgaggtaattctatctgaatgtattcagctattacaaccatctcacaatacgtagtttgaagataaagcaaaactacatgttgagatgtccagaacctaggaacggtgtttttctgtgtgcgtggggcttgcatgcttctggacagtatgctttttaaataatgcatttgttatttaagtcattcgatttgaggtttcccatatgtaaactgaagacattccaatgaacaaatcgttttaataaattctcagtttaaaggaatgctttgcccaagtaattttcccatgtttatttggctactggtgatgaaactaaacttcaagtttgcttgatgatagtaattacatgcttaaacatcatgctattctacgttaacaaagtaaacttctgaaatttagaaaatattttccgtgcatcccaaatacctcatatcatgttgttataataatttataaatatgttctttgatgttgggcatatgcctcatgtattaaatagtgatggcagggagagacaatttctgaaacctaacaactaataaatattacataaattcttcgggaaaaaaatatagaaagcatctattgatacaagttcttttgtatttcatggtaaagtctgtatttgttaattcaaaataattctgaaagctgaagaaaatactcaatattagacattttttatttacataattagtacaacattcaaattagcctttgatgatgtttaaccaaacaaattaatgatgctttaactaatgccaataccaataccaataccaagctatactcattagtgagacaggataatatagataagtccacaggaaaagcctgggattatagccccatttctctaaaaaaaagttatattattttgagcaattctctaacttatatgaaatagtgtttataatttctattttttaaggttgaaatatgtattacaataagcaaggattataaaataacacataggatgcttgatatatagtaggacctcataaatggcagttattattagctatgtcaattatcttaaaataggtattcgtatctgttcacaatggatcttgaggatgaagttcttttttcagcaatcccatttgattccaagataagagtttttcccccaaactctatgttgctaaaaatttaccttttttgggagcagcttttctccattatgattatttcagaatggcaataagtcactctaatattaacaattatttttgctccccggtgtggaaatcagaatgcattatatatgtataattacaaaatataaaaactttaattaatctcaaggtatgcaaataccacgttacacaatcaacttgacatctaattaaagcacttctttcttcatatacattctataccttggcaatcatagtccaatgagggaaacatgacataagcaagatgaatacaataccctgtgttgattgctttgggatatagacacactgggttatattagcagagatgacagccactcaatccagttggagactatagaggaaaggattccctgaggtggaaaaccccagacactgccaaggaaggtggagttgggaactgggaaagaacattctagggtagaatgtgaaatacggcaaagtgaaaaaaatattatttttgtttctgaaacataaactgtgaggcaaaaagtgatgagaaggaacactagcgatgaaggcagaaagcagaccatgttaaggactgtgaactttatcttctatatgaaaagcagcatattacgattttgaacaatgttgacagggttatatttaattttttacatgctcattttggcagcagggacaatctggatttgaaggataacagggcagggttagagagattgaagacctaaacttggactgtggaagtagggatggagaagagtggattcagacaaggtttctttgctctaaattaaaataattataatagttttttttccctttttttccatacacatgaaagcattattcaaaggcccacacaaaaatctatgccttggcaggactgtcttatcaaatgttattgcttgtaaatgtctaatgcagagagagcaaaatatggagtacctttattaaaaaatcatataattcagaataattctaaaacttggctgcttttgtggtatgtattataagtgacatacatttcacatctatatggaaaattcatgttaatgatgtttaagtaataatcatcctaaattagctacttaaaaataaatatacaaaggtaaacttatatgaaatttatgaaataggtaaatattgtatgatacaaaatgcttaaactatgacacatcagaattccttatttattcatttgaaagtgatatcattttagagaaaataataaatatctcatattctagaagaattatgcattgcaatatttaatattttacttacatattttattacagaatatatatcccaagactctaggctagaccattcaacagtgcaaaatgccacctcagggaattctctaggctaatccactttgctgccagcatcaggttaacagtttcaatcttgcaagggctcatattttagagatggggtggaggagagtctggggacactgagagctactgatggagtgataaaagcttttagctttgttttatttttctatgcctttaatatctgtacactggtcttctcctttaggggactgttggcatgtaacaatgacagattacataaagcactacaaatgtttcactgaagggaagaagctacataaaatgaaaaattcatcaaatattaaatccatagcaccacagtacaaaaccattggttcctttccatcatttattcatgcttagctactggaggatataatttaaattccataatacatataaatgatcaacttgaatttacagattttgaagaaaatccttgcagataatattcttggttttaggagactattcattacaaatttgtataagttaggtcgtatatatccaaaatattttgaaaaatatgtatgaggctaattcaaataaatttgttaagaagggctctttttctgtttttttgtcccttattaataatggggtcatcatggtctaggatacctctcttttcatttatttatctatatctatttttatataaaaaaactttgactccagactttgagaaaatgaaagttttgttcaaaatgattagatacacaactatagtagtgatatacagatatttatatactttcatatataatgaaccatgcaatgagttttaattccagcctcagtttatccttgttatttttcttaagacaccaaaagacaggatgtaagataccagcttctcaatgcatggtctttgttgttaaccttatttttgtttatgtaatttatttaaacaaggttattgagtagtgaatctttatcagtttatatctgtggaaggcccggtttacttctatgtcttcctggacaagcaacttaggcaggagtccaggaagttagggtacaagagaaattacctgccacagctatgcaggaggaaagacttgtagcccatgaatgaattctctctggagccagtagttaggaaaagactggggaagggtttttatttctgtctttgtgaaaaaggtcaccggtattttgatagggattttgtagattgctacgggtaatgtggacattttaacaatattaattcttccatttcacgaactcaagatatctttccatttatttgtgtcctctccaatttctttaatcagtgctttatagttttcattgtattattgtggttaccagaagctggagagaataaggaggaaggagaaactgggaaagttactttgtcaatgggtaccaagttgaagtttgagtgaccatagtaataacaatgtagtgtatattccaagatagctagaaaagaagattttgaatgttattatacaaaggagcaatacatgtttaaggtgataaatataataattattctgatttgatcattatataaggtatagggacatcaaaatatctgtatttcactgcaaccttgtataattctgaaccccagaaacaatttttatgtgtcaattataagtaaaactttaataaaaaaagagtgaggaaaggtagctatactactgtttcctattttgtgaactgtgcttcaaatagaaggctcctattttaagttttggaggttaagttaaaacacaaatcagataatataacttctatctaaaagctattgacttatttaattgtatacacatatttaaaaatatgactctttaccagcactgttatagtgatatagatacagactaacttttcttccttcactgggggaagaatatagtaaatttaaaaaatatataataatcttatagaatataaagtcttcaaacactcatatgtgttatgaagtgttttaaagaaagataaatcaaggtaagatgatagagagtggtggaggtgttcagtgatagaggaggtgagggtgaggaacttgagagaaatctgaatgaaaagaggaactatttagatatcacattcatcagtggtttctcattccatatttgaataaatctcaaaggggcctctatgatctaatctttctttagttctacagtctccatgttgcccattctcctctttacccactatgccaagggcccctgtaatctttttagtttctagaagacatcagggccataaaaatcctttatgaggactactcactctgtctcagacactcttctctctgcatttccagttccttgtcattccataatattggctgaaaaatcatctgctcagaaaagtatttttgacatttctaaggggcttcctctttattccattaagggtgatttctttacatgatgattatttattcctgtgtttatccttttattgtctatttaaagtgctaactagaagcttcctgatgttagcacatttgtctttctaaaaaatcgattgcaatcccaggttctacactgtaaaactgtaggatttcccaggtaatgtctagctaagatttacaatattggtattcatctggccactctaaggcacatgaggtgctttatgcttgtccttggatgttagagatcgtcacagactgagaatgtatagggtggacactgaagaggtcttagcaggaaaaaaaaaggtggaactactacatcctatctctgcagatgttgctcccttcaaaccttacccctaatatcattgatgtgggtgactttactattacatcagaaggggttaaaattcaaagcagatatgtaatactgagcaaaggaattacacacatttttacactttgatatgtacattatgtgattcttgctgtgtgagggcaattaaatcatccaaatgactctccttcacattgaatagagattccaggagaccaaaaagctgtaatactaagaagggcaagtgctgtgggtaacacaggtataatatcacattcctcctctctcttcacaacccagttgcagctattcttgaggtgttaggtagctggggtaggagacaatgttccagaaggttgagcatggccccactaactctaaggttgtcattaagataaccttccattctgctgcaaaatatctcagtgacggaaagcaaaagctcacagctcttgccagtttcttcttcaagctctcttggcagcagcctattctgacttagaagcatctgctgatggtttccggtgactaatatcagcagggagtctccacaagaatatttcaagatctgaaatgtatgagagtgtgtgttatctgcaccgtaggaaactaagctcaaacgttagtggaggcattatacccatctcgctctgggaatttattagtgttgttggtggtggtagcagttgcagtagtagttacaatagtaatattattaacactaatattttgaacatatatattccaggccctgttcttactgcatatctcatattatcctttcaagagtcataagaaattaaattattgagaccacagaagtccagataagtttttggtggtgatctgtgattcattacacaattatgcagtgtctatatttatatacaactaggtactttttatatttgtgtattagtatatgaggaattttagcatcaagaatgtaaaatatagaaaggacatacaatgaatatttactatttattcctaattattcaatgagtggtattacatcttcaaaagaatataaaatactcaaagtcaatgactattattgtaagtattaaactctcgtgatgttaaaaaaactatgttgattcaagatgttaaaatgaatctgcctctaactagtaaaattgcaatccataattttatacatgcaattatggaattaactaaaatatatgtgatgataaaagaagttgctaaaatattagtttaagaataaaataaacataaatgctttctagaataagcatcaattctatccaaaaagagagattttatgtttggtttctttatacttctctgtgcttttgtttacaaaaacattgattagaagaatgatgatcacactagatactatcatttgaatgtctcccctcaaaaattcagatattattaatgtgatagtattaaagatggtagctttaagaggtgatgtgccttgagggctcctcccttgtaaatgggatttagatgctcataaaagaggcagcattaagctcccttgtctttctcactttccatgtgaggacacagtgtcttctgctgtccaatttccttgttactcctcattgccacctgggataggcagaatacctaattaaagatgtccactccctaatccaaaaaaaagctgtgactatattaccagacatgtcaaaagggacttgaacttgtgattcaatttaagaatcttgagatgaaaagtttattctggatttctagagtgggccaaatctattcacacaagtcttaacattagaggaagaagtcagaagaatgtgcaaatatgacatcagaaggactagacacatctttgctggatttgaagatggaggaagaagactgggaatggacctcagctaagagccaagaaaaaataaagatattaaggaactacaaggaactgaattctgccaacaagatcgattaacaggaaacattctttcccagattttccaaaaaggaatatagtgtgctgacaacttagttttattgcagtgagccccatgctgaactgctgacccacagaattataaaataatgaatgttttaatttatattaatattattatttgttttaagccactaagtttacagtaatttgttacagtagcaatggaactgtcacttttataacagcatccagacttcatcattcttatttcatttaataaagccactggctcaccctgcaaatttacataagccacataagttttccaaacttgtttctgcacctatacaatctatacaataatattaactattcatacaattaataggaggattaagtgagaagatacataaaaatagcttagcatagtgcctgtcacatacactcaattcatctacaatttaatataattaattcaaaaaaatcagtaacagtaataaaatcatgagttttttcctaatatcttttctcttgctagctagtacttaaaagggaatattctttgttcactcatcaattttggactaaatatgtgtaacagaggttgtcatatctttccaaaacatccatgtactccttctcctaccatagtagaattcctagctggtagcaagttgtccttactaaagactatattttccattctctcttgtagctaagtatgagaatgttgttagattattgcaaaaatatgatataaatagaaatgttttgaagcaacatcaaggaatatttcttaagagatagcttacatttgtcctttgttttccttatttatcacttcccccaacctgcttcctagaagggttagacaccatgttgcaacctaagataaagaccacaaattgggaatggtagggtggtgagttagactatgactctgagaaatttctggatcagagacaccattagtcttggaccagatacatatcttgtttaagtctctgttaatgcgttttctgtcactgacatccaaacctaatcataattgaaaagcctgtgcatctcggttgttttaattaagaccttctttgcccagtctctctttttcctcccctatgccggccccagaaagactgtatttggttgtataaagtacattaattgccataatttatttgaattccttactatttatgtcaaattattattcaacacagctctgattatgcatatgattccggtataatcataatactgagattaaaatggtgggtatacccaatggttagtagtgggaacagtagtggaaaaaatacaaacaaaaatgctttgccatttgcatattttgcctactttgttggtaagaaccagagacattcctagaaagagctaaaacacatggaaataaacaagcaactattttgtctaggaataattgctcagttatttcaataaatattcatttgaaaaactcccacatgacagttacttcattagatattaaggatgcatggactcaggaactggtttttgtccttaagggttaaactaaggaaaataagtgcacaaacatgtaagtacaatgtaatgtgacaacacatgggtcagttatgcagagtaagctttcccaatctaggtgggaagataggacaggcttctaggaaaaggtaaaagattacctgagtcctagaagatgccattaataaacagggtcacaagactggagatgtgtaaacaaagtgaaaaagtatattccctacagaaggagcggcttatccccaaaatacagggtcctagaagtgctttgggggctaaatagagtgttgaagtatgagtctaacacaagagtagtttaggttgcccatggcttcctctataaagctatgcagaaccatttaaatattttacaaagaagacattatttcatctcagaataaaacatcacactgaattttttggaaagtaacaggcttggagtaagcagaaaaatgagatgaagatttgctaattggaaagctggttattaatccaaaggagaataatggaaacctgagtgagagggagttaaacaacttcaaggcatactaattaaatataatgaagtcattggactttgtatttagatatgtgaaggaaaaggggaaggatgtaaaatgaaaaatgtttgaattattaatatagaggaacactaatatttaaggataaggtcactagcaaaagcctggaaacgtagggggaaattcaggaaaacagagaataaagaggctggggaggataaagtttcaaggaaaaggaagtagtcaataatatgactcactctatacctatgcctttcttttacttaatttattatttaaaaatgtgttttcattataaaatgaagcatatatcttatttgatactttttttgttagtacaaaattaaagtggaaaatgcatgtaatcttctatctagagataattcttttttaacatgttaaaattattcttaaaaaagataattcttttttaacatgttaaaaaagaaatattcttttttcccctttctttctttccttctctctctctctttctcctttccttccttccttcctttcctttctctttttctttctttctctccctccctcccttccttccttccctccttccttccttttttctttccctttataaatacactttttaattttcttgagataggtgttgctctgtcacccaggctggaatgcagcagcagggttatagctcatccatccttaaactcctggactcaagtgatccttccaccccagcctcctgagtaactgggactaaagacatgtgccaccatgcccacttggttaatttttaaaaattgttttgtagaaaaagggtcttgctatgttgctcaggatggtctcaaattcctggcctcaagtgatcctcccaccttggcctcccaaagtagctcccaggtatgagtcactgtatctggcctcattttttctttattgatatttatttatttatatttattgatatttaattttattgtacttgcacagagtaattcactttaaataaagtatttcaattaaataaaccatttgaacaaaaaaaataagtaccattggtaggggttaggaatagttaaggtactgctatacagatatggttcacttaagaggaggggaaataaaagatcagcgcctttaaaattctactgccaagcctgggtgttctataaatagtgaccagagctacttttcttggcttggggaaccttgtagttggtttttctaatttccatctaattgttttgtatcaagatcttcactctgctactaggttctttctgaatcatgctttgttaagactgccaacctggctttaatttcagtttatccctgtactgctgcctcaggtttggtcttgttagtgcctgctccattgtagtagatactgtcaatgctccaggtgatcaataacccccttggatgcttcttgccctttctgttatctgttcattatcttccatacactatgcatttgtctctaaacgtgtatagctatgagtcttctggagactgctttcaggctacaggagcccacttggtccacacatgagccctgaaagatctgggtatcacttaccctatgatcatggggtgcagaagtatgagagcacagcttctttgccttgagttgggataaactatcaggtgtaatttacactgcatgagatccagcagaggcttggattttgtctgaaattgcaccttgcttaacttccttcttgtcctgcctctcccactcccttaatagtttctcctggatacactttcttaatgaatcagcagcatataattccttctcttgggcctgctttttcaggaacataactgaagacagctatagtctgcagaaaagtgactctctatgcctggctgaggtttcagacctggcactgaagcttggcacaagtaccaaatctccaaatatttggcgcaaagaactagtacctataaatgggctgactaaatgaagtggcaaaaggctatctctaaagatggaaaagtgacaagaattgttcagatgacagtgttacaggtgagttcaagagtgtattctgatgcctgaagactttatggggaggaagattaagattgtatttaatggatctaaagaaaaaacatgggcttaaatgtattgaatgtacaaaggtaatatttcacagtttaataattttaccttcattataaattggaccttcactacttgtttttaaaataagccaaagaatggaatggcctgtctgaaaaggaacttcatctcctactagaaaaggctgtcctttacctgaatttaagtttggggcaagtgtccataaaaacataagagcagagaaaaactcatttaatacttcacttcaacagaaatcaaatctatgtttcagaatgatatgaaatgttgtaatgaagttttatcagaactatatgaaaaacccagtaactatgccttatggtagctctagagaaaataatatacaggcacaaatatgatttaatataaatgtagttagcatttatttataaagcagtacaaataccaacaaaatatttgctattcattgtgcactcatcttagactgtgctgtattaaagcacctagtaatttccgaacaatatatattgcttattcatattaattaattattttatttatacaataaatgttaactggtcacccactatgagctaggtactatgcttatgcttacacatccttaaatactcaacatatctcaatatatgtataatggtctatctgataatgtcattcactaaaagttatctttggaataagggatgggatgaaaaataagcatatataattccttaaacttacaaggtagtttccaatgtacaaagtgctgttttatttattaacttgtgtgatacttcaagactcctatgacatggtgaggcatggatgattacccctaatttaaagatgagaaaactgagattcagagaggtgagatgatctgcacaacaattcagggcttttgactcaggttcacattctatccatgtcttattccacaaaagaaaggcttttataagtagggtgggaagctccagagtgaatttttaaatatgtacacttaaaatcataccagtcccttgacctccttcattaattcaccttggtcatggtaagccatattctctaaattttaagatccacaagtgatgtgacgcaaatttaaaacaaagtaaatattcatagttttaaaatacaaaaacaaatatgcttttgtctagtgttatgcaacattttttaaagccataatcaatacttattcttttgatgacatattttatttcttccgacaattaagacttctactaagctagcgagagttataatctgaagtcaacctcatatgcctgtctttattctctatgaattatattcttctatgcccagttaatttaatctttcattactcacctctcaaagaattgtattttcttcgttgtgagatttgctgacatcctggagtcatcaaaattatcctcataacaataactcaatattgataaaagtatattacatttaaagagagcagggggtggtcaaaaagccataaagaattatgctcctctacattttcagcttagttctttacattatatggaagaattgtctaattaaaatcattgtaattttactataatttacatgtttatattggaagaatcacatctcaaaaatctattagcaacctaacaaagtaaaggtagccaacactagcatgtgttttaatcacctggattttctccaaccagatatggataaaaatagaagaaataagcatattatcaattttcaggctatagtggaatgtgctagaattattctagaagcaaactgggatgttaaatattggattagactccatttatactagatcaggagataaaaacaaaatgatgcatatcattatctccctgtctcagagttttttggtgagaagtaacagaaaaccattttgactggcttaagtaaaatacgtattttaagttatggggtaggacacagaagcaagcaaaagctaaaattccagactaaataaaggatagaagcccaggaaactttgggttctaggtagtaggaaagaatcagtgatgactgtaagagtcaatgcctagttttgaatccagtttctcaaagttaaattgtagcctttggcaaattactttctctctctgactctatttcctcatatgaaaaatagggataataattgtacctacatgttagggttgttgtaaaactaaattaaatattgcatgcaaaggctttagaaacattcttcatatatagtaaacatccagtgaacgttaactattgttatttactattattctgaagtgttttccttctgataaatcaacaccaatatttttcagtgtgtgctacttttttcaaggttcagtaagaaatggagtgactaaacttgggtcacatgacatgaggagtgtattagtaaatgcttaataattggctctttgaaaaacatgcttattaaaaatttacttatataaaggatgtgtaacacagaatttacaaataatgacaaatatacaatattcttgattataaattccacacagccaaatgctttgcagaaaatgcttttgttgatgtctgccaaacatttgtatctgtagctaactcatggttacaaattgatgaatggactggtatagttctcacatgaatgttggttgatatttaatttatgttaatgagtgaaacaattataaaaatgaatacatatgttgaaacatcatttgtttgtcaatgatgtgaatgacttcattattgaaacagatcatagtttttgaatactggaagaatatttcctcaatttttttgtgccattcacaatgtaatcgctacagactcaatacacttcaaaattgaatctttagtatcaacattttcttcttcactttctatgtctacacaatgaagaaaagttctgatttcttgagtttgcctatttctatagtgtaaattgtaccactgtgtccaaattgaagctgccaaagagactgaatacagattggggcagagatgcactgtctttcatcattatatagtaggtccagcatatggtcaaaatagatttaaataacctcaggggcatagctaatagtaaagtctagtaaaagattatgaaataatgagttttgtgtagttattacttttatttttaatataacattatattttagttcatcttgtgtagttattacttttgtttttaatataacattatattttagttcagatgatttcaattttattattggatatgcttaacaaccagcttgttatattccttataattacatcagtgctctcaagagctgataaaagttacttccagcataccactgtatgagatcttcttggcaaatgaaggtggaagggttagggacagcgtaactttgattgaagtcccctccaggaccacccggaatggcagaaaggtagttttttggcttttaaaaattatggagaacagatggatgctgtgtaagcaaaaaaactaacatggattcaagtctactacaggcccagtttcacgttttttctcattcttccccctgataatctacctgagaacaatgtaaaacccatgagagagagaatcgtgacataaaggatacaagggaattgtgatataaaggacctttgagccgggcgcggtggctcatgcctgcgatcccagcacttaggaggccgaggcgggcagatcatgaggtcaggacttcgagaccagcctggccaacatggtgaatccccatctctactaaaaatgcaaaaattagccaggtgtggtggcgtgtgcctgtaatcccagctactcaggaggcagagacaggagaattgcttgaacctgggaggcgaaggttgcagtgagctgagatcgtgccattacactccagcctgggtgacagagcaagactccatctcaaaaaaaaaaaagacctttgaatcgtcagcttcaagaactacacctgggattagtagctactcaatacatacttatttgaatgaataagtaagtattccccagtagaaagaaagtctcagaggatagaatcagttgtaaaatttgagaggacacctattagataaatggcaacaagtagatggcagtaaaggaagagaaaggttattttgggaagattggttcaggggtcaacagagcagtgagggagccaggagcagcaagtcagaaaatttgcttagagaagttattttggtgggtttcaaagctccagaaaggagggtatggatcagcaataggacttcagtacctgaaaaagggactagtgatgacaagggaagatcccaacctaacaatgaaagataatagaatggacacatgggtagaaaacaggacagatttccaatcactaacaccaaacttaaaaataaatcccaaacttaattttcattatagggcatgtgataagattagaattaagggtgacttcaagttgagtcctaaaatatcagtttaggactgaaatttggatttttttgttttcctgcaaaagtcaacatttatacttaattgaaaaaagtggagtcaatgatatagtaagaaggactggacccagaatacaagaaagggactgcatgcttctctcatttgatcttttaatttttaaaggcaaatacacttgagtaattctgatcactgtattttatttttatcagtgctttccaatcttgaatacgagaagtactttgtaagtaatatgaaggaaatttgaatgaaaataattaatgggacactcacacgagatagagttgttcatccattatcaattaagaaaaaataggtcaggcatggtagctcacgtctataatcccagcactttgggaggccgaggtgggtggatcgcgaggtcaggagattgagaccatcctggctaacacggtgaaaccccgtatctactaaaaatacaaaaaattagctgggcatggtggtgggcgcctgtagtcccagctacttggtaggctgaggcaggagaaaggcgtgaatctgggaggcagagcttgtagtaagccgagatcgtgccactgtactccagcctgggtgacagagtgagactccacctcaaaaataaataaataaataaataaatagcaagtgttgttctgattatattaataatacaaatacattttggaatttttattagtaatgttatatatttacatttcaaatagtagttcaaatatacttgagacacttaatctgattcttccacggatatttgtttcctgggttgggaatgggcagtcttcaatcacataaaaatgtaacattagaagaagtatacagaaaaatatgcaagaatattttcaactaggcatcctactcattagcttttgccagttgttcatcactttcttttttcttttttttctttttttccttgagatggagtctgactccgttgcccaggctggagtgcagtggcatgatctcggctcactgtaagctctgcctcccgggttcaagcaattctcctgcctcagcctccctggtagctgggattacaggtgcctgccatcatgcctggctaatttttgtatttttagtagagacagggttttgccattttggcaatgctggtctcaaactcctgacctcaggtgatctgccctcttcagcatatcaaagtgtttggattaccggtgtgagccaccacacctggccgttcatccactatgtattctaactgtggctttccctctaagactttctttgagatctttcagtctcatggtttcaaataacatctatagctgacaatttgcaaactttcacctctatccttttaaaaaaggatatctggattttatatcccacttgatatccaatctaacaggtatttcaaatgtaacaaagataaactgttttttctcctaaaccagctccacctgtagcttttcccttttacttgaaagcaatactgtgctaattatttatctgctgtctcttagctctagccaacccttctgtattctgccctttgatatttgggttagaacactgcacattacaattctcagattcttttttttttctttagtggatgcctaaacctgctagctcacatcctttcctcagaggtgtgaccaccaaccatgaaagatttcctcctttgaaatttgagcaccaggtctagactgtttttactgcaagctcttaggttctggtaataccacagtttttacttttctttctggatgaaaaaaggatggtatctgtctacatagttattgcttcttcattaatttttactctttatgcattacatatgcaatgcctgtgtaacaattccccaaattaaattccattcattttaaatagctaatacagattatatttttctgactagaccttgtcagtgtagtcattcatatcaagagtgagcctaagactttcaaaaatgggttttgtgggagtggtttgcttattttttggtcttgccagagctgagttcttggacagtaaaaaattcatatgcaattacttatcttttgtgattgaaacagattttgaaaacaaaatttgtggggagagggcaaggggttgctgcacttgatggctaacatatccaagactacaaggacaatggagggagatggcaattgatgactgcattgaagccagaaagagaaattacagctcacatcatggtcagagaacaagagaccgtctatggtgaacctgtagcactgggcaggtatggctaaaacataccccaaatttaattatgcaagttacctaattagaatgtaatctgaacttacagactcacaaagtttcttatgtggaagctagggaattcactgagaaggaatgggatcatgaaatttaaaatggagacatttggatgctctgtgataaagtacagaatcttaaaacccgagttttcagagtcatttctgccaatttctgccattccatttttcctttccctgaagtcctagcaaaaacttcacctgaggcaattaccttgcaatgaggcatttattctcttcaatatccaccaccatcacctttcattctccacacagagcaatccaatagaaatctcagtggtgatggaaatggtcaatatggtagccactagcaatatgtggctattgagcactaaaaataaggctagtttgaactgtgatgtgataaacttgctagatacattctagatttcaaagattaagaataaaagaagagatggtaaattcttgcattaattttatgccaaatgcatgttgaaatcataatatctgtggttaaataaaatataaaattaaaattaatttcatctcttaaaaaatgtggctactggaaaatttaaaattaaagatgcagctcacattccatttgtatcggctagaccaatatccttcaaactcttgctcacataaataaaaagattttggaaactgtactttctcctacaattttacattgacatctattatttaaaactcttagtgtgaatagctgcaaaggacgcaatttctactccaatttcacaagtattttaaatatagttttctcaaaatcttgcatcattagttaactcaatttatggaaaatgtgcatgatattttataaatggaaaaactgtaaaatcaatcagacaaatcagaaactctttctgtctaaaaaagtcagactttgtgttttaattaaaattggcctataatatcctaagtatcatgagttctatataaggataaatagagatacaaatagagggatgaaaaaatagatggatggatgaatgacagatgatagatgaatgacaattagatgatagatgacagatagatagatatataacatacatacctgtatacacaaataaatacatagagaaatagatgatagagacagagatgcatagatgcagacatgggcatttctatgagtttgttgcttggttaataggatatgattcccttcaaatatgtcttagcgaagcttttttttttttttttctttgtctcaagatctgtccctgaggagctatgaatctggaatttcctattctaattctccagggttttatttacactcaagcaatgtaacatatttttattccagttggagaagtaatatatgattatcttttgaaacttggaaaaacaagtataagagggaaattaataaagaagaacaaacagattgaggtatgtcttcagtcttcatttcacacatggagctaatgttgaatgtgtaccttaatgcaagaagaacaattaattcaaagactaggtatgtttaaagtgctagtctaatattttaacttgctgttataaagaaaccctcaattattttcattactcaaatgccataattaaaggaaacattcccttacagaagcttgtggaaggggcataaatgaacatcaaaaatgtatattagtttagattataatgctcagttattacattttattttctgtgaacttaattgcaatgtctgtaaactgattagtaataataacttaatgtttaatgttttagaataagacagtcacctataaattattcaaccatataatgaaatatagaagaaaattatatgtaatgataattttgctttaatacatgttaagtccagtaaataacaggagggaagtatgtttctgaggagatggcagcatttggcaataaaaataggtgtcacttaaggtgaacttactttatataaggagtttcacatgttcttatctgtgcaaccttatgatgtggtattatgacctctactctatgaaaaagagactgtggctgggctctcatagtgagagtgacagcccagattgaaacttgtttaattaatttcatcaagttttaaatctcaggttactttttccatcaaccatgtactttttagtacatttagaacaccataattgctcaaatatacaggaaaacatgaacaataattactgaacaaattataaatgtagaggtattaatcaccttggttaattgggatgtatgccaactagtatagctgtatgcttattatttataccaacaatttccttctgaaaagggttccaaggagtaatctaagaaagcaaatacttctaacagtgtttttaaaactatgtgctataaactgttagggcatcatgaaattaatttagtgggacataatcaatgttttaataataaacagattacattcgactagaatggaaaatacaggagtgcattcatgtaagggaaaatgttttatatgtgtgaaactgtggtgtgtgtgtgtgtgtctgtgtgtttgaactaggtcacaaggtaaaatataatccttattgtggctcatgatgaataattcttgtaaacaaatttctgtaagacatcttaaaaaagttaacctaacagatcaaaattaagtgtctacatttattaataaaaaatagcaaagaactgaaagtaattatgtcctcctaagaaaataatttgcatttgttggagaaaaaggagaaataaatttgagtagattagataatataaacaagtagaaatgtgacaacctctgaaacttcaggtaattctgtaataataatgatttaaagttagcaaagcaaacatcttattgaacatgagataataccacatgttgatgacaattacatgtaattgcgaagacaaaacaatatctccatctcaatgcaagattaattaaatgtgtttattccatactttataatgaatttgcttcatgtctatcttggaaaaagatatttataccttactgtgagataagtctttgtacctacacatatctcataaagtacacacctctgacctttgctaactatgtgatctttgacaagttatttataggcttgcttaaatgcagacaataaaagtatctccctcatgagagacttacaaggattaaataattcataaaaagtgctagaaaaaaactactgagaatagtgtacggcatgctgctaagtgttcaacaaatgtcagttttccaagcacttcatgtttttttttttcctcaacaaccaataatttgcacagagaaataaaccaataaatatttgttgcattgaattgaactgatgacacaggttgggtggataacatgatttccttcatgcaactgaggggtttgatttagaaatttacccaagtttatagagataatttggggcagagtaggtttctgatctagttcttctgatttataaatcagggctcttctatgagacaaatctaatagtcccttggttgagttttaaaccaactctgctgatcttagaattaggtttcaagaacttgataagtgatcacaaaaattcccgggaggcaatatatactttaataacaatgaattaataatgtatttcaaggtcttattagctttactaacaactgtgtttgcattatcttgcttatttcttatgatactataaaatacatgtctttatcattcacatttcatagataaagaaacaacatcagagaggttaaataacttaaagttatctgaaaattatacatcagtatatgaaacacaatctgaaccaatttcatgagctcgaccaccaaactttaaaatctagcccaaagaagttatcacataatttgaagatttgagagaaatgatgatttttcctatttaggtcctctctattgctataaaatcacatcttacaaacagaagcaggatagcaagagcaggaaagaaaaaacagcaaaattttcagctgcatttacattcattgtgttataattttgcttgaggtatagtggcacatacatatttagatgtgttactcatattagaatcaaatagaaaggcaattcaactttttgaaatatccataatataaattctttattagtgcagagcacattaaaccaactatttcaaataaatagctatgtgatatatagcaatagagaaacattgaaattaaagtcagctatgtataaaaacaggattgacctgaatgatgtgtcaaacagaaaagacacaaaaacagccactattcatgattccttttaaaaaggatacacttacaaccttcaaaaatgtatctcagaaagcattcatttgtaattttaaccttttggtttatatgttagtagcttggagtagaattgtattatttttattttttcccaaatttctcatataaatctggtttataaactgttaagtagggaatattgcgccaaaatcctacttgagttataaattttccatactgcatgttccgtattatttctttgcctttgtctttatgattatgactttttttttaaatcacagatggtgttctcttaccttatttgtattcactgctgtgatgacccagacacattgtgcattgctgtcatactggaacggaaagttgggagatgtaaaggtaccacttggtccttgaagattagagccacacgttttcactaaaagagaaattgcattttaaaagatgaacatatgtcacatgtaaaattacaacaataaaatatcttgcaaatagactttacattcaaaatgacacaattataaccacattgaaatatatattatggtattctaatgtcacttatcaaaatacagtgtttttaacaccctgggattcacaagctcgatattttcaacattaatggaaaacactagttatgaatagaaatttgagggcatgataaatgcttctctgactttaaataggtgtgtttaattagagaaaggtatatgtacccaatattgtgttaacaaaaatatacaaagagagtgaaacagagccttgggttaatgaagcaatctaagaagtgttttcatttgtgtttattaagtaccctaggactcacaatagtgcagttgagaaccatcaatagaaaaacttctctttctgtacttataactatgaattaaagaactcagactaaaaaaaaaagcagttacatttaagtaattgtaatgaattcccacaaaagttgaaagttgtagcattttctcagttttctaacccatctttcttctacttaataaatgagctagtgaccatactgtttctgtttcttgcttcttgatgaccacaaatttctggatgccactgcttttgatttggatatctttgccccgttctatcaaatcctgcccatattatcattttctaatctgtcaaaaataatctattgtatatttaaatgatgaacagttaaatgtatattttcatatgcacttaaatctgtacatagttatcatcatcaccactttgaaaatcagttgatggacctcctaaaagtttgcttgacatggtcaaagtcatgcttctagtatacagtagtcagaatttcagcccaggtcttctgattcaagtcttgttttttacatcactaaaagtgtgtctttcttgtatgttacatgtagatttctttattagtttcttctcttaatagcataaatctatttcagacaactttcctgcaacttgatggttatatcttgtgttgatttaatagttacagtacttttaattatcttgtgagtgtgtgtgtataatttctgtattttaaccaataaaatcatattattttgtatagaaaaaataataaattgtatttttcttcccttaccattatttgcaattcaatcttttttccccatttactacttaacttcttgtaaatactctatgctcactactccatttttctctcccctttcactcttcaaaatatttcagtctgattctcattctcatttcagtgtttaaattgctttttcaaagccagcaatgaactcataattgctaaatgtagtatctcttcatttttccacatatttgatatctcagcagtaatgcaaaatattgataatattgattagctttgtttgaaattctctgccttcccttacatagtattaagctctcctgattattcgcatgtgttttaaatagttctgctctaccatattatttgttcttgttttatttttcccatctgacccttaagtagcataattctaaattgacttaaccttctcttttctatttgttcaatggtttctctgaatagttaaactaattcatttctatgactggaaaggacatttctgtgttgatagctctcaaatctacatcaccagctttggcatctctcctgatttctagactaattttctgtccgctggacattccattagatgctttgaggaagcactttcaattaaatatttcttgaatagactatccagatcctcgccttgcataatatatactcctcgaggtctattctgttttcctctgtggaaacatctctgttttgcttcatttcttctcttcccagtgtccagtgcttcttcctcatttttcttgtactgataatagctactgaaccccttttctagactccaacttctctattacatcctcctcactgctactatatttatctttctaaaacacagatttaattacattacctaactgcatgaaagcttggtatctatttccgatggaataaagtacaaattcctaatagggagtataaaattattcctgtgaggacctaaatttattttctagtacaatgacctgccattttacatagtcatacactttacttgtgccagaacagacatcttgctcttctttgatttaccatactctttataattttctatatttttcatgctgttttctaggtctagaatattattccttcttacatttacttgcagatattctatttacttaaacaaagccaaggtgatgtgccacttctttccataagaagggtttctaattcttccactaaggattctgtaatggattatacatttcatagcacattatttgaacagcacatttatacaagtgtttaggtgctagtggcctgataaggaatgtagcgtgaaagagtctaagacctttatagaaatgagaaatttatagcaatcacaaagcaattggtttgtagtggctatagctttctgattgaatatactccttctctgagtggtacttaatacttcgtaattctctggcatcctttgttttctaaactatatacacacttagaatcttttgaagtcaaggccttgtttatcatctttgttaactcatagtacaatggctttcatgatgtaggtacgtttgctaaagaaacaaatatccaagttctttcgcacagctcttaaattaactataaaatagtgctctcttcatgctgatgaagaatcttcataaatatgtttcacagtgaaaaactgtcttctatgaaaatgattttctttttctataagaataaggcaaaaacatttataaaacggcaagtaacaatcacctgtaaatattttggtctgtttatctgcttccatccaaacctgacagtaaccacttaacaagttgtatatctacagacatttttgttttgtggcactatgagtttttgcatatttcttgttttcttaatgtatttgtgtgttttaacaaacatagctaattctataatattagtctgaagatttttttgcatatatcatgacgactgttctaggtcagtacatataggtttttttcttttgcagatttagcagtatgaacagaagctgatagaactactggacgtttttgacaggcttccactatgagaatagcacaggatgattaggaggtttccttaatcctgcagtgggaaataagaagacatgtagaacagacctgctatttgaacagagttgcagcagttcacacatagcaacacaaatacagtgaagatcttggtacatttatgtattatgttttatagttgaaaaaataaaaacaaattcattattatggaaagccaaactgcaaaatctcagtggcttacaacaatgagtaattttctcttcaattccattgtatttgtgctttatacttgtgttattattgtaggattaattcttagaagaaatattaattagttacaatatgtgagcatttaaaactttgataaatatacctaaattactctccaaaagtttgttcagtatactcccaaaaataatattaaaaagagaacagttccccaggctgtcgccaaaataatagtatcaatcattatgcttttgtcattctgtcaggaatgtcactgttttaatttccaattctttctctacatttttagtatgctttaacagaagtatttattgttgtctctattttttgctctgacttttctctttgtacacttttcctcatttcaattttttcttgctgatctatagaaacttcctgggtgttactaatattaacccttttatatgtgctacaaatactttcttacagacttttgttgttttcgattttgctttgaattaacttttctctgtaaacataaaaatatgtgtaaatctgtcagtgtcttcttttagatcttgtattttatatctcactcaagaaagattttcttcaaatctaagattgaaatacaacctttatttctcattctttaatagttttattatattataattaaacttcttctacaaattggtttcatatggggcaaggtaaaggagcatttatagtaaattctatattattcgtcatgaactgaaaataccatttatattatatttatatagaccgtacataaatgtataagaaacccatatatgtatctgagcctttttcttaatattgacctactgatctatgattattcttttgccagtaccatactgttttaatcattttttacatagatgacacacatctctccattcttattcaatttcataatttctttattatccattattatttatatttccacaaactttagttgtgtccatttgtcaaagtaaaggagattggtgtctgtattcaattttattgagttcaaacattattttgatacaaatttgcctcttcaatggagcctttagtaacacaaaggaaataaataaacgtgattacagtaaagtagtacatttgagaaattcagctgaaatttcctagtatataagaattccatgcctacagtctcagaaaaatagaaatagtagaaaaagaaaaaaaaccttgtaaataaaccaatgaatgtatgaaatcaaagcaagtattgggttataaattaaatatgacaactttggtcattaaagattagaacaaaatgtggatccccacactagtgataccattcaatattgtcttagaggttccaggcagggcaaaaaaataaaaaaaatttgaagagttacataatttgaataagaaacacatgtcattatttacatgcaatataatttttgtcttacattcaagagatataataatttatctaacacaatatgctgtattattttcaagattcctatattttggttttaaaatatataactcatataaaaatgtataggtttctttcttttttttgtttttgttttgttgttgttgttgttgttgttttagacggagtctcactctgttacccaggctggagtgcagtggcatgatctcggctcattgcaacctccacctcccaggttcaagcgattctcctgcctcagtcttccaagtatctggaattacaggtgcccgccaccatgcccggttcatttttttgtacttttagtagagatgaggtttcaccatgttggccaggctggtcttgaactcctgacctcaagtgatcagcccgcctcagcctccggaaatgctgggattacaggcgtgagccaccgtgcccggctgtataggtttcttttataacaaaaatagttagcaattcaaatggaaaggtccaatttatacaagcagcaggaattatatataattttaaaaaatatatttagcaaaagacatataagacagaagtcttataaaggtaactactaaaaaaacaatgaaggggcattaaataaaacttgtagaaacggaaagatagggcatgttctgaatgggacagcttattatcataaaaatgctaacatcctgatttgagcagtttataatgaactaataggttagctaatatttatgcgtttcctatatttatgattatcttaacttttagtgctttagacagagttgatattttataaaatattttgcttatttcattcacatgccacctgtgtttttataaaggaagattaaaagggctaccctatacattttacagtcctgtttgtggaataaaatgaaccaatacctgcagagaccttgcaaaatactgctaacatcgatagaagtacagaagcagaagccaaaagatttattcctagcttgtctaccaatgtattcctattttttcctcaggtaaaacacatacagttaaccatgctttggaaaatgcctaggaataatgttaagtacagtgaaatatgtttagctttaactgtaaccttcaggcatttagatttgtgccagatacaatgtttcaactacacaagtaagacaggctgacattttattttttggctgagtaaggacatgattcacaggttaaggattcttttttgcacagaatatatcaactgagatctgtctattgttgtctctcggtccactgtgccctgaagtacctttttcactctctcctggaattttccttcttgaatttttccatcatgatttttaaaataaattgaaggacttttgtaatcttactccaacagattcttagaatttgtaaattctgtaaagctctttccactaacttacttgtaattccttaaacacagtgaaaatgttcacactttaagaccctagcactttctatttttctcacctggcataagtttctactcaaacagtattccatacaaggcctattctgcttaatatctctaaactttagtttcttaagtattacctttacataccccacacacacacacacacacacacacacacacacacacacacagaccattgtttattgtctgttttcctcattagaatgtcacattgatgaaagcaagaacttggttttgtttatcatggaatctccagcacataaaattgtgcctgccacatggaagacactcaatgaatgaatgagtgagcaaatgattaaaatacttagagtcacaacaaagatttggttttgtttatcatttatgtcttccaatttttttcccctttgggctttggtagcaattcaagcttctaccttttggtgaatgtagaatgtggtaattaatccacaaaggattcattaacattgtgtgaacaagcacgtcctactgcctgctgttctaaggctatgtattagggttgttgaaagatttctggtaaggaacattttgttgatggtatgaggagtatgatagcatatgtcattaaaggagttattagtatgaagtttgtggttcatttttcatctttaggatgaagtttgtagttcttgtatcttcaaatcttcaactatccctgcatcttcatatttccacttgagcaaattcaaatcacctagatctcagctttttttaacttgtaaacttagatagttgtgctatgtcacccataagctctgataagcctaatatgataatatgattacatcatgcagctatctatgtgctctgaatggctttcccaagagatgcaatgaagttgatagagcctgaaagttatattcttgcccattgaggcctttactatatcagagtaatgttattattattatttaaactgtttgctgacatatgtgacatggaaaataatgaatccgctagaagaatcaagtttgattcaaatgtatttgcggcatttccctttctgtggttgttcacctgagagttagttaagtgttgtagtcttgcccctagtagaagtaattacatttctatctatctttacagtggcttctttgtttattagccaggcataaggatgaataatcatagtgtcagagactaacttgatattctctgaaagtaacttggtattgacaacagcataaactataattcttctgctgcacatgatgtgatagacaaaacaggccatattattttttacttaatagtttctatcgcttctagaaattctaacttgtacttgggaaaattagatattctaataagatgtaactatgtaacaatgagtgagtatgtacagctcaaatcttgtgaagtgcaagtcaggatagcccagacgaagagagatgtaccaacaaaggacttacttatttaaatgtttctcattgggctgtgttaggcaagacaataaatattcttaggggcaaatatgaaatcactggaaatggataaatgttggtacctaaagatggacaactttcagcagacaatgagattcggatgttgagagaaatggtgtgactatatctcagcaagaaaagggaactatccctgacttcacagaagtaggccaaggcaagtgctacccacatgtttcaggtacctttctaatctttctttgctcaaccatcatcattggtatttgaattttattcttaccatccattctttgaaacaaggctgatagtttgagtttctgtcatggcatatcattcccctcaaatagccaaaacaatcttgagaaagaacagagttgggggcatcacactccctgatttcaaacttcgttcatgcgttgcttaatgatggaggtacattctgagaaacgtgttgtgaggcaattttgtcattattaaacatcatagagtgtgcttactacacaaatctagattgtgtagcctactacaaatctagattgtgtagcctactacactatggtatagcctattgcttctaatctatataccttttcagcatgttactctactggatacactgtatacaataaaatgcagacaattagaacacaatgatacttgtgtatctaaacatatctaaacaaagaaaaggtaaaaatatcatacaaaaaaattaaaaatggtacacctgtataggggcacttaccatgaatagagtttgcaggattggaagttgctcaaggtaagtcagagagtgaggagtgaatgtgaaggcccaaggtgttaccatacactaatgcagacttcatagatataactataaattgttttttaaaaattgttacttaaatagtgaattaaccttagcttactgtaacttttttactttataaactccacaattttttaaacttttgacacttataacaacacttagcttaaaatgcaaacacattgcacagccatacatcattattttatttcttcatatgcttattctatatgcttttttctatttttacttttattttttactctttataatttatttaaaactaagacacaaacacacacattagcctaggtctacacagggtcaggatcatcagtagcactgtcttttttctccacatcttgtcccacggacagatcctcaggggtaataatacacatggagctgtcattttctagatgacagtgccttctcctagaatacctcttgaaagacctgtctaaggctgttttactgctaaaagagtacactttctttttaagcagaaagagtacactccaaaatgatgataaaaagtatggtgtagtaaatacttaaaccactaacatagttgtttattatcataataaaatattgtgtagtgtacataattgtatgtgccatacttttatatgagtggtgcagcagttggtttgtttacaccagtatcaccaaaaacacatgagtaacatgttgtattaagatgtgacaatggctacaatgtcactaggtgatataaatttttcggcttcattataattttatgggaccaagattgtatatgttacacatgactgtatatgcaaagctacagtaatcataacagtatggtactggcataaaaacagacagatagataatgaaacagaacagaaagtccagcagtaaacccataaatatatagtcaactaacctgtgacagggtcaccaaaaatacaaaatgggggaaagaatagtctcttcaacaagtggtgttgagaaaattgaatatccacttgcaaaataatgaaattgggcccttgtcttataccttatacaaaaattagcttgaaatggattaaagacttaaatgtaggatatgaatccatacaggtcctagaagaaaacaggaaaaaaatctccttgacattcatcttggcaatgatttttttgaatatgacaacaaaagcataggcaacaaaaggaaaaataaacaagtgagtctattatcatgatattgataggaggagagagtggggattttggtggattcattttaattatttattttctctcatggaggaaaaaatctggctcctgggactgagtgaacaccagaagaggaaaatgacagagcagtgacagtgtgcttagctattaaattttaaaatgtgaatttattttgtattccaacctactggcataagcacattatctgtgtttataagaaaaattctgttggttgaatgagaggattagacatattataattgtataaacttcaataagcatctagcactgaaaactctatatctatgtcataaactgagagtaagcagttatatcacaggaatctatgaccccaaaataaaattaatgtttttattatttattgatcaaatattatttctgggtatgaaaacaaatacaatctcatagttaaaactttgtttgcagtgtggtgtttcctcaaggatctagaatgaaataccatttgacccagccatcccattactgggtatatacccaaaggattataaatcatcctactataaagacacttgcacaggtgtgtttactgcagcactatttgcaatagcaaagacttggaaccaacccaaatgcccatcaatgatagactggataaagaaaatgttgcaaatatataccatggaatactatgcagccataaaaaggaatgaattcttgtcctttgcagggacatggatgaagctggaagccataattctcagcaaactaacacagaaacagaaaatcaaacaccacatgttctcactcataagtggaagttgaacaatgagaacacatggacacagggaagggaacattgcacacccgggcctgttggggtgggggacaaggggagggagagcattaggacaaatacataatgtatgcagggcttaaaatctggatgacaggttgataggtgcagcaaaccaccatggcacatgtataactatgtaacaaacctgcacgttctgcatatgtatcccagaacttaaaaattttaaaaatttgtttagaaaaatattaaatcaattatttgccttttcaattatttatttataaacctttattttaggttcagggtacatgcggcaaacatttacatgggtaaacttgtgtcatggaggccaacaatcacatgaaaaaaaaaactcaacatcagtaatcattagagaattgcaaatcaaaaccacaatgagacaccatctcacgtcagtcagaatggctattttttttttttttgagacggggtctctctttgttgcccaggctggagtgcagtggctcgatctcggctcactgcaagctccacctcccgggttcacgccattttcctgcctcagcctcccgagtagctgggactacaggtgcctgccaccacatccggctaattttttgcatttttttttttttagtagagacggggtttcacagtgttagccaggatggtctcgatcttctgaccttgtgatccacccacctcggcctcccaaagtgctgggattacaggcgtgagccactgcgcccggcccagaatggctatttttaaaaagtaaaaataatgagataaaaaatttcaccaaacaaaatgactattagataatatgtttttaattcatttgtgaaggctgagtgctggatagtttttattctgaaaaatcacgaatcacacaaatattaaattaatccatattctgtttgaaacactatgctgggtggaggtggaaagattaataagacaatcaaagtcgttgccctagagagattatattctagaaaaaaaaagaaatactaaactagcagataaatctggttttacaagatgcaatgggagtaagtaatagattacaaaaggctattcttaggaactgatggagaaaaggaattgttttacttacatattttatttccatctccccccaccactccccagtaatttcggagtttttctcctgcagctcatgtagaaatgaagaacaaactcattttagccaaatcaaggtacaaggtgtccatttccatggtaacatttgataggatctcatcttttaaaatgaatacgtgattattaccattaaacatggttgagttgaaatgctttagggatgtgctaaggaaaagcatccccaagttggcagatgtatactctttgaatgtaaaacaatgtgctgatgaaatactgactgtgagaaaatgaaatggctcaggatagtaaataatttttcagaaattatagaagatacaaagcctatattaacttgaacagaaaataagtatttccaaagttttaaaaaatgttttccaaatacttctaataaattagtaacctaggaagaaagaaaatacccaacaattgaaaagcatttgaggcttaatcttcaatgaagatcataaaagatatgctgtaaaaaacggttaaaacttggaagaaatatattataaaaaagggaaatggaaaaataggaaaagtgagaagaccagcactggaagttagagcgctgttgttttcatggacgtgcatagcaattgtagagaaaaagtgaatttaaaaagaaaggaaagaaagtgcaaacaacctcataacagattatttcacacacacagaaaaaaaactccattaaataagagacagagttttgtgttgagtgtcaagattttagtctttctacacaatatttggtgtatactttcaatgattatgttcaaacataccttctcttcctttttgggaggaaaactcttaatagtgtatgggaaggaaagttatacccaaagttatgtttactacattatggtgaaatgaaatcctacactgtagtttcctccataacaatttaaccacaaaaataaggatttaagtaacgtatataaatgtgcaacatttttcatgtgtcagaattcattttattcttattttcctttaattttaaaatatagtgtatgatataatccactggaaaaatactgaattattgatctatcaaagacctgttattaaactatagataataggagtaggcactgttctctgaatcaattagaattctcagattcttgacagttggtcatgaaatatacaaacacaagtatctgaaggtgaatgataaaacctatttaaatcagcatctggaactatcaataagtagttcagttcaataacatttaactgaacatcccagtctctacatcttcatgagaaactaataaactgtcaaaagtgcagttacaattaggactaatcttcaaatacatctgagtgtcatctgcataagaatgggagtctaatccatgtctgcactaaaagaaagcatataaatgtagactaataatgaaatgcacccgaagtagggaactcgaaaacagaaaaaagatgctgtcgaaaggaaaagaattaaaatcagcaagaagcagactgcacagaatcagataaatttgataaaaatgcagcaaatgcaattcctatgaaagacgagaaatataatgtacagatttttcaaggtaaaaaaaagtaagcaaattcatttttttctagttctttgttgtttaaaatttatcttagccacgaaagtcatgtttatctacagcgctgcctccctttgctccttgtttctctgaatcatcccattagtattaaggatgaaaagatacatggtattaagtcaccaataaaaataagtcatgtgaattacttatttattatgcttttcataaaaataaaaacaaatccaacctagcctatttttcccagtaagaaaataagacatattaagaggtgagatagaatgatataaattattatgcacaatttatatagaaagcctagcattctcaaggtcatccaggagggaaggagtgtggaagagagatgagaagtaagaacagaaagaattaagaagatgatctgactaagaagatgatgtgtagtgaagaagccagacaaaaacctcagacaacaaattctacaaaagattcagtttcaagttatttaccacctttgatgtggactgccctcatcctttcccaaattatccaggaaattaactgagccagttctgatctgcaaatttacaaactgtttttttgtttgtttagatgaagttggaacaatgtctacttgaatttatgttgaatggacataatccaaaaaaatcataaagcaggaatttgcagctagaactaaccattaaacattaagtctccacctaatggcacaagaaattaactgaaattttggaagattttagacctccccaaaatttaaaattggatgttagattaactgatctacacctgaaaaggcaggaaaccctggttaataatttgtaatttcataatgcacttccaaaagttacttccatagcttttcacatgttatttccttcatcagaaatattgtcttttatttcttaatcttttagctaaaatccattcttccaaatccttacttctattagtgcacatatattatattttaattatctgcttacctctgagctcctttatgtcagcaactacattttgcatcttctaatgacaagaagtcagcttaaggtataatatctaccaaatgctcaacaaatgtttttaaatttttaataaataattaagtaaaattaaatataccatttcttctagattttctagtttatttgtgtagaggattttatagtattctctgatggtagtttgtatttctgtgggatcagtggtgataccccctttatcattttttattctgtctatttgattcttctctcttttcttctttattattctggctagcagactattttgttaatcttttcataaaaccagctcctggattcactgattttttttgaagggtttttcatatctctatctccttcagttctgctgtgatcttagttatttcttgtcgtctgctagtttgaatttgtttgctcttgcttctctagttcttttaattgtgatgttagggtgtcgattttagatctttcctgctttgtcctgtgggcatttagtgctataaatttccctttaaacattgctttagctgtgtctcagagattctggtatgttgtgtctttgttttcattggtttcaaagaacttatttatttctgccttaattttgttatttacccagtagtcatttaggagcaggttgttcagtttccatgtagttgtgcagttttgagtgagtttcttaatcccgacttctaatttgattgcactgtggtatgagagactgtttgttatgatttccgttcttttacatttgatgaggagtgttttacttccaattatgtggtcaattttaaaataagtgtgatgtgctgagaagaatgtattttctgtttatttggggtggagaattctgtagatgtctattaggtccgcttggttcagagctgagttcaagtcctgagtatccttgttaattttctgtctcattaatctaatattggcagtggagtgttaaagtcttccactattattgtgtgggcgtctaagtttttgtagggtctctaagaacttgttttatgaatctgagttctcctgtattgggtgcatatatatttaggatagtcagctcttcctgttacattgatccctttaccattatgtaatgtccttctttgtcttttttgatctttgttggtttaaagtctgttttatcagaggctaggattgcaacccctgcttttttatttatttattcatttttgctttttatttgcttggtaaatattcctccatccctttatgttgagcctatgtatatctttgcacttgagatgagtctcctgaatacagcacaccaatgggtcttgactctttatccaatctgccagtctgtgtcttttaattggggcactcagccagtttacatttaaggttaatattgttatgtgttaatttgaacctgccattatgatgctagctggttattttgttcattagttgatgcagtttcttcatagtgtcgatggacttcacagtttggtatgtttttgcagtggctggtactggtttttcctttccacatttagtccttccttcaggagctcttgtaaatcaggcctcatggtgacaaaatctctcagaatttccttgtctataaatgattttatttctccttcacttatgatgcttagtttggctggatatgaaattctaggttgaaaattcttttctttaagaatgtcaaatattggcccccactttcttctggcttgtagggtttctgcagagagttccaccgttagtctaatgggcttccctttgtgggtaacccaacctttcttgctgcctacacttaacattttttctttcatttcaatcttggtgaatctgacgattatatttcttggggttgctcttctcgaggagtatctttgtggtggtctttgtatttcctgtatttgaatgttgtcctgtcttgctaggttggggaagtcctcctggataataccctgaagagtgttttccaacttggttccattctccctgtcactttcatgtacagcaatcaaacataggtgtggtcctttcacatagtcccatatttattggaggctttgttcattccttttcattctttttttctctaatcttgtcttcatgctttatttcattaagttgatcttcaatctctgatatcctttcttccaatggatcaatttggctgatacttgtgtatgcttcatgaatttctcatgctgtgtttttcagcttcatcaggtcatttatgtttttctctaaactggttattctagttagcaattcctccagccttttttcaaggttcttagcttccctgtattgggttagaatatgctcctttagcttggaggagtttgttattgcccaccttctgaagcctatttctgtcaatttgtcaaactcattctctatccagttttgttcccttgctggagaacaatgatcctttggaaaataagaggcattctggtttttaaattttcaacctttttgcattggtttttccttatctttgtggatttatctaccaacggtctttgatgtcggtgaccttctgatgggttcctgggcacatacaccctcttaaaataaaccaagaagaagttgaatccctgaatagaccaataacaagttctgaaactgaggtagtaattaatagtataccaaccataaaaagaccaggaccagacagattcatagccaaactctatcagaggtacaaagaggaactggtaccattctttctaaaactattccaaacaagagaaaaagagagactcctccctaactcattttatgaggccagcatcatcctgataccaaaacctggcagagacacaacaaaaaaaaagaacatttcaggccaatatccctgatgaagatcgatgtgaaaattctcaataaaatactggcaaaccaaatccagcagcgttatcaaaaagcttatccaccatgatcaagtcgtctttatccttgggatgcaaggctggttcaatatatgcaaatcaataaccataatccatcacataaagagaactaatgacaaaaaccacatgattatctcaatagatgcataaaaggccttcgataaaattcaacagcgcttcatgctaaaaactctcaataaactaggtatgctggaagcattccctttgaaaaccagcacaagacaaggatgccctctctcactactcgtattcaacatagtattggaagttctggccagggaaatcaggcaagagaaacaaataaagagtattcaaatgggaagggagaaagtcaaattgtctctgtttgcagatgacatgattgtatatttacaaaaccccattgtctcagcccaaaaactctttaagctgataagcaacttcagaaaaatctcaggatacaaaatcaatatggaaaaatcacaattgttcctatataccaacaatagacaaacagagagccaaatcataagtgaactcccattcacaattgctacaaagaaaataaaatacctagggatacaacttacaagggatgtgaaggatctcttcaaggagaactacaaaccactgctcaaggaaataagagaagacataaacaaatggaaaaacattccatgctcatggataggaagaatcaatatcgtgaaaatggcaatactgcccaaagtaatttatagattcaatgctgtccccatcaagctaccattgactttcttcacagaattaaaaaaaactactttaaatttctttttttttttaatttgagaaagtttcactcttgttgcccaagctggagtgcaatggtgtgatatcggctcactgcaacctctgccactcaggttcaagtgattctctagactcagacttcttgagtagctggaataacaggtgtgtgccaccacacctggctaattttttgtatttttagtagaaaaggggtttcaccatgttagccaagctggtctcgaactcctgacctcaggtgatctgctcgcctcagcctcccaaagtgctgggattacaggcatgagccaccatgtctgaccttaaatttcatatggaaccaaaaaagagtccatatagccaagacaatcctcagcaaaaagaacaaagctggaggcaccacactacctgacttcaaactataactacaaggtgacagtaaccaaaacagcatggtactggtaccaaaacagatatattgaccaatggaacagaacagagtcctcagaaataacaccacacatctacaaccatctgatctctgacaaaccagacaaaaataagcaatagggaaaggattccttatttaataaatggtgttggggaaactggctagccatatgcagaaaagagaaactggacccattccttacaccttatacaaaaattaactcaaggtgggttatagacttaaacctaaaacctaaaaccataaaaaccctagatgaaaacctaggcaatactatttaggacataggtatggacaaatacttcatgagtaaacaccaaaagcaatttcaacaaaagccaaaactgacaaatgggatctaattaaactaaagagcttctgcacagcaaaagaaactatcatcagagtgaacaggcaacctatagaatgggagaaaatttttgcaatgtatccatctgacaaagggctaatatacagaatctacaaggaacttaaacaaatttacaagaaaaaacaaacaacctcatcaaaaattgggtgaaggatatgaacagacacttctcaaaagaagacatgtatgcagccaacaaacatattgaaaaaagctcatcatcacttgtcattaggaaaatgcaaatcaaaaccacaatgatataccatctcatgtcagttagaatggcaatcataaaaagtcaggaaacaacagatgctggagaggatgtggagaaataggaacacttttacactgttggtgggagtgtaaattagttcaaccattgtggaagacagtgtggtgattcctcaaggatctagaaccagaaataccatttgatccagcaatctcattactgggtatatacccaagggattataaatcattctactataaagacatgtgcacatgtatgtttattgcagcactgtttacaacagcaaagacttggaaccaatccaaatgtccatcaatgatagactagataaagaaaatgtggcacatatacaccatggaatactatgcagccagaaaaagaatgagttcatgtcctttgctgggtgttgcaggaagtcagggatcccgaatggagggacctgctgaaggcatggcagaagaacagaaattgtgaagatttcatggacatttattagttccccaaattaatactcttataatttcctatgcctgtctttaatctcttaatcccgttatcttcgtaagctgaggatgtatgtcacctcaggaccctgtgatgattgcgttaactgcacaaattgttcataaagcatgtgtttgaacaatatgaaatctgggcaccttgaaagaagaacaggataacagtgatgttcagggaacaggggagataacgattaggtctgactgcctgggatctgggcaggacagagacatatttcccttattgcccaaaatgggtaagagaaatgtcgctgaattctttccccagtaaggaatattaataattaacagccctgggaaaagaatacattcccaggaggaagcctctaaaatggccgctctaggagtatctgccttatgcagttgcagataagagatgaaacatgccctagtctcctgcagtgcccccaggcttgctaggattaggaaattccagcctagtaaatcctagtcagatgggttctctgcccttgaaccgtgtttcctgctaagatgtttatcaatgactatgtgtgcccagtgggacatggaccctcattagcaattctggtttcacccagaacttgtgatatcactctgaccttctgctttgtgatattttattgcctttgaagcatgtgatctctgtgacccacaccctattagtacactccctcttttttgaactccataataaaaacttgctggttttgtggcctggggggcatcacggaacctgccgacatgtgatgcctcccccagacacccagctttaaaatttctcgcttttatactctttctctttatttctcagaccagctgacacttagggaaaatagaaaagaatctacattgaagtatcaggtgctggttcccctgagagctgggacatcaatgaagctggaaaccatcactctcagcaaactaacacaggaacagaaaaccaaacaccatacgttctcacttataagtgagagttgaacaatgagaatacatggatacaggaaggggaacatcacacacctgggcctgttggggggtggagggttaggggaggcataacattaggagaaatatctaatgttgatggcagtttgatggttgcagcaaaccaccaaggcatgtgtattcctatgtaacaaacctgcacattctgcacacgtatcccagaacttaaagtataataaaaaaattaaatataccaaaatataattttaaaaaggcttaagttaacaatttaatgcttaaattaaatgcaataaaaaggcaacttatcagaaaagtacctcagagtaatttggttatcacttgtaattctagacaatctttctttctagaaaaaatcaaatgaatattgatgatctgttacaattatttttggagatagttattcaacactaaacattgacttagaatgtttcaatgcaaaaagaataaggtgggatcctacgcttaaggagcttgcagtcttaaatggatacaaacaggcccttgtaataatagcctataagtactaagataaaagtaatcaggagttatggaaccataaaagaatagacattttcgctaccctgattttagagaaggcatcctggtggtgatgtcagaactgaatctcgaaaagtcaggatgcataatcttagaatagaaattcaaaatggacttctaggcagggggaaagacacactaaacagcacattgaatacagaaaaactctggaattcccagaacatctaaggtcgttgggatttggggcaattcttttgatggtgctggggatgtaaataaatgcctattcaagggggtcatatatgataggctactacagttgttggatttttgtttttttgtcaagctaaggggggatactttgtggatatccaaaaggcacttgacttacctatgtctagctttaaggagatcgatccagctgccatatacagatggatttaagagagtaatatggtaagcctatatgcaagactacaggaagtccagtcttataacttttctcatatactataaaatccttaaaaatgtagctgttttcactttctacatatttatttgacaaatacaattgtatatatttattatgtacaacatggtttgaaatatccatttagtttaaatgcagagacatttattcatttatgtatatattcagtcactcattcaacctacactatgtattaaagaactatgatgcactcaactctatgagaataatcacacagttgtgaaccaggccctccttcatgcacctcacgttacagggagagagacaaacaggaaacaacccaaacaagttgattatataatcatgaaacaactgctacaaaataaaagtatggggtgtcctgagggtgtatatttggggacttacaacattttgaggagtcatattagaaagtactgttttttatttttaaacgaattaaaggctcattaatacaagataatggaaggcatggtaaagacaaagcatgttaaaaatctggactaaacagcattttttaaagacattaaattgcatttctttcaaatgtatctaacaaccaaagtgttaacattttcttacaatcctataaatatgtttctatgaattgttaagaattattgtgaacaggttgtagcccttggtatgaaaatgatgctgctaagcaatttttaaagtaacttgaaacaggttctttttaggtagatttactgttttctgcactccaatctttttattttactgaagggcttaacaaatccttggtgatatgaaggcagcataatagccaaccgtttcccaaaataatgaggtttcattagaaactttttcctgcttaacaacaagtagaatattcccctaaagtggcattcaagacctttacaaagggaaataaaggaaagagaaaaaggaacaaattcttcccgattaggagactactgctgggaattgggtcagtgaatcctaggatatgagaaacacttatttacaggagagtctatttctctatgcaaaataataatatttttaaaaaatattattgattaattccaggaacaaacataatattgtacagaatgtcaactgtcaaggtccctgatccctaattgagtttattttactcattcctttttctgggagactggtaggtagaatggtataattatatcaatctaagaaaaaattctgaaaatcaaaaagaaatcagaaatagggaagccttagcataaaactatcattcagagctatacagatgtgaaaggacaagaaaatctcaggaccccagagtctttatgtcaaaaggaaaaattaagcttggaaactgagtctcaagcaaaaatctgcctttccttttgttactaaccagcaacaagatacaagaccacatgtctccccaggtagcttccttcaccctgacaatgtaaattaacagcttctctttgcaggtaagagacaaagataagactagaaatcatcccttgcccacccttgagaaaaatgcagatttactgagcatgacaatgcataaatgactgtttccctacaagcttcctttgcacatggattctgtaaaagctcattaaagcctcataggaatgtgtccccttatttcactacctactctactttctttgctttcctcttttcccctccttcccactcttttccctttatttattgaagatctcaagatcccctttggaaagcgtgtgaaccacagatcctactgtggcttgtgtctcattttcttgggcacatcctcaatcttgacaaaataaacctctaaattaattgagacttgtctcagacactcttcggtttacattgaacaaatacatttgtcctaaattatgtagacactggatggcaaaagaaaatgaatccatcctttatctgccacactgaaacaagttgaatgacacttaagaaacttttgatgcccataaacaggttaaagacttttcataacaggaactccaagaaataatttctttagcctaataagttgacaggcaaattagctgaatcagatctctcaaaattctaaataagaaaaaatacacaaaagctcatatttaagattgagaagtgaaatataaatgtcaaaatcagatgctgcattctgaaaagcacacagtgggcccacctggtaaatgtgaagggagtggtgaataaaagggaggggttgtgtggccatctggcaagcagatgtccaggataaaggagcacacttttgcttaaaatgttcacacatatctgaaccccaggccaagttttgcccgatcttccaatttttcaaagagaaactgagaatttggatgtttacatgaaatcttcgattttcaaatattgacaaatgatttaaaatatatcaacctataatagccaaataaatatgagctacttctggaatataaatcgttggtttgtaatgtctgattcatatattctttttgatgtgaaattaaaataagtaggttattatttcaatggagtaagagagctagaaaacataattgcaaactgatacttgagggacatgatggcagtgaaccatttcagtgcttctaatttacaaataggtagtgtttttctaacaaatagtttaaaaaataaaaatcacttaccaacttattaattttattctcttcctcaataccactttttagaatttttttgtaataattttagagtcacagagaagtaaaaattgtacagagagttcccatattctcttaacccagttcccttgaatgttaacatctcttacaaaatcatggtacatttgtcaaaactaagaaattacccttagtatactgctgtaccagtctttattggattttcgtcagttttatacatgttttttaaataatgcccttttctcttccaggatattgtaattatttcatatgtctgtttagtctccttcaatgcaaattaatattttgccaattgtcactttttttgtatgtgagattagtataaaaaatcagtaccttaataaaaccaatgtggaacaaggttgagcacgagtttctgagctggcaatgtttggggccagacactaaacaggctgaagtctctaaggtaatagtatgccacagagcccttggttaaatctgtctgcatcaccagtaagtatctttgtagttaaaattctcacagattccttttcaagactgtagttaacatcttaaaagtatgccacagggtgttttaacctggacacagtaaaacagtgctttagaagtcaagaaacagaaactgcactgagctattcaagatgccaagttatctccttactctatcttttcaaacaatgtacagaccttattctcagagcaaaatacaattgcagtatgtgagagtatcactctcagttttacaagtagtcaactaacccattagtatcaacccatgtgagtgataaaaaatagtgaacttcctacttttgcttcttctatgactcttagcagactaaaaatactagatagccttgtttgtgtttatgcagatttctcaattatcagattcatgtagggtttttcggcctccacactactgacattttggattagataattgttttgttatagagggatgtcttgtgcattgcagaatgcttagcaacattcctgtcttctacccaccagatgccagtggcacatcctttcccccacaattgagggggagttgtgacaatcaaacttgttcccagacattgccaaatgtctcccagctgtcagaatccagcccctttcccattaagagccactaatttagggggacatctttttttttttccacctaatctctttaatttttgcttatctcctttgtttctttttacttggtactttaccaaaaagtttgggtaaaagagaaattatgggaatcaagtataaacttcagcttccattgcagtgggaactgatcatattaaagctataatagatgattgtttttacactcaagaaagaaataaaaatgttgttagcataaattaaataccttttttttccaggaccttcttatcatttatctaattcctacaagtatttgaggattttattagttatgcctctggaaagctgtccctgagagacccaatcccagtccactctaagggtccctcccctgtgttctcattttgtttatctctaaaagctatcttattatgtacaaatatcttacttctactgccttttcttccttggtatactgtgagcctcttgaggacaattaccacatcttattcctgactggtccttgatttatcctgtaagcaatcagtaagtgtttactgagtgattgacagtcataggaaatgtcctgattaagataccaaactgggagatctgagatgccaagtagcagaatgacagtactgactctgtggaggtgaaacagaggagccttctaagaaagattgagctgcaatagtcatagagttggctaaatatatgtacacaaatagccagtatatatatatatatacatatatatatttacgatgaactatatgctactatagttgatgaactaatgccaatcacaaaataaaatatcatgaaatatttaaggtaatgctgtaagacttgccactgaaaaagttgtcaagctcttgaaatatatgtaattcctccatactaaaactactcctgacttcatgttcttttgtggatatgagattcaaaccctctctgaggccagagtctaagctttaaaaaacactgtgtaataaaagtttgctgtataaccacaattaatgacaatgatgctgggtttttgcttgtttgtttgtttactgctttattctcaatagcttgtgtagtcttcatatctatttagttgtacaaattatgtcaagaaagagattggcattctcaatgttcctttatggtcatgtgattggaggaacaaatttcttacttgtaagcacatctaacaatgaagagttcactatctgttcatcatcctaggaagacagagtttcactatgtctgggctgtcgagttaccccaggaaataaaggtcagtgatgaatcttttctgctaagaggtcactactatatgactatcttaaggcactgaaatacatgttcctaaatatttttagagaaatcacctctttttacatttattaaatagtaaatattctatattacccaatccgaaagatgtgacttccatatattcaaaatatcaggattctgtggttttacttgtttgtttttttctgatgttgatttaggataaacattaagagtaattttaaataaatctttaatataaatatcatagaaatttatctctgaaactctgaaaccaaattgcttagtaaaaaaattgtttgacattgtgtctgtacatgtgtaactcatatgtattcatttaatgacatatcaaatataaatgttaagtcatttttcttttttgccttttgaaatgtttcttctgtctttttctttttttttctttttctgaaaagaaaatgagcaaatttttaaagtctaaagaaggctagatcagttgtttgctcaaaatatgttcctgttatcttgtgtcgtagaattctttactttcaagcaattcctatcctgagaaatgtgctgaagtgttcaatgctatagtgtgaattagctgtgctatccctacagatgatggcaaacacaaatattcatagtgagggtgtactacatactagatattatttttagagctttgcctattttatagtatttaataatttagagcaaaacaacaaaacatagcacctgtgagataaatatagttgtcctattatattcttggagaactggtgccagaactccccttggataccaaaatctgaggatgctcaagttccttataaaatgtggtagtatttacatacaaatggtgcacactcccctgtataccttaaatcatctctagaatacttatataatgactgatacaatgtaaatgctatataaataattgttatactctcttggtttttaaatatgtattatttttattattacatattttttttcctgaaaatttttgatccatggttggttgaacttgcggatttggagggctgactgtatggtttaagtggaccttgagtgcatggtccaaatcttggctctactttcaagttgaccaaaatgagtcactgaatctctctgtacctcagtctcctcactggtaaaatgaggtaaaatagcacttcataggtttgttgagatcaaattaatttatacagttaaagctcacctatcatatagtaagcactgtataagtgtttgttgttacaattatttgtttttttttttttttgaatagtataaaagaatgtaactgggattagagaagttaaataactcacccatgctcatttgaacccaggacagctacaaaacaaagtccaagctcttatcttgtatgctataaatattcattcaatttttaacaattctggtttacttttgaggtaatctaatagagtattaaagaaaaaatattacaattagtcattgcagctctttttatctgcaacacgaatatatattaatgtaagtactattatgtaactacttatatacatttgtagtatgtgatttttttcatgtttaaacagataaaactatttcttattaacatgtcatttttaccaatatttagacacctttcttaattccctggtcctttaagagcaaagttttacaaatatgtaatgcataagttttttcacattttctgtgtattattttatagtatggatagtgcataccactttaaagatcatgtagcctgaaagaataaatggttgattacttaaactatttgatactagtctttatgcaaaaaaaaaaaacttgaatgatccaagaacttaggattgtcgtaaatttttcacagcatttagactatcacccaaaagatggtactaataaaataacatttatttagtccataaatcaactcagttagtattctacttggtaattaaatcctattagtcagtgaaaaatgtttacataatgccttcctgggtgggaagctgtccaacattattacttcctgcaataaaccacagcaaattgtttcaggaaatatttcccctacgtacatatataaccatagaacagaaacaacaacaaaaataacaaatataaatcttgggagaaattgtctttgatgtctattcctgagaaacatatcagtgatttcaccattccctggagattagcacaaacaatgtccttgaggtttagggaaataatctgaattccctttgggattatggccatacacagaaacaagtggaaatgaaacagagatgtttgctatccttgtgtttcctgtaggtcattctctagggacataaatttctgaatgttcctcaagcacggataatcgaatcattggactccaagcaaaaggttaagtggagattgataggatctggctaacgtaggcttaaagccaatggagtgctaggaggccccacaaaattacctgtcttagactacgttactcagaaactatgcatgaatcaaagacttatgtgtgaaggattttgctggtaatatgatctcaaggagcagcaatggggaacaggtgaggcgttgaaacaagcccggaatgtaggaaagccaatacatgcatgtgccatccaatgtgctaccactctgagtaattttagtttgattctacagaaacctccaatgaaacttgtaaaattcctctcagaaaaacagaggaaactgcagaagaaagaaagatgcatttatttgttcgttcatatcgctttgtaggttaagaattgactcataaaatatgagcacttgtgtaatttctgttagcgcctgtgtaaaggccactcacgttcacagatttttctttcccaggtgtcagagagtccatagggcaggaagcaagatgcagaagtctacagaggcatgatgaggtgcacctgcatgaaacttaactggtcaccacagcgttgactggaataagagatgaggccaagaggacttatggagtgtacaagagactttggacacactgattccctcattcaaatgctaatattaagacaaccaattaacaaacattgattccactggatatttttagaaagttaaatcatttagaaaatggtttgttttaaaactgaaagcaaatctctggtttgcaatattgtattctctaatgggaaaaaggaaagttaagcatgccctgggtttctctccaaaactttccccttgctgcccctacgtttttcacatttccttctaattcttataattgaaatgccaggaaaatcccctgctctatttctgtcccaaataatagatttagagagcaatgagatatcatcattaccctgatgatattcagctgtgccattcattgcctctggactcagatggcactcagcctccatgatcctttcagcagccaagtctggaggagagatgagctggcattcttccatatcattaaagacagagagacctggctaatatgcttgagaaacatcaagggacttgaaaaaaggaagtttgggctttatcaaatgaggtgattcacacagaccagcctagcattagtttatttctagatctcaagctgcccaagtatttccaggcagcacctatggaaatgtgtgtcttttgtcttcttgcaattaacttgaaacttacaagctatattcaatgatttcatgtctgcttgggaaaacttcaaattgaattaagagcaggcaaatttgaacttgggcggcggttatgttggtcctgtgaaacagaaaagttgggattcttcaaaagaaaaaaatgtatttttaacatattacagatgtaaactcattatacactttttaaagtaactttaaactagaataaatcaaatgaactaaaatcttactgactctaccctcccttcctacctccagacttgtaagacaatatatttaaagacaggttgtcaggagagaaatcctgataattggccttgagtgttccccatgtaagattcctatcttctgacatgccctgacaaacagccagatcatcactgctgaggaaacagagaagaaagttgccttcagaatgtgtttttatgtgtaatatatgtgaaatgaatatagttttaagaaaacacagaaaaaaagcacttgttaattattaaatgcacaatttttacagtgtcacagtagtatactgtattcagttttggcactaatggtttattttcccattaaaattcaacatcagggagaaataaaacatcagtgacattcttcccatcaaaatgcatcaagtgacaatagcattttaccatgtggttaaattgccactatctaagatagatgacagttctttcaatgattgccagcacttcttttagagggaatgataatgtctttgctataagtatctggcataaagagaaagaaaaaagtcttgatatgaggacagccattttagaaacatgaggtaacattactttttttcttaacctataatagatacaatttcatcctgatgccagaaacaatgccaagtaaaattctttttcattaaatgagtttacattgtaggaaaaatatgtcataagcatatgatacttcaggataagcccatgctactgcaggaggctcccgaattcaagatggtactcaatttccttaactacctgggaattctacaggtcagcttttaaaactccatgccctctttcaaacttctgtcatttttcactaaaaaagcataggctaaattcattttcactattcactattatgcgactttcactaatatgcgactttcatagatgctcactaaatattttctgaaagacaaaacctcagccatataacttgtttctcaatcttcagtcttatttaataggcatggcttttttgtgggaaaaatgtggaatgaaggaggtgagaaagttatagtataaatggagcagtcagttaatgttttgttcttcagaatttctgagagctaaggattgctacattgtcttattacttattcatataattaagaatagacatttatatttacaagattgcagttagctctcagatctctatgaaatacatacatctatacatattaatatttatatgtagtcttttaatagtcacattccatcagagagcaggatagtatgattattctcatttttacatcaagagaatttgttccaaagccacacgacagacctcctgggacttgtaacatccaatccaatagcttttcctttagtctcactactcgatgtgtgatctgcagcagttgtcgcatcacctggaagcctgatagaaatgcgaagtctaggttcttactgagtttcactgagccagaaccgcctttgaattccccaagtgataactctgcacattcaatcttgagcagcactgcactctgccatagagcctccttcacaacgagctgcccagcaatcaatcaattcatcaagattattgataggaaatatttctcacccacagtttatacctagtacttttagctttatcatccaacatgagaaatactttaactgggcagatgttttttggagacagctctagcagagtggctgttcttcaaatgctatgaagcttgaagggagagggttctgattttccaggtatcaggttctatctaggcctagttcattcatttagcatggttctgccctctttcctcatgaaacaggaactaaaaaggactaagttaattcagtttaaccaggcaaaatgtcaggttgtatgacattttcagacttgctactaagtcaaaaatttgatgtacatgtaacaactgtataaaatgggtttatttctgttttatacattaggaaactgaggcttatatataatttgtctatagtcatatacatagattgtagaataggaaattaaatctccatatatctgaccccagtctgttctcttaaccaagaggctactctaactccctaaattaaggtgagcctgtgtgcacgtgtgtgtgtatgtgtgtgtgtgtaaatgtgttatcttcagggcagaaaatgtgggaatataaaattatgtatactacaaaagtcttatgatctttatccatctgggattgtagatgtttattaaatatgaatgaatactatatgtattaacttctatctcctctgttaattattattattagaaatccatgtatttgtttatattttccattaattttgtacatgtattactaagtattctctcccttattgccattcccaggaatatattattttttgttggtgtagttgagcaaatgtgatcacaggccaagaatgttttcaaatatttgcttatataattatcacaattaacacatataaaaaattgttccttttttttcaaagattgtatattcaataactctatagaaagatgaattaaaagccttgagttttaattccaactttgctatactttatgggaccttaatatgaaactgaacattaatgaatctcattgccatttttggaaaataggggtaattatgccttgttgaaaaataatttattatggtatcaaaccaacaaatgagtcctacatatatgaagttttactgcccttcaataaaaggaagaatacaggtagttttttaaaagaagtagatactgaaatttgatttatatattatgggaaagtgctttatggaaacatcaacacctactgccagcacttttgtacttactgttctcactgcttgcttggaatacagcttcctcagatatgtgcatattttctgtcttcaattcacaacactacttaaatggcatctcagagaggacttccctggccatcacatccacaacagcaggctgttttttattccctcagtttttcttcacagtacttaacctgcaatttttctctattcctagttcagtatttgtttattttgtgttgcctaccttagaatgcgagctctataaaaataagaactttggctgctttgttaaccattcaatctccagagcccagaatcgtaactggcaaagagcagatttagagcaattgtttgttgaataaatgaatagataaattaagtcaatatatagctataggcaaagaatgaataataatggcactattagtactgctgttgctgctgctgctactactactactataacaacaacaactactactactactacaaaactactactactactacaactactactactactactactatcagcttaataattgggtttttactatgtaccaggcactgtatgcattatcttaacaaactctcacaacaacctgtggcagtagatataattacctacatttcccaaataaggaaattaaagttttagttagattcaatgtacagcaaagattgagaatcaatgactagattaagtcattgattacctggtaacattggaattacctggtaaaccttttaaagtattggtacacaggttccaatctcagagttctgatttaagtgcaattcccaacaataatgcaattaaattaaaacatctagggatgggaacaggatatcagtatttttaaaaactcattgttctaaagtacagccaccattgagaaccactcactggcttagataaagtaactaacttcctccaggtcacttggtcaggaagtggtggagcagagatttaatccctgtttctctgacttcttcccaatccttcctccatattttgcatattctctgaggcagactctctggtatttgagtgccttaccaactgcaatattgctaactgtgactttgagataatacggttttatttctaatagtgtgattttaaattttgtgttcttcttacattcagtttagtttccttacatgcaagaacctgatggtaattattgctttctgttcctgtgtactgtacaagtacaagtacaagtgggtttacaaagtaatatacagaaagaacagtatactcttccaatggatatgaaaggtcaaggcctgaaaacaattttgtaactatcataataatttttaaaggagcagaaatgggctacaaaggcactgtgttgtaacttgataaaataaataagagagactcccagggtaaaatacattggatttaaagccaagtctaaatcctaaaaaccaaacaaacaaacaaacaagaaacacaacaaagggtttctgtaatatcaaacttgggtttgttttgaaaatagatgatttcagaaatttttacttaccacttcaagttccaagagatcatcatacctccaaatgtaaaaaatgcttttcaggattatagcctcaactgtgagagattcatttgtatcagcatatagacccagatggcattgaaatggtgcattacaaagtggtaaatgatgcaagctctgaagtgaagaagagtggaatgtgaaacccatcttgtcacgtttagttgtgtgtcacagggtgagcactctaaattccttgagactgtggcaattaataattgccacaacagattagtataaaaataaaagataatatagacaaaaatattagtataatatctgatttatagtactcaatatttcattgctggagatttgagactaaattccttgagacttatatgtttaagtctcatctcaatagaaaatgaaattaataattgacacaacagagtactgtgaaaataagagataatatagacagaaatattagtataatatctgatatatataattcaatattttgttgctatttttagtaatcaaatacgcaaccttctaaaattaagacggatttagatgcatggaatgaatttatgtagcataagtccatacaggtatgtctattcatgttacttgctactactaatgtattaattgcttggaaaataaccagtaatttgaggagtttataatttagctggaaaattaaaagacataaagagaattgaaaaaaaaacacacacacaagatatcacattgatagtatttatcatagataagcaatcactaacactggaatggataataaatgccagtggagtttggaagaggaagtaatcactttttgctagaatggaaaagaaaggctcatggatgagagtttgacttagaaggctataaggctaagtaatgtctacacattcctcttatttgtcccttcatttattcagtaactttttattgaatgcttactgcctttcactccctctttttgagacagtctggtgatataacagtcaacaaaactcatgccatgtctgaccacgcagagtttatatactaatgagagatatcagcaaacaaatggtatataagctatatatatattataaaagcataattattttaaaaaataatgtgttgcagaaattttttaaagggcaaaacgaataattagaataggtagatatttcagcaatgacggtaagtggagcctgaatagataaattaatgaattataggaacctgatatgtaaatatttctgggaaaattgttccagaaagaggaaagcccaaagcaaaattctgagaaaaaatataagctgatttattctaggaaaaacaagaaaaatgatcacatgtgcagaatattctgagtaaggctgaaaaataattttaaaatacacataaaggaaagaaaatgaataggtggatgtaagatggctgccaaagtggacttggttatacctggcaattgaatgggattggtgctgagcgaggggaatcaaagacaaatccaagagactgaacagaaaagatttttcccgaaatatttcaagaaaaggagcaactttgaggaaaaataaagtgttaatgttaaacaacttaaattgaagatgatggtgagacatcctagagacaacaagcagctggagatactaatacttagaagagcggtcaaggttagatgggttttaggagtcaatagtttgcaagtgataaagtcctgaaaaaggagataatgcaaaacagatgctaagagagtaagaaaaagcagaagaagaaaaagtaggttttgtttgtttgtttgttttttccaaatctagtctttttattgtttcctttctcaataatgaaatcatctttcagtgagttatctgtactggttttaaacatgtccacatattctttgacactccttccattgatttcaggctaactttatcaatttgttcccagtgaatgtgatgtggtgaagtgatgctgaataatttccaaggtgaagtcataaaaggctccagagcttttacttggagtttgcctttgaatctagccactgtcttataaagaagtctaacacctacatagaaagtccacatgtgggtgttctggccacaactctaacatatcccagcatcagccagcatcaactccaggcctgagaataagagaaacttgagacgattccagctcccagctttggagctgcccgatagatatgaagtgataaaaagatgagcaatttctgcccagccttgaccaaatcacagatatctgagaaaaataaatattgttgatgcttagactaccaagttttgagatgatttgttacatagccatagataattggaacatggtgtaagcaagaaattcagaagtaatttatgataccaaattttcttttacccagtaccaccttatttaatccatcaccaaatcttatagattcttttcctactatagagtctctgaaattcatttagttttctccatttccaccaccactacaacaatacaagttatcacaatttcttgtctggacaatgtttggtttcattctttatattccatccatgtattttgtttccatttatatttattccattacactttccacttatatttggttccattcctcatactacatccagttatattttgaaaatgcaaatctgaatatatatatccatagcctctataaaaaacaatgacttctcattgctcttagaataaaaacaagcttccataccttggcctataaaaacctgcctcatctgtctcttcttgcctctacaggctattccaaagaaattatttaatctttaccctctacctcctctggctttctaatttcttcacccctgttcctccagctgcagattttgcacatactactttctctgtctgaaagtttttctctcctttctttgcataccttttagtcatctttgaactgtcactttagtcattgtttgatcagataaatcttcccatttcaaacaaatcccccatgtaatatttttatagagccaaacgctgctgctccttaggacttcattatttttataaaactgcacttacgtatgcatgcatgtgtgtgcttgtcttttcacccttctcattcagtaggttcaatgagaacagagaccatgtccattatttgtcaatgttttattcccagaacatactctagtgccagacacagaatgcactcaatatatatttgtggaataaattaattaagaacatataaagacattttattcatcattataggaggaaatcattactctaagagtgaaggaagtgaagggagaagggaaatagtctagatatctacctgtatgattctatttgttcctgccctattgattacattcccttactgattaatcttgagcctcagctgataaagaactcagaaaactgggcaatatagtaaataatctcccagattaattttaacctaagtatcaacaggttaaaatgttactctttaggaaaagtggtatttctatcgagaactccctaaaatactatttctctctctctctctctctctctctctctctgtgtgtgtgtgtgtgtgtgtgtgtgtgtgtgtgtgtaggggaagtcgtggtaagaagagataaaagagtgaaaaaaataggcataaagcgggaggaaaaagtgaaagacaaaatactctctaactttaaatacaatataaaaggactactaagtaaatgcagtaggaaatattatttttgttataatctaaccttcaggttttattattattgttgttattagaaggctaacagactggtctcctttttaatgatttattcacaaataacaaaatggaggtttcaagttaaaagaaaagtatgtcccgctgtctttatatttgccaaccagattatttgttatacgtatagaaatacttccataagtataaattattatttccttactgctgtgcccaaatgacattacactaatattttaagcaagcttccaatgttaaatagcttcataaatttacaatgtctaataaaaaccaacaggagaaaagtattaaggatactagtcacatcctttctagtgcttgaagatagtgatattggtggactgatttcaaagaatgtccttcttatgcctgaataattcagtttctctaccagtaatataattatgcttagcttgctgattagattgtatttctgttgcttttgcattcataaaatttatcacataatatgcattatggttttcatttgtattcacggttctcaagcccaatttttatgttacttgggcataaaagacttttgttagatattagtactctagtaaattattttgctttttagtaaatggacgctatatttaacttcatttacttcttattttgtataatttgaatgatagagtttaaaagtaatgcaataacaataaaatgtataaacttaatagtagtgcttattttcacatagtaaacaaatttgacattgggtttcaatattaaaataaaataaaattcaaaacataacaaatatatatatgcatgtatatacatatatgtttgtgcatgcacaccaacatgtattttcatacaaaattacagaaaaattttatttttaaaatcacagtatgttttatctttttatcacacataaaattataagatgatcattataagaagatatgctgcatttttttctttgtcacaaatccccaaatctttgttggacaacaccaagggaaactgcagaagacataaaattgaaactttggttttactaatttatactgctcttattgtgtaacctgcaaagtttacattactaactcttcaaataattcatcttggtaaagtgaatagaacttgctcttgaaaatgagtgacacaaatgcataagatcaatgagcttaatttcaatttcttatacaaataagccacaactcggacatgtacaccatgaaatgtttaaaatattatagaattgccaaagttttaaatccttaattttaatgcattgtgtgccttaagtctattcctacttcagtactttcatataacctctaataacctgaacactaatcttacaattgtcccagactatgcagaaactaatagaatttttgattcttcatttactagttagtggggcagaaaaaaggcattcatggctctacccttatagaaatctaagtatccagaactaaactgtgaaattatcatattggtctatatcttttgaaaaaataataatcagattggcctaaaatatgtgcatataggcacattttcacattgatattttcaaaagttattttcattctaagcattttagtttttaatattctaaagcattcactaaagacttcttactatatattttctatatatatatatatagaaatatactatatatattttgggttaggtatctataccaacctaacccaaaattttgcttgtctattttatatatatatatatatatatatatatatatatgtatatacatatatgtgtacgcaaatacatacacacacacacacacacacacacacacacgtatatagccatcataacaggtatgctacaggtatgctcattctccttcaggtagggacatttctcaacaatctggcagtcaatctcaagtgcacaatgtacgaacaaccagtgtcatatatatatatatgtatatatatggagagagagagagagagtcagagagagagagacttatatatatcttctgattagttttgtcgcttaacaggattattgtatgacattatttttatttgttagaataaagtaccttcaatttggaaagttgtaatgtttactaaagtaaagtatactgatttcttatttgtaattccttttctctctattttctctgacttgctacaagtggacacattttttccaatcattctattagtaacactttctctgtgctcatgggcaggaaataggtaaattgccttctagagccatcagggcagtcctgacccatggaatcatagcaggctgctgaggaggaatttagtgcccttgggattcagtaggctatttgcaagctcttgggagacaattctccattggtctcttgtgtgtatatatttccacatgcaaagccatttgttctggactagtttttcaagaatgtttgtatagaaaacatccttagtagagaaaatgacagaggcatttaaattttggaagatgagatgtgtctctctctagagtctggagcaataggacaggcataatatagtgcctgccctttataaaatatttgagtcctctaagctcagtcctctcttgtaattcatagtatgtgcaactgataccttgttctcttcatgtgatactgtggaagttgggggtcaaggaagtggcactgaggctaatactgtggctatctttagtgctgggagtaaactgtgacccaggcaccttttgactaccactggcatccataaaactgtggcagtctaaattgttaacttgcaagtatggtaaaatatcagacactttatagtccataacaaatttgtttatgaagatgggatgctgacagagaaaaagctctttaaaagaagaagaatgagggtctcacaggccaactaatgggattttagaaatgtctctggaaatcagtggcaactacatggaccaaatttaatggtcaaccaggcaataaatggtcctccactttattgctgttaatgaggagatattaggtagaggcttctggctgagtattataaggtagaatcagagatagccatcctaacaggtacattaattctccttaagatagggatacttctcaacagtctggcagtcagtctcaggtgcacactgtagtaataaccagtattaacatttttactggagagaggtggcagaagtttctacttggtttcagacaagttatggtgaaggttatgtatactaagaatataagaaatatatttcataaagaaaaataatggccactatggtaagaagccaggcaaattgtgagaattttgacttttgcttcagatatgaggggcagtgagattaatacttgataaggaaacatgacaattgcaggaccatcttatgactcaaactcttttgcagtgtgttatggcaatcataggtccatttaaatacaacattaaaagatcttacaattttgtcagtgggtccaggctgctacagtggtgctttggccctttttggaagatttcactgaacaatctcccatgagaaactagaaatgaaacattttctaatagttaggcttttactaccccagactgagtttacaattctgacaaagttgacctactactggaggatgagaaactgactgaagtacctagaaaaattcttgaaatccgccattgtactgctcaaaactgaaagtaaatacacatggctctgtccctccataaacggagaataaaaccattctctccttccatatttcctgattccttccttctcccacttaaatgatctcatctactttaaagacaaggatgatcagggatgggactgaagtctttctgatccccagtggagaccaaagaccattctcagctgtctttgctggaaatatcctgggaaatttagtagacaggatagttcaaacttttatgactctattagatacaggcacctcagttaccattctacccaatcttgtgggacactggattctcaaatcaaattgatggggttcgggtaaagttcaaaatggggaagaggagttaatgaggccttgtaggaagagcctttcagcaaattccatgtaacattgttgaagattctacttttcaataataattagtagtcatatattacatgcttgtattgtgaatgcccatataatgtcaaagaaattctcccaagtgagaagatcatccagtagaaaagtactattaccttttcaaccccatgaccttgatgacttttttgagctataagtgtctgtgactaatggttttacccactgggcttctggcaaaaggagacagcctttatctaggtgtcccaaacttgtcagtggcaagactaccaagcacactgtttttcaaaagcagctatgtttaacacagctcttgttaaatcccagtgtctgacccatagttattgtgactccctagcttgatatgatcaaagggtaggtcaacttggatttattgattaataaggggaggagggttcaaggccgtgcttgtcaaatggaaatggcattttcaaaatgcatccagcccagtcccaagggcatctcagctttacgttttaaaaaatggcagcttttcctttgaggagaaaatttatcttctactctgctatctggtgcagtggcccctcagttcatagagatacttctaaatatatgaacctggtttgatgaaggtacccaatggtctgctgtggctgttcaagctcagcgttagtcatgttaaaactaacatgaacctggtcactatacgcactgggcagaattcattcttatatctctggtcaatacccctcttgatgagccttatggatttactgactcttggattgttgtcaataatctagcagtttagtctgccacgtgaaaactacggatttaatacagtccaaaagtgattgacctattgtcacaaaaagcattcaaaaatgggttgatagtcaaagcattctatgaacctctatgttctctaccatgcataagcattgagagttgttgagagttggaatgaactcaagaatttctaaatctacttcacccacttcttctgacccacaaagctttgtaaggtagtttggtcattgaatgagactatctccagaagggaatcattgcttctcagctactttccaggtaatgatgaaatggttgaggcatatatcagcctattttgcaaatttaagatgtctttgaccgtttctgagcattatgtgtctttctttccctaacggcaaccacagtcattcttgatacaacatctgggtggcagtcttggcaaaaaaaaaaaaaaaaaaaaaaaagaaaagaaaacatggcctaggagattcaaatttaattcttctttagtgatctaatatttttgttattgttgttggactcaaatattgctagattctaaagataattatcatttggttgagattcctgagaccctttatagcagctaacatgggctaaagtaaaggacataataagtcattgtaagttttacaaaaattcccttgttccctaaaacatttgaataaaatgttccgaaaagagtataagatgactggagacaaggtggagttattattattagaatgggacacactaatttcatggtggcgaagggggatcaacaaccctggcatgaggggatagaggttaccataagacctcagggagtatggggaagggagaaatgttaataatttttgttttttcagaattacccctggagccttttttttaagaagaaaaaactctggtgtgggattcctaaacttttacaaacactgtaaatttaacttattgataggtctctcatcacctgctggatgtctctgactgatttgaacacaatcgtccttattcttactaataagcttacgggaaacagtaggaaatgactcaaacttctacatttccaaagtaaaacacttgttcacacctctagatattttttctacctttattccgaaagctgtcactctgtcattccacgaggtaaacaaatgccaactttctagttggatgtacaaataagacagagtcccttcccaaacaaagaccagattcaatcattaaaactgaattgggaaactcacagttttctagccatttgggaggcactttgaaggcactgtaaacttgagtgccctggctgatgtaggtccttcttaagaataggggtccataattttaaacatttaaacaatgctttttcccccccagagacatgatgtttagctgggaactgtccttatgtggaaaatagatattaactaggctgtcttcccaaaatatggtgacattcaccttagatgtatcaataaaagacattcaagatctattgtacagcgcggtgactatggttaatgatgatatattgtattcttggaaaatactaagacagtgaatgttaaaagttcttatcacaaaataatgttagataatacattttataaatagctagatttaaccattccacagtgtatacttactttaaaacatcatcttgtacatgacaaatacatacaattttgtctgttgatttaaaacaaataaatacatttgaaaaaaggtttaagataacaatacctataggtcataaagcctttagatgactaaggagatcttgccaatatgaggctaccatgcttacttaggagagctactgggagggaagctgattcattatttatgaggaccttgaaggtggttatcctatgataataagagcaattggattagaaaagatgttataaagttagtctctgatttattagctgaagtgatcaatgatgccacctcggttctggaaggcactgatgccacctcagttctgaccttaaggtcagcctcaacttactggccagggttgttttagatgatagaattgccctagattttcatcttgtgagccaaggcaatagttaatgcatcctaaagtatctacattaaagatttgggacaagtgcaaagaacaatataaaaaccaaaggaaaaagccacctgcctctctaaagtagacactgatgttgatgtaatttgttctgcaagttgagtctggatgcctggtgattggcctcattctgcagttaggattcctgttgataatgatcttaattaaatgttgtatgataaaaatggaatggatttggttccagcctatgacattcagattaatcaaagtatctgattaatgggaattctcataagaaaatacatcagaaagtttagattgatgagaaatagcaaaataaagatatatggtagacagtgcccttagcttatgatgttttgggaaaggctacagtgtgaataacattttagtttcaattacctctatcatagttcttaacatagtcggccttatgttcattttgtttaattggtcacaaatcaatttattagacaaacagatttttattaaacatatactatgtgtatatatatatatatacacacacacacacacacatatatatcaaaagtcaatatgttatggatgttaggggtgggtattgttaggaggcaatcctccatgtgtttcttgtggttgtgcacatctttcaagcaaagacattgactgcttttgttctggaatatctttttaaggttgttcttacatcaaacagcactggaattcagggacagttgttctttccaaagcaaaacacaaatttattttacaattttggaagatggagatagtgtctccctccagagcaaagatgtgggcaatgcttaccatcaattataaaagatttcaactctttatggccaaggtttctttcctataatgcaacttactatatatgagaatccgatacttggtcctatccctttgggaactggggctcagcaaagtggcaccaatgcttatattctggctactacttttgttgtgagtagtaaagtatgcttcgtctctgacctacgagtctttggacttctgctagcatctgtgaaaatgtggcaagctgtatggactgaatgtttgcattcctcctaaattcatatgttgatgtcaaatacccaatgtgatagcatgaatggcgcgagtctttgggaggtaattagatcatatgggtgagttcacatgaatgagattcatgcttttaaaaggccagagagctagctcttcctctttttactatgtgaatatataaaaagaagtcagctgtctgcaacttagaaaagggccctcaatgcaatccaaccatgctggcattctgatctcaaacttccagcctccagaactgtgagaaagaaacatttcttctttaagacaccgaatctatggctatttagtatagaattccaactaagacactgtgagtcttagttgcaagtctggtaaaatctcagaccctcacagttctagatacgtacctctaacaatcctatgaagtattcatgggagttcacaaggctgcaacagaatgactactgtttacatcattagaacccccatcaggcagtgcatcaaaaacttcaccccaaaaaacaacccatataacttttcatgttttcatgaaattaaacctctataaaagctgagaaccctcaacttcttcaaaaaagcaagcaagcaaccaaccaaccaaaaaaacgtctctaataattggaaaaggagacaactgccctttgtatttcttacctatttttttctagccactgtcaacaactagggataagcatcacttaaggtttgggccagtgcaataaggtaggaaaattacacggcagcaacacagtttaagattaaatattagatcttccttttctcataaatctttttttcacctcacctaaggattcctcactagctatcatctcccaaggtttcagcctctttccatattgctcaatattccaataactttaaaaagttttccactgctcctcatcccctaaattcaaattctttcactgatcaacctttttgtttgtctttaatcttccatattacaaccatagggtttgcacattcagatgtaaaactgcctttttcaaagctagttaatgtgtgaatgaattgtaacctcaaaccatctagggtacgctgctgaattataacgaagtatgtcaatgtgtatcataatgtttgactataaagaaaataaaagatgaaactgtgaatacttacctaccaaatagttattttttaaatttgtggagaaactactggttttaaaaaggaaggaagaacttttcaaaggaatgactcagaaaagacaaatcagaaaagggaaaagttaattcaggaaaattctttagacaaaatccataagtactgctgagttagggtttaggtggcacagaaaagaatagtccctatctaagaaggccaaacatcttatgtatgctgggactgacagtcttatttccaagtaattttataagagccataaacttcacgtgaacttttgaaaagctgaactgaaattcatcatattcgtagtttgtatatactgcactcttcagtgttttgtgctctttaattcagtacggtatagtgaaaataacatagagctggaaatcacacacattttgggttgaatcccagttccagcacatataaaagctgtgttctcttgggcaatttacttgacgtgttttctcatctataaaattatagcattaattacttgtagtcagtacaattactactacagaaaagaaattaaagaaaaatttaatatatattacaaataaacagtaaaggagactgaactcaggtcctcttaagtctgggcttcttttcactaaaggggcatgttgggaggaaatattaaccatggtcatatctacctatttagaacagtgtttatgattggaactaagaagaaataaagttataaaaaaagttcagagtcaatttttagaggctccaaaatgccaggttaacaatttttgagttgaatgatatagcaatgaattatctgcagaatagaaaaagtaatgttttaaagtaagcatattctatgatactagtgatatgtaaatcaaatgtgagaaggaatgaactggagatgagaatagttacatgattattgaaacaacacagcccacaccagcatcattcaaaattttcagctagatgagatttttttggtagctatgttacatactacatttctacttttaatgataaacaaaaaacatgataatattagagattctgccaagttctgtagttaaagtaatacagcaaatcatctatttgtctgactaccattgaataccttttctaccaaatttattcattattaatattcaaatagaactttaggaaatactagcttaacgtatttcatattcctaaatcttttaggctttagacagcttggcaatgttattagaagggtatatcctgtatttaatattcaatctgggtcatatgtgtatacatacatgtctttaaaatcatagaccctcagtaaagtctctatattacaacttcagtttccttaaatgtctttctttaaataagttctttatgactctagtcatttagcacttgaaagtaagagtggcttatatctttataactttgtagctgcaattcaatatctgttctataatttgtttgaaactgctctcttaaaattctaaatacactctctggcaatgttcactattgtctttcttagttattgtaattctaaaatgagctgatcacattcctcccaggttttaacttcatcagacaattttgccttaatgaggaaaaaaataggttcacaatagccagtattgttattacttcctgtgacagaaaatagtaaacagggtaaactttttgaaaagtcaaatgtggtctttggtattcatagcccagaataaatgctaatatgtattattaataaatatttttatggtcatgaaaatgaagaaaattggagtcatttaataaagatttcacaaaagtttttctcagcatggtctttatgatgttttattgttctttttaaaatactcttaaacaggcaggaaaaataacctgtgtcctccttgcataatttagaaataaactttagctagaagacaacaaagtaaatacaaataatggtaagtgagaagattttcagaagtcatttctatagtcttaatggaaagccatttttgctttatgttttttatatctaaaggttttcttgtctttttttttccctcagaatttagtagaaatatctaggagatgtgagacatattaatggttaaagtaacaatattagaacatccaaagtgtttattttcagaataaatatatacttgtaaatcctactaaatatgaatatttatcattcaaacactgaaataaaagtttacccaaaatcaagcacataaacataaacttatattaactccaaattggttcagagcatcgttttttcagatgagaaacacaagaagtcatccaagatgtctcctttttccttgccccaaactaaaaaaatatgtactagtaaaataacacttaaaaatctgtcataaatattggccttaacaatgtaacagaagtgtaaaattttaaacacatattttttttaaaaaatcaaataatcgaaataagccactaaagcaaatattgcataagttacattatcagtagataataacatacaaaaggaaagggatgtataaaagcaacgaatatgttgaaatgttgatacttttgacaaactttaaaaaaaattcatgcttcataaaggcatatttggttatttaattttcttctcaaaattatttcgatgctgcaaacctacatttgtcgtgtcttatttccttggaataaataagctaaagatggctgaaaagggacagtgggagtgcaaatgaagtgcagttcatttagttctgacctcatttcatttcttcccaagaaacacttatctcagaagtaaatcggtgccatttccagctcgtaatacatgataagtatgaaaatgagttcatctttgaaatttaacatgcaaatttatattactttcagtatctggattaagtccggttagaagaggaaatcatgagctgctgcttcaactcagtgacctcactgcatcaaacttccactttgccactctgtagaacaaggatatgatatgtgtaattaaatgtcccaatcagcctgccagtgagtacgttacggttcatgaataagggagagactccctaagaaaacagagtgtcattttaagttgttttcgggatcctcagtgcagttaaattgaccaatttatcacagagagaaatatattaactgaattatcctccagagactttgatttaattaacctaggatgggagttaggcatggatttttcttttaaaagctctccaggtgattttcacgtgcagccagggatggggatcactgagctaaatgaaaccctcaggataagatcctgtttctcagtggctgcttggtgacttccctgacctccctattcataaaaatttcagtttcatccaatttcatcacagaactgctgggtttcttccttcctcagataactgtacctactttacagaaaaaaataggggtagagggttctgccatttgagaatgatgccttcttccatttccccctacaaaaacattataccttcatcggctccttcctcagggtctttcacctcaagggagagtatgtgtcaatttttatccaagggcaatgctatcccctctattctgaatctcagattcttaacctcctaggactgtaatgttacaattggctcagatctcacctgtattttcaacttctctcaagcattgtatctttgtcctcattacttcagtctctcacatcttaaaaacaatctttcctcattgcatgtccttttccgtctacaaacctagctagctcttgcctttgcttcagaggcaagcttccacttttcacataaagcctcagttttttcacctcattatttctcaattattagccatgtggcttatacatcactaattccagtgaaaacgattttacccaggtcactggtggcctcttggttgttgaatttaatttattttcctgaccattttgcagcatttcacaatgttgatcacatctgatttataaaatatctccttgctgtggtatcatgacaccattctctctggttatgaatctttgcttctagctgctcctattttagtctttcacaggctcaacttcatcctcctattcctcatattgttgttccctcaattcacttctgtttcaactcttctctacattttcttatcattcacttaatctaaagtcatattactttttacctaaattactgaactagtcttcaaactggatacaattcttagtcttgtctctctcaaaccatatgacatcttccttcttttatattttatttcattcatttactttaaaatatctccagcttattaagatacaattgacaaataaaaaatgtatatatgatattttgatatttgtctacttgtgaaaaattaaatcaagctaattaatatacccatcacctcacatacttttgtgtggcgaaaacatttaaaatttactctcttagtaaatgccaagcatgcagtatattattactagttatagtcatcaggctcaactttttagattccacatgtaagtgagatcatacaatgtttgtctttgtgcctggcttatctcacttagcagactctcctccgggttcatctatgttgtcacatataataacatttccttcttttttaaggctgaattgtattccattgtgtgtgtgtgtgtacatatatatgtgtgtgtgtgtgtgtgtgtgtgtgtatttatgtgtaatgtatatatttagttaattgttatgtatgtattatgttatatataattatgtattatattatgtatacattataatatatttagttaattgttatgtatataaaatataattatgttatatattatatatgttatgtaatataacatatatacattatatataaaataaatataagatatatccattatgtataacattatgagaagaatattaaataaccaaatatatctttatgaggcatgaattttttcaagtttgtcaaaggtatcaacatttcaacatatttattgcttttataccttcctttcctgtcatatgttatcatctactgataatctaatatgcaatatttgctttagtggcttatttcaattatttgatttttttaagatcaaggagttttatatatatatatataacataacatatatccattatatataaaacaatggatgattcttcatttggtcatccattaatggatgacacttaggttgattacatatcttggctactgtgaataattcagcaatgaatatgggaatgtagatatgtcttggacatactgctttcatttttttttggataaatatctagtagcgggattgctggatcatatggtaattctatttttatttttttcaggaatctgcatactatttttcataatggctgtactaatttacattcttactaacagtatatacagattctcttttctccatatcctcaccaatacttaactcttatatttttgatgataggcaacctaacagatgtgaggtgataccgtttcaattaatggtactgggaaaactgcatatccacatgtagaagaagaaaattggacctttatttcacatctcatacaggaatgaatttcaaatggattaaatagttaaataaagacctgaaagtataaaactatttaaaaaacatagagaaaactaatgtctctctgacattagtgtggcagcgatttcctgtatatgaccccaaaagcataggcaacaaaagcaaaaacagacaaatggcattgcatcaaactaaagagcttctgcacggcaaaggaagcaatcaacagggtgaagagacaacatatgaagtgagagaaattatttgtaaaccatatacctgataaaggccttatgtccaaaatatatgaggaattaaaacatcttaatggcaagaaaacaactcaattaagaatggacaaatgattgagtagacatttctcaaaagaagacatacaaatggccaacaggtatatggaaaaaaaatgttcatactccattttctaaaacataatggtccctaatattttaagcctttgcccacggggctccctcaatctggtgtaatctgcacatccaccattgttctcatcattagccttgtttactgcatcttcagggttcaactcaggtacttttttctgtggacgccttccttaacaatccctagtaccctagagcagtggtccccaaccttttaggcaccagggactggtttggtggaagataattattccatggactcgggggaggagtggtatggtttcaggatgattcaagcacattatatttatcattagattctcataaggagcatgcaaactagatccctcacatgcacagttcacaatagggttcacgctcctatgacaatctaatgctgctgctcatctgacaggaggtggagctcaagtggtaatgcccacttgcccgctgttcacctcctgctgtgtgagcctggttccttacagtccacagaccacaacaggtctgtgctgggaggcttagaggagcactccttttttgtatagctcttagcatagaatttacaataaactattgtaattatatactaacttttaaaactcttggcgcccacccttgagagtaaattcattgcaggtagagatttttcccatcctcaataagtttatgctcctccacatttcactcacccctctccctctgtttttctttttttttctcctctctctctctccttctttctctctccctctacggttcctttcatcaccctgtggctttatacttagttgtctctatctttaatgtcttacatttttcaatctctatgtctgtctttctttctgtcctttttgaatccctgcttatccttttctataaaaatttttgtactcttctaggcagagtggttccttaatcgtctttgaacggaatgcaccatattcatttttctgcagtagctcttattgtgatatatagtaatgcatactttttcgttgctgtttttcccactggagtagcccattgatctctttgaggagaaaaattcatcttttccctccccttacctaataattaccacaaaatatcaatgttattaaataaacaaaagaatgatttccaaaataagggaataatatataataataataacctcagagataaaatgaccaagtggtattttcatgtccaatgaaatttatttcccaaagggtaatactatcatttctgtcttctgtctttcctttgttttgaattgtctttatgacaaatattgactgtgcaaccatgcctctgttgctttagggatgttctctggttgttttattttgaatgtactgtgttttcaatgagataatacatttcttaacggcataatttgttcagttctgctctgtgcttcttacattgtgtctagcatagtggtaaacaaaacatccattcattcaaatattagtgagtatctgccatgtgccaggcattgctatttgtttgggatgttgacactatttacctagctccacaaaaattactgtaagacaaagtaagcagaagaacatacttcatgccttaatatgaggaaaggtctgccaaaatgtcataaattctgaagattcatatcaagcagaagaccagtgacttttacaacttcaaataaattcaatttaaaggataaaagtttatctctttctcatcaataatgtctgtatatattctgcctatgccttttgtttcctctttggttcccaggtttcatcatttttccctttcctattgtttctttcactttgcgtggtacaattatacattttgagtgcatatacatagcaacagacattctaaaggttacagtgtgatcacttttatctataaaccctccttcccagagctagcccagctattattttgaaacaaagtgagattttactgtggagaagctaaataagggaatcctaactgtagtatatttaagttttccaactttttatgtgatcagaattagtggaaaggctattaagtcatcacagatcttcaagatgctttttgctagtagcacatattttcagcaaatataggaaataagtttttctacatcacaggggaattttaagagatttcataagtttactatgaacacaaaaagttattctattttaataatttttcaacatttccttttatataggtagcttctcctccaaaattgcaatcactgtgctgattttattagcttttcatttgttcatccttgcattaagacattacatttcagatttttttcagtgcttggttttttagtttagcgaaagcgttcattactaatatggttattgcagtctttttttccttggttagttgttgtttgggcatgatgtagctcattttatccccattaaatttcaaatttttaggcttttaaaattatattagctaaaagttaaagagttgttttcttttgtatttttctctcccaaaatttagaattgttactaatacattttaagaattaaaatatttatttcccatttgaaaactctcaaaaatatcttagtgtatagcattttcaacaatgacattataatcacctttatttttctaaagatacattgtttaaactcaacatattacaagggtgcacttcataataaaaatgcatgaagacaaataatcttttacctatatacaaaggtagattttaatggtaaataaagcataagagatctgcagaatctaaattactttgaagcagttttacaatcaataaccatcattctggcactgaacaaatttgaaacctgtcttttttaaatatccaaaacataatgcaataaaaataatatttcattagcaagagtttattaaaatttttaaaaattattattgcttgtgtgtttcaggaactgaggcaaattctcagcattcaaaggtaaagaagaatattgaactaaaaatatccttaacaagtttcaatacagaagcagtcaatatacttcagaatatttagaatttgcaactgaaaggagaccatacaatcccttatcaacttacaaataatccctcatcaacttacaaataagtaaactgatgttcagaagatattaagcaaatgagcaaggttatactcctagaaaatgatgagttggaaagaaaatgttctctttgatatctgtggagattttcctgctatgtaccaaaactgaatcaagaatttgttcattatatgcatatttttgtaataatctgagagctaggcaaaatgtatagaatgtatttctaaacaattgttggaagggcacccttgaaatgcaaaatttctaattgttcagggagttttgaatttaagtgatctatcttctactaagttgtctataaatgcatcactattaatctccatcaaataacatgtaagtgatatcattaaaacctgttaattgttagagcttagtaaggcttgtttcctaatcaaaatggtttaataaagcttcacactatggcttttagaaaaaaaaaccactaagaaatatgaatgtgtgataaacttccatatctacaccatctgcctatctccttcaccatatgtcactctattaattgctaatatcatccttattatgcatcatttcatctgtaagaatgttccacaaaactaagaaggcatcaacaactacagaaaaacacctgctatatgcatttctggctgataaatttcagcaggttctgatatgttcttgggcaaaattttctaattacctttgcataacaggaagcctactagagcaactttctgtagttgcaatgatcttattactaccttctcaaactgttggttacaattaattaaatcttcctataatatttcttaaactattatagcagctactgtatgtataaaaatatgggtgcagtgggtcactgagctaaacactgagaagaggaataatatataagagggaatttgtaacatatgtaaaataattttgaaaaagttaagaccctgagcttttaataaacatgagttagtgagggtcgcagctcttacgtttgaccagtagttgtctatcatataacctgtacacccatttttccattgtttataaagaaaggaattgaacctcatttagattgttttattctatcaacagtaatggatgggtagaccatattgataactgtcctctttggcaacagctggaacagatccattcaaaattcgaacactttagaggcattgattattttgttctttttgaggtggcttttgttgaagaagcaagtctactgtccatgaaatgattagggagcattgccaaacaaaataaaattaaatgctatattgtgtggcaaagacagtaattgtaaagtaattttgaagatgaggaaataagggaatattgaaataggaaagaatttttgtaggaggtgaaaactgaacaagacctggagaggttggcttggtcattcaggaacaggctagacatatatgaatatctaggtggcaattctgtttattattgagacattgggataaacttttggtacaagttaaaaaaaaagttgcttaaaggcaaatcatgggtgattttggaaatcaaaagagttaacaatcggcaacatcagcaactgctgcagcaacaccacacccaccaccaacacattgtctccatccataaagcgagactttaatgggattaatctgtcagtaacaggtgggataaattgtactctaaatgaaaataaaagtgatagttgccgtattggaattgtagaatagtgacaatgggaatggaagtttaggagtgcttctagacatatttcaaaccaggagatacataagataacctctccaattttatctcactctacatcctttcatataactgaccaaactgattccccagatgtgtcaattcacattgtgattgcccatgatacattctctacatttgaaatgactttcacatccatcttcctctgcctatatccacaataatttccaagttctgcccacatattattttctccaactcaacggccatttccaaacatggaaataatcttcctcatctgaattttgcagaggcttgcactaacttgtaaacaagtctattatatattatctagttttgtgtttacgccttataaatcaatacaaaataataaaaataattttatactctatatcacatatggtacataatctagaatacctactcatgttcataagtgttgaatgaataaaaataaattgatcagtacaacaataaatgaataataacaatttcatgctttttgaataaagaaattaaaaggtgatgtcatgatttttatggttgtttttagtattttcccatttcattgtcttcttttctcatcctcccttaattacccatttcattaatcccatgagtggtttttgcccttgtaacttaacggactttgattacttggtaccatcctaataaacagattaaaatttgccatttttttcttcagtctattattattaactattttaaatgtttccgcattatcaaaattatcaatgctcaaccacatactgtttctttaagtatcaggaaggtctaaaatgaacattctacacatcttcaacacataaggctactttttgcaaaagctccagcttttggatatctactgcatatccaacaagggaataattgttttcaccactgtaaactggcaaatactttgtatacataacccatctatggaataagaattgtctctgtttgtgtaaaaaatattaatattaatttataaactgctcttttaattcataatttgctgtctgtgtgaacttttaatccctttaaaaatcaccatttcttgattgctcaaccatgcaatacacagacagaagctatgttaataatctctcaaaggtgcagtgcactgatactgcaatttatgctgttgtctggaaaaagcatatttattctgtccaagaacccatgagacatgagaactactctttgtccagactcacagtagtcattttaaaacttcaattactatttcagcatgttccctccattactgtttccactaccaccgccagtaatttctagcaacaaaatggactttgtaaaccatacacatacgtgccttgcatgcaatgagcaaatgcagctatgtctaatatctgcaaaataaaatgtaaatttaaatgaaataatatcaacatatgaatcttgaacatgtgctttttttatacttcctatataataattgttgaatatgaatacatatgttatatatataacataatgtatcttgcaatctaaaaagtccaatcatacattaatattcaacaaatagttcttgaaattcaagtcagtagagagctgctctttgtgccatggggtttataaaaaaataacaatgtaatataacaccttatttttgcctttgaacaatttactatcataagtatgattcatctttttaatcaaaatgagagtcttgaatgaacaaagatgctatgtagtctcaatcttactttatgtagatcttaaattccatgatctggctataacttctggtgtgagattttgttcctacattaacattaatctccttttctctgtcatctattttcacatccatttttgctaacaaaaatgcacatatctaatttatgtgacattgaagtaggatatttgaaacatatcattttgaagccatgatgttcactatattgctctttatggctataatttcatcttgagtgaaggacacaagaaatcagccttgtgtaatcagtaaaatagaacattttactgttctatttactgccatgacattcatgaaagtaacccttacaaaatgtattattcattattcactttataagaaaatatgagatactgtatgcttctttctaagctataaaaaagtgtgcctttctcgtatcataggaatacttgaattttatagacaatgttttttgggtgtaaactggtcaagtttctttatatgtttggcagctatactatttaaagagaagaagagctagagagaactcgagtacagagacacagaaaaatgcagaaacaccattattaaaaataataaccaccagaacagcaaacaagccatcagaaatgccagtacgacatgatgaggtattcattttcaaacacagttttataaagtttagaaagaaggaggcttatttaatttatgtggaaatagttcatctgaggaaaggtgatgcatgtgctagctaggataaaggaggggggaaagattagttttcatgattaacagttaaattgacacaacagtttaatgaattaaaaaagttgatgtttgttcctacaagtggtcacaagcagttaaagaaaagaaaaaggtaagcaagtggaatagatggcaaagaaacagtcagaaggtgaagaaggagtataataatatagatataacatcatttaattatattcatatttttaaacatttatctcaatgagataatagttctttctatactctgtcacaagtcagtgacagatatttaaatttgaggtgtagattttaattctactgggaggaattatttgaaatcagactgacctcaatgatatggttcttgcaaaccttgatgtttatgtctaatgatattggcatatctgttagtttttttagtatttaaagatgatgatatttacactatgggtagtcaaattgacttataatcaggtgttttgcactgtgaattacttattaaaactcaactacaaagtcagatgattttaatacatttgaactcccatgttaaaaataaaaaggtaccccagttggttgtgttagtgcctttctttattttctaagtagctgtacaaaatgtcacttgcctttcataatattttcttctatatttaaaattgtcctcaatgagttttgtccagtcaatattttgccatatatatatatatatacacacacacacacacacacacgcacatatacacatactggtatttatatatatatatgtacacacatacgcgcgcgcgcacacacacacacacacacacacacacacacacacacatatatatacctccagtaattccagataagatatatatacatatgtatatcttacatatatatacacacatgcagataatataagatatatatttatatcttatttggaattattgataatgtgacatataaagccagagaactaactggtttgttctagattaaattaactaactgtagaacctgtgctctaccttgactgctaccaagtattgtagacacggacacataagcaattcaaatggcaaactatgcaagtggagaagaaattacggctttaaaatatctgtatcattgcctatacagacagggtaattgtgattttcaaaaaatgccgacaatgtttccagagtcttgtattacatactttattcttcagtctatgttgtatgattattaattggaaattccttgggaacctaatagattgattcacattttgcagattttctataaatatcaataaatatatgagcacaatctttccttaaagattatattacaattcaaagacttaattgcaacttaattacaatgaaataaaggttaaactattaaaatgtgttcagagggcattattataaaacattacctttacacacaggcctgtgatcactccaagcagcaaaaacttcagctatccgttgacaggtgatgctctttgcgccctgtaggacataatcttcatcacaagagaactgcacagttgatccaaggctaaagttaaataaaagagaaaaaatatgataagaaagatgcaacataataactaggcttcacttctgctggcaatatccaataggtcaaatatgtactatagtgacaaaaagtattttggaaaacaaaatgtgaaagtatgacttgtagaaatgtaaagctatcatcaaatttaatcatcttgttaatagatgtagaacgaaggtcaaataattcactaagtttaccatgctaagtagatggtaaatgtgaatcaaaatgtggctattctgacttgaattccagtacagtgcttgtgttcatatcatattacggtgtttttctggcatgtatttacatgtgtatgtttgcagatgtgtctctacatgtgtatgcatttacacatgcatttgtgtctataaacatgcatttaatgtatttagagatgcaaaattgtactgattgattttcataaggtgtttttttctaaaaatattttaaatttttgtgggtatatagtgggtgtatatatttatggggtacctaagatgttttcatgaagtcatgcaatacgaaataatcagggagaatgaggtatttatccccctcatgaatttatcctttgtgttacaaaaaataccattacattcttttggttattttgaactatatgattaagttattattgactatagctatcttgttatgctatcaaatagtaggtctttttcattctttctatttctttttttacccattaaccatacccctctccctcctagccgcccccacatcccccactaaccttcccagcctctggtaaccattattctaatctctatatccatgtttaattgttttgatttttagatccctcaggtaagtgagaacatgtgatatttgtctttctgtgcctggctcaattcgcataacaatctccagttccacccacgttgttgcaaatgacagggctccatacattttatggctaaatagtcccttaacatggcataaaaagtcctacatgtcatctctcactcattgtgacacctgatcaacatctctagaagttaatccgtataaccaaagagagattatatttacagtcttcttagacctcgtcatgactccaagttttatttagactactcttagagcttgagcaaccttaaaagtttacataacggtcaattatctgccttttccttctttctcatctcaataaacgaaaactccattcttcaagttgctaaggccaaaaaccttacagttattcttaactcatctttctgtcttgcatttcacaagcactccatcaggaaaatcctgtcagcaacacattagaaatccagaatctaacatttttcagccctacagtgttaataggaatctgagccacaatttctcattcatatgattgcaatagtccttcttgctatgttgttagtttttcctctttctgttcttgcctccctgcaatctgttcttaaatagtatccagagcaaacttttcaaaggttagttcaaattatatcacttttgtactttcaaatttcccatccctgtttcactcagaataaaggatcacctgtttcactcatactaaagagattgcccttaaaattgccgatgtgatttggtctctgctaatttgcaggattaatttcctatgctttctccttccatgtctgttctttagatttatcgacttccttgctctggcttgaagatattaagcatgtgcctccctcagggtctttacacttgctgttatatcaatctggaaaaccatttcttcagaagtcctgtatctcccattctcaattgttctggtttctcctcgcatgatattttatccataaggccctcccttactgctctgtgtaaaacagctacgcctattccattatcttcttccatgttatttcctatatactatctaatacactgtttatttgtctccctgcttccactaagaaaacctcaagtctcttatctattttgtttcccaacatgtcaaacatttccaaaagtattgtaagtttatgtatagattttaaacagtgattaaagctatcttttgcagatttattggttgctatcatataagactgtctaatgcactcagatatgtccttatccctataactggaaaaatattctctgtcaggatactctctcaaggttaattaaatttttataatccatggcacccactatttcccattgcctgctgcatttgctgtgttcaagaaagagcaagaaaaatactaatgtgattggagcacagaaaataaagagaggggtatgtgaaattaagtcaaggaagcaattaggggttgtggttagattggttacaactttctaggccatgataaggattttgaccctcattctgagagaattgggcagttgttacaggggtttaagacaagtgaatactatgctttaaaatgaactcattggtttctgagtgaaggatacaatttaagcggccaaagatagaagcaaagagtttagttaacaagctgtcacggaaatccgagttttcatggagatgttatgatggcaacaagtattagaaaagtagtagctacaagctaatgatggtaaaaactttaggggatggagaaagaaggcccagtatagggcctggcccataggattcatttaattactattttctcactaacataataaattaatgatctatcatggttaccatatttgtcacagatgattatgatattctagttctaaccaggctcttcttgctaaaagtaataaatgacatcttgtttaagtgataggagtttgagcatgtttcttttgattatagaaaattaattcacttagcgtggagacaggaaattgataataataataattataattattataaaataataaataactgttttgctactatactaaagattaccagtaatggtctctgaagcttctatacttatttttcccctacagattagccatctcaacatgttcttctccccttaatacactgggaaaagtagtttagagtagtggtgaacagtttaagctacagaatcacaggtatctcctttcaaatactaactttgccctaaacttcagctttctcgtctgttgtgataaagtaatgaaatattatttataaactacacagtgtctatcacatatcaagcactcagttatttccctcagttagattaaaatgaagtcctcatagtctaggggttcttgtcttttaaagtcattttgagtatctctgtattcctccatttgtcccaactttaaaatttcatgtcataattatatttaagttctggtgggggaaatttatttttgtccatttataaagtttatattctcacatcccatatctccctaacatgaaccttatgttccaaataccattaacagtaatttactttttctcatacctttggtctttctacaatgtctactctgccaggaattctcattttcctcatttagcttaatcattattaagatttgattttaattttaggttacacatgaagctcttattaatttatccattaagaattaaatattttcctctgggaggccaaggagggaggattacgaggtcaggagatcgagaccatcctggctaacacggtgagaccccgtctctactaaaaataaaaataaaaaaattaacccagcgtgttggcgggcacctgtagtcccagctactggggaggctgaggcaggagaatggagtgaacccgggaagtggaacttgcagtgagctgagatcgcgctactgcactcgacagagggagacgccatctcaaaaaaaaaaaattaaatattttcatctctttgtgcattgctttcccatacctcagtagaacaattgctacaatgatttaggggcttaagttaagatggagcagtaagagagagaaatagtgtaaagataaagaaggtaggaagaaaggagccttctcacctagatgagaggaccattttctaccttactattttatcttaagttagcttataagatgccatctaaatgcatcatatatgacattttggccacatggcccatggatgtcctctgatttagattttctaggtctgctcctgtttatgctgcaggaggagagggaatgggatattttaaaatgcagatttagaatccaaactgccaagatggcaaatatttctaattactcatttgtattgtataagccattaatttcttccccactaatgaagaaaagcatctatattgggcatttgcaaacatctccatccaggatcacagctacacttcaacatattctagaccaaaaatataaaagtgcaaaacaacacagagaggacagaagtcaatgaaataagtagcctttccagtaaaatccaggctcaatcatcaggaaatggatatcttaaacaaatgcactgtgctttcactgtattaactgttttaatatttgagtcaaacttaagaaaaacttacactcattaaatatgtgtgtgtgtgtgtgtgagcgtgtgtgtgtttgtgtgtgtgtatgcattcctaggaaagtattcagttaccatgaaatgacaaggaggacaagctgtatccactgaaattcatctgtcaccacagaagagatgtctgccctacccagccaaataaaactttccactttaataagttattcattctgatacaacatttcaaaacaaatggctgagcacatttttaatttgaaagtaccaagtcataaggcaaatgatatataatgatattgtttgaaaaactagagttgaccttctcatgattatgctggtcaatgtttaagtgctgtcatctttttaaaaatgatacttattttgcaaaaacaccctataatatcaaagctgtcagtaagagaagatatgaggtttttcaaaatacacaaattttacctgtgttggcccaagatagtgaatctataattttatttacaatcaaatagacaggatatgaacaaatacagaaatatggaaggacagataatagtgcttgggtcatagaagaggatctaaaaaaaaagcagaggaggaatgaatcttgacagcattacatcaagagtaaatttgtctgcacttttgttgttattattttttggtctatttaaaaaggtctagacaatttcctgacagatgcagaaatttaaccctaagtagcagatgcatatttttcaaaattatcactgtacaaatagaaattgtccaggcatgacagatgatctaaaaattaaagtatctgcaaaccatttctgtagcaaaaaaatcaaaacactaaacgtcaagaaaataactattaccaaaatgaccacaataatgctgatttaatatctttaaaagtctaattattctctaaatgtctttaaactagcaatttcaaaaatgagtaattgcacattagaatatctaaggttattttacaatatgagattttctgttttaaaattgtacaagtacgtattgcagaaattttgaaaattaagattagcaaaaaaaaagtgaaaaccacttaagctctacactgttaaaggtacttttgagtctaattccaaaattctagttcttctcaaatttgaattatttctttcttatttccttcttgtaaaattggagcaagtgaagctccttatagaggggtcattcctccaactagtttgggattcaatccaccccgccttgtcattacttgtactattaattattccttctttctcttgaatattcaactctcattttaagctggtagtaaaagtgatggtattaatctgtttatttgtaagtcataaaaattaaatgttaataaactctatccaaagggatgataaattactttactttcaaaatattttgtttctgactctaagttacattgataagctttgttagatattacaaagtatttcatctcataccaaaacttttcttcaaaacataatgaataccatgtttttttatacctattgcctatttccttgaccttataaaattaatgtcattcttttgcagaaataatgtcatccaaaccaagactatgtccgatacaaagagaattcaattcagcattcacacactttcatatttctttacactgttggttataatcagtctggatattgttactgggtatcttgctttgtggaatgcttaaggtcactcactacctcattcaatatttatgccaactactgccctatttaataaccccaagcttggtcatttgtgtacaatttcaagtatactagaaagataataatgctacctgtctttgcccctccaatactcagcttcagataaattctatcactaggagtacatccttcttcttgtagatttacttcctctacttatatacttctatgaaacataaaacagtatactcaaaaatagtgtaattccaaaagaagcaatattctggaaaaaggaaaaatcccaaaagaaatacattgttcagagagaaacgcaaaagccctaggcaagtgcattagttaatatagattttcatatgacaacagctagttaaatagctaaccaagctaaaagcaaatgtcacagaaaaagttataatttcaaaccttcaagagaaagcatactgattattatcatagagtccttttcgttaacctccaaaattaactgtggtgaactcctcagaatcctcaaaaatccttgctataatacccaataagatttcaagattgtgatgttccccttcctgtgtccatgtgatctcactgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcctttgggtatatacccactaatggcatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttctcatgtgttttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgcgaaaattttctcccatggggtggggggaggggggagggatagcattgggagatatacctaatgctagatgacgagttagtgggtgcagcacaccagcatggcacatgtatgcgtatgtaactaacctgcacaatgtgcacatgtaccctaaaacttaaagcataataaaaaaaaaattaaaaaaaaaagatttcaagattttaaatttagtacaactattaaaaatgtgagagctgaagattttatttttattttgataattctttttatggagactaagagataaatacttgtcactatatgatgtttttattctgctttgctttatctcttatatataacactcaataggtcagattttgtgtcttaattaaacaatttttaatagatcttcaattctacataagcacaatatttttatataacaagtgaagtatggtacagatccataactgtgttataaagtaagaaaaggcacatagtaggataatgatatactttgatagataaaaggcaataaaataaagtgcttttgaaggttactagtagaatgcgttagaaagtaacatgaaaatgttcagaaaaattacaatatacatacacttaagtggcaaaatataatctaattaaaagcttaaataattttttttctgtgacagaaatgtttttaagacatgagttaaaatcatttgaatataataaagctttcaaatagtattaaatgaagatctatgtttgggatcatttttgttggtatgatcataggaaagaaagtggttaagattataaagtagaacttggttatacaatcccttcaaataaaaaagtaaaataaaattagtgtgagagctaataaatgaaataatttaatgctatattgtttaggttggtaagcttcctaatgatttccacaacatgctattttgaagttcacatgtaggcatattcatacaatacgcctctttaagccataaggcaaggttaacatctcattcttgtgacattaactttaactgttcccattgctatatcactccctgtgttctcatccctatactactatcagacagcaataaactaaataatgtaatgaagataaacctatttgtatctaatttttccaggcttatattatattaaactttgatctcttaatagtggcaacacattaattgtattttaaaaagccccagaagactgtggctctatatttaagaacagctgtcagagagaaataaaccagttgaagtagaggtttaaatagttaaagtcaaatccacctcagagtagggaaacactatagaggcatagatgaactgagctttgtgatgcacaatgttataaattatccaaaatgatcaagtttatttttaatcctaatataaattattaaaagaatattaaaaatttatatttgaatagagcattctagtttacaaagtactttcctctataaaatcccatttgatctactcttgacgtttttaccagttaatgtcatagaaatttgcaagagtaacccacaaggcactttgtgaatgatatttaaagtgcaaagaccgatgtgcatagcaactacctcattgtctgtgaactgttcaatcttttatacactggaaggaccagttagattaaacactgactacctatgtttaatatttaccccttgaatcctatatggaggtgctgacaaggaataataaattattgcatatgtcagtaatgtaaatttagaatattaagttgctattgccatattaagcctataatataaaatcaacttttccacattcaatttatcagtattatagtccactgagaaaaattttgagtagaataaattaggttacctttagatgagttacagctgtcatattccatgaatcaattagctttttattaaaataaatctgccaaagcaaacataccttaaatacttcatcattttttttatgttgctatgcctctttcatgaataaaatgtgaacttagaaggtggggtactttgtttttaaatcattttcatttaacataatgactatgctataaagcacttcctctaatcataaagattaaactatcctgatttaaacaactttggaattaatgtctcttcttgcattagaaatgcctttccaacactctcttcaataaatggtgctgggaaaactggatatccattacagaggaatgaaactagacctttatttctcaccatataaaaaatcaactcaaaatggattaaagacttaaatgtaaaatccgaaactataaaactactaaaaaaaaaaaaacttagggaaaatgttctagggaacttgtctaggaaaagattgtatggttaaaacttcaaaatcacaggaaacaaaaagaaaaatagacaaatgggactacagtaaaccagaaagctttcacacagcaaaggaaaaatcaacaaagtaaaaagacaacctgttgaatagaagaaaatatttacaaattactcctctgacaagggagtaatattctgaatttaaaaggaaatcaaacaactcaatagcaataatataaataatcccataaaagtggacaaagggtctgaactgacatttcttaaaggaagacatacaaatggcaaacacgtatatgaaaaatgttcaacatcactaatcatcagagaaatgcaaatcaaaaccacaatcagatatcatcttaccacagttagaagggctattaccataaagacctaaagtaacaaatgctggtgaggatgcggaggaaaggtaactcttacacactgttggtggagatgtaaattagtacagtcattatggggggcagtatgaagagttctcaaaaaactaaaagtagaactaccataagaaccagcaatcccaccactgggtattcatccaaaggaaaggaaatcagtcctttgggatatctgcattcccatgtttattgcaacactattcacaatagctgagatatgaaatcaatctaagtgtctatcagcagatgaatggacaaatgtagtgtgtatacacaatggaatactattcaatcacaaaatgaatgaaatcctatcatatgcagcaacatggacggaacttcagatcacattattaagtaaaataaaccaggcgcagaaagacaaaatatcacaaatttttatgcatatgtgcaagctaaaaatgttcatctcatagacatagaaagtagaaagatagtatttttagtagagatggggtttcaccatgttagccagggtggtctcagtctcctgacctcatgatccgcctgccttggcctcccaaagtgctgggattgcaggctacttgggaggctgaggcagaagaatggcatgaacccagaaggcggagctcgcagtgaggcgagattgtgccactgcactccagcctgggagacagagcgagaaaaaaaaaagaaaaaagaaaaatagttaccagaggctgggaagggtgtgcagtgtgtgtgtgcgtgggagggggtacaaagagaggttggttaatggatacctacagttagatagaaggaataatttcagtatttgatagcacagtagggtgactatagttaacaagatattgtatatttgcatttcaaaatagctataaaagaagattttaaatgtttctaagagaaagaaatggtaaatgttcaaggtgatggctatccaaaataccctgatttgatcattacacattctatgcatgtatcaaaatatcatgtgttccccataaacatgtacaaatattacacatcaataaaatatataaaagtatttctggtaaaaacaaaaacaaaaataagaaatagtgctctactaaatgttaggcaaatttagtatcagttttataaaatcaaatcgtggattggggagttgggagtaactgcaagatgacctctgagatttttttttccagctataaaattcaagaagtctctaagaatagatatggtgctaaaatacaaatagatagctgtataagatgttatcaagtggtgtataatgataaaaatatctctattattcagaattgggctatagattctcttaactctaaaagaaaattaagccccaagcgttctataatggtatgaaatagaatagttcaaattttttaccagtttgtaatatgagctggtttaaaatgttacaaattttacaccgaattgtaatatcagttctgcaaagtattacaatataccttaccatgattgttagaaaagacatggtcttatatttgctgtctttccaccatctcttcaccatctctccaccaagtcctaggccagctggagcccataatgcattaaacagtggaaatagcaatggagtgcatcacactctgatactctgaatcatagatcagagaagggttctatataacgatttctgaataagtcacagtgaatgtgtaaactgctaccttaaagttactatttatatttgaggagttaaaattagaatgacaagaactctcattattttacattaaaaataattcgacattttttttatggtcaaattagaacccagtaggttagacttagcaagttccaaaagcctgagctagtgagggggtaaagacagttttgccgtgggaatagaaagtttacaaactttctatttctaaggggaatctaaaaaataccactagcatctagttgaggagagcaggccccacaggttgcagacaggcatacagaagtacactaaaggtctgggaagatcagcaacaaccttttatgagtcactgggatatgagctaagactgtaaactcttgaagggaaaaattacatcatattcgtccttttatctagggtttagcccaatgtctgcagtgggtacacagtgggtattggctgagtacatgagtggaaggaagaacacactaggataaggcatactagtttaaatgcagtcatgatgcagagcctggaaagctttgtggatgttacacattgtaattacaaatatcatgttgttttcctggactctgacagtggttggagaagtagctagttcctgcaacaagtcttaataaaattcaaaataacagtaccagcatctatttttttatggcatattttgccctctattccttactggctaaaattacagttcccaaagtatgttgagctttttgggttgctgaatagaacacataggttgctacagtatactttaaatttttgaaggaaacacagatatccatcatgaattgtgcaaactactagcttgaagtaattcagtttcaatattatacaactattaatatattcctttcaatgacattgatgatgctggattttcagtggctgctctgatgaaaagcaaatatcataccattttgctgtggagcataaaatgagggtggtaacataaaatctgagtccaaggtttgagaaattgtgcagtgcacaatgctaagtttttagaacataaattcataagttgcttagccacagctactaaacagaagtgttaggtatttctttgggcctgggagcctggaaaaaaaaattactaagacactcgggacactgtgatgcaaaaatatttgggaacttcttgtgctaaaactttgcacgtcactctgtgaatctagatgtatagtgtgcaaatgttttcttccattctgtaggctgtcccttcattattgtttccttttctgtgcaaaagtttttatcttgtgtaaccctttttctgattttgtttttttgcctgtgcttttggggtcatatcaaaaaatcattgcccagaccaatgtcaggaagcttattttctaggttgtttatagtagttacatagctttgggccttatgttaaatacctaaatttattttgagttgatttttgatgtgagataagggtctagtttcattcttccacacatgaatatccaatttttctgacaccatttattgaagaaagtgtccttttcttacggcgtgttcttggcacatttgatgaaaatcaatcggctttaaatgcatgagtttttgctggcttctctattctgttccattggtctctccttgttttaatgccaatactatgctgttttggatactatagttttgtagtatattctgaagtcagactgtatgatagttccagatttgttcttttgctaaaaattgctttggctatttgaaatctattgtgctttcatgtgaattttaaggtttttattttattttatttttgtatttctgtagagaatgtcattggtattttgtttgagaatgcactgaatctgtagattgctatggttagtatagacacttttttcatgagcatgggatatctttctatttatttgtaacttatttagtttctttcatcaatattttatagttttcagtgtagaaatctctcaccttttttgttaaatttagatatgtttcaaaaacagaaaagatgctataatgactggattagagtgggaaataagaagaatgatccaaaatgagctcaattatgaaaaaaaaaacaggttgtatggggattttttttaagtatcaatttattctaactgcaagggggaagtcactgaagaattttaagcagaaaagtgacgtgatttgatatagtttttaaaatattgctctgttttgtggtgaatgtattacagatgacaacagcagtagaagagagatggtttaggatgtttgaatggtctaagtgagagatgatagtggcttgcattaggaaggtttcagttgaaatggagaatattggatatttttagaatatgccttggaataaaatctcaagtatgggtagaacttcttgatggattcaatatggagaggtgcaactaagagtagttactagttttacaaagacttttatgaaaaaaatgctaatatagtctgttgtcacagacttcctcgcttctgctatttccacatttagtttaacagtgactttatatttcccttctttcttctaccccaagtctcttgcctctgtcttattttttctatcttgcttaccctcaaaatattctcattacttggacatctcttctccttgtgtctcattccctaatttccttctcttattcccattttacttctgtacctatgatccatgtcattatattaaataattaaaatcatattgcttcttcactttgtccaagtcacagcatttacaacataataaggatattttctttcacaaaatttacatatacataataaagctgaaggtcactcctatggaaacttaagaatattaaacagactaataattcaaattttgcaaggaagggtctgactaatttgactttttgaatttgcatataggttttctttatctttaatcgtgacactagaaggaagccttagtattcctttttcctataactttttttcaaaaacacccttgtaattaaaaatgtgtggcataaaatgtattcaatgatctcacttttatagaactgaaattactcttggtatacccaaaatattctaacactactcaggcagaaatactcagtttatctagaaatactttaattcatcaaaattattcccaaaatatactcacactacccagccagaaataattggcttatctataaatatttgtattgatcaaaattatttcctaaatacgtcaatatatttctaaatatgtacatttaaactttacttcaataaaatattaccataatttaaactacctgtagcctcaattgtctttttatttttattattttttacattaacattgcaattacagcttgttttctccctccagcaatgaggagaccatgaaggtaaagtagacaatctatagagtgtagaaaatgtgataaggtgtgcacagggtattaggctttgttattcatgttatcttcttttaagtttgcctacccaacttgagtatttttataagccatatattttaaatgtcctatcagtttggataacatagctggaggagatttcaaaaatctagtcctattctttcttctatatatttatacaacttgaaatatattttttttgtaagagctagtttttatatggtaataatgtactgacagttttgagtcacaagaatcaaaagaacagttatgcttttattactctttgtttttggacctaggtaataatgttttttttttttttttgagacagagtctctctctgtcgcctaatttggagtgcagtggcacgatcttggctcactgcaacctctgcctcctgggctcaagcgattatcctgcctcagcctcccaagtggttgggattacaggtgcccaccaccactcctggctaacttttgtatttttagtagagacagggattcgccatgttggccagactggtcttgaactcctgacctcaggtgatccgccagcctcagcctcccacagtactaggattacaggcatgagttactgcccccggcaggtaatatgtcttttaaggtgccatcccaaagaggccagaaacacctcttcatacagagaacagtaggataaatagtaattgcaaagaccaatgcaattactacttatcttactgttactgtttctgtattgtctgtataacacaagaagaagatgacagtgcaagtttactcaaattcaatgcagcaagtgattcttaagcatctaaacattttttggagattgatgattaaaaaaagatagcatcagcattcaaaaatagaataaatactgagcagaaagataaaagaagcacacaagtaaattttattcaagtcaaatgagttgtgaaagttgatcgtatgaattggttcattcttgccatacccaactaaaacagtcgagaagccaggggggaaaagcactcagaatatataacattgctctagaaatgtaattctctgcaagtcaggctgctggaactgcctgttgtaatctgagaccagttttatctataagtgctgaaataagttgctgcaacataaggatgaattttgccaaccaccatcactcaccaatgggagcttgccagctccccagaactttattaatgcccatgaactttctcaaagaacaatatgtaacatttctcctttaatgaaacctgcaactttctctttattcttccaacataccaaagaccacctggtctgactgtatacctcgaattgtgattctttcttctcaaataaaatgttacatttagagatttgtctctacatttttattttgactttaacagagccaagagagcattgataaaagttataagaaaccaaggcagatgaaggaaattcatttgaaggataggtttcttataggtaaagattggcagaatcttattttaggaagcaagagtagcatgtgcaatattacacagctgattaagggtggaggcatttggaaggacaatttgtattaagcaactagtaagttagaggaaatggtagtttttacttttacattgattttttaaaatacacaccacacgactgaagtgaaatatttttcggtaagaggcaagtgtggcattctgtaatgaaatatgacaaaagtggaaagataatgccagaaagttaggtttccactacattgaggaagaatttaaatgctagaatgcaaatatataagcaagggggaaaaaggatcaaattgcaagccatactccctgggtacaaggcctgtctttattactgctaagtataggaacttctggtatgtgagtttactcattagtaaaatagaaatattgaaacctacagtgtgttaatacatttaaaaaataatggtgtgaaagtgcttttgagttaaaatatgatatatgtatgtacgtgataactgatattatatcacctcttaattcaataggtatgggaaaaaacaagtttttgatcaaggagtattattgcaatatttaaaagtgaggaatcctttcctgaaagccaagtgtaatacttcttgtaacagaataaatagaagataattgcttttgtgcagttgggaagttttaagtgagtaaagtaaaagagagggaactgaagattactaatgaatgagatagaagtggcatcagtgttggaatggatgttggaaaacaatgaagacttttaaatcttcattcattgggaaaacgacaggaaaatagcaaagacaaggcaaagacaggtaaccaagcatttattagcccctctttgttctgggtacttcactaggcaagttcatgagtctgagataatctagtccttcactgtggcatttcagtttggtgccaccctttccatttttatttaaaaggaaagacaactttgtgtagaataaataacttccccaagtcaagtaaaaagagcaatagaacttaaaagtaagttcatctgattccaaatcccacgcttttacagatgcaatgacatacttgttttgtaaaaaatactaattcaattgttataaaaagttgaaaataaatattcaactctcagaagaataaaaatgataaagacctgagggaaacatggaaagtcatgattacaaacccttgaaaggagatcagattcttgaagaaaaagtgagttttgaagtgtaactgtgaaaaatttttatttttaggaagtgagaaggtaaagtagattcaataaaagagtgaaaaatgggtagtcaatggctacactcaaggaaaccaagctatttctcagccattacattcaagagagcttataataattacaaatacttatagcagtatggtaaggaaagaactgccacagatgtaggccattctttaggaaagtttacttgtgaagtggggagagacagaacacctttggaagcttctatatactaacggtctctttgtaattaccaaaataagatttataactaatatactagcatatttagaaagttcatgtaagaagaatgagtgaaaatgactttatattcaaaagtatggttgatttacattatgataataaacttttcctgaatatacattatacagtagtgttttaatagtaccaaatgagtagcatgttccctgctgtttcactgctgagatataccagcattttaataatccagatacaaatccaaaatttggagtccaaattgttatttgctctcaagagaagcccaaatttatgttcacatctagtgtgacataagagatttcaatatctcttttaaaatcttcaaaattctccttttcctttatatcttcctattcagtcagaaaaggcatcaattaaggcctttcccacagaaagaaagtctatgaatataaggatcccacaagctgagctttcccaaaaagttggttataattttaagggcatttaactttttaatttatttttcagcatagaaaatgctgccaactttatatctctttggcagcatttctccctttaaaaacttgttatattctataggtatttcaaattagaaacaaagcttttaagatttcaaaacacacctgctgggactatcacctaggagagtagagcacaaatggtaaccaaaatataacaagtaagataccttacttctccaaggattttctcatagatttcctcagtgattataaaaatattgattacgtgcaaacaagactgtttctgtttcatcaactggtatctataagccatttactaatacgatgaatttgaggtcctgctacagtcatgtgattagaaaattaatggaaaatgctaaactgcagttttgctgttttaatcaattcaattaattacatttattgagctctctttgtcacacatacagaaacatgaatactcatatctgattacaaggatcttgcacttagaaaagtttctaagagacaagaaaaaaaaattgggtactataatgaaggaaaacatgagctaagaagttaagaaccagagagtaactgattggaaaagtaagaaaagctttataaaagaggattttgagtgagcacttgaagaatatgtaagataacacaggcaaaaacgctaagatataacattctaggaggaagaaacaacagaactaagtagtcccagaaaatcagatatatttgaagccaactatgtgggacaatttgttaccacacaaaatatgaatggaagattgggaatattttgaagcattttgaatgccaacactgagtactttttgtataagtaggcgacaggaaagctctgctggtgttgaagttagaaaaacacattattgtagatgttatggatggaaactgtggacgagaaggagaaaaatcggcagcttgtaaaactgacatcacaattttctaaaaatgtgtaaataaacgattaactaagataatatccatggaaatgcagatcagagaactattcttatctcttctacatctcttcataattgaaatatctcttttatccctaaagttttcattcaaagagattactgcaatgttaggaaaatcatgaaacagtaaatatctgaggttgtaacaaacatgctagagaaagattttagtaacatattatcattaaaataacatgtgtatatgtggatatatatcacttagttcaaatataatatgaaatcacgtgtatgtctttatttttaattttaatagaatttattttctagagaattttcaggtttataaaataatcacagagagtacagagggttcccaaacactacccctctctccccatcataatacagtttctcccattattaatattttttattagcatggtaaatttttttgcaatgaatgaatcaacattaaaatattttattaattaaagttcataattacattagggttcactctttgtgttctatgggttttgacaaacacatagtgtcattattcactattacaatatccgacagaatagattcactgcccttatatgtcccctgtgcaccctctcttcatccctcacttcatccccctgaactcctgacaaccagtgtttttttttactgtctctgtagttttgtcttttccagaatgtcttatagttgaaattttacctaggagtgtaattgttggtaaacccatgtttagtttaaaaaaaaaaaaaaaaactgtcaacggctggcatgagtgtaaattagttcagccactgtgaaaagcagttttgcaatttctcaaagaacttagaactaccattcaacccagtaataccattattgcgtatatacccaaaggaaaataaattgttctaccataaaggcacatgcacaggtatgttcactgcagaactactcacaatagcaaagacatggaatcaaccaaaatgatcattagtgatagactggataaagaaaatatggtacatatatactgcgaaatactatgcagccataaaaaaatgagttcatgtcctttgcagcaatatgtatgaagctggaggcgatggtcctaagcaaactaacacaggaatagaaaaccaaataccaagtgttctcacttacaagtaagaactaaacattgagtacacgtggacacaaagaagggaaaaacagtcactggggcctacttgaggttggagggtgagaggagggtgaggatcagaaaactacttattgggcattatgcatattacctgggtgacaaaaaataatctgtacaccttttaaatccctgtgacatacaatttacctatgtaacaacctgtatgtatagccctgaaactaaaagtttaaaaataataaattaaattaaaaaactgtcagaatgtcttccaaagtggctttattattttgcattcccaccagcagtacatgagcattcctgttgttttactttctcggcagcattttgtgttgtcagagctttagactttagctattttaatagctatgtaatcgtatctggtagttatattaatttgaagttccctaattacatatgataatgagctttatttatatgtctatttgctgtctcatatatcttctttggtgacaattctgttttgatgttttgcctattgtgtaattgagttgttttcttattgttaaattttaagcaatttttccatatttaatatacagaatgtatttttattagatatgtaatttgcaaatttttttccaatctgtggaatgttctttctttgtcttcacagtgctttttatagagcagatattttaattttaatgaagtatgacatcaatttttttatcgattatactttttggtgttttatgaaataactgaactttcacttggatggggcaccaggagaacatgccacgagttcttttgaattttcaggggcagagactggtaattctatccaaaaaccagtgtgactttcatagttggaggcagtaattcactgagtaatcacaatctaatgttcctttgagataaaaagggcccaagaaaagatataacttttaatttaagtcctgactaaaagtacattacttcataacaatttgatttatcttttgtcggtgatttttattcctttacaacctttccattttttattcttctgggtgatttccatatcttatatgagaataatttttgtattacatttttgaaatacatacaaagttctttttccccctttgaaacagatgagtctacaaatacttcaacttctgcttctgaaactgaccttgacctgaaactgatccactctccttttaaaagtcccccaatttatatcgctacttgaagatttctttgctcccaatccatgtttctaatctgtatgcctgaaagaattactagcaagttcccaaatgcactgagtttatcatacttttgcacaatcctttttatgtttgtagctaggaagctcagtaatgctaggtagaaattataaaaccaagcagattcattatcatcaatctcaaaagggcactcaaatttacttagcaaggcaacatttctacatcaagcttgctctcccactcttggtaaaaaactatttttcatttttctctcagtcttaaactttctctcccatccatcctcatctccttatacacacattttcatttgatggccttcctagatgcggcgttactaacgtaaaagtattaaacatgagctttctcatcttccaatcacaaaatatgtaggcctagcagcatctcttctccacttctctgtcttcctttctattagattgaaaataattccccactacctgtccttgggatcccatttattttctcctacaaaattatgtttctttacctctaccctctctttccaatgccaccaatagatttctctctatagaattatttgtaccaaccaataaacatgctttggtctcttgaatctctaaaaagaaactctctcttgatttcctaatgactacaaaaatgcctcattatttcagtagtttatataacttgaagtcaccaagctgtaaactatctgaactgtctttattcactcttcagcatatttaagttggttttcaacctctgtcattccactgaaatcactcttgtcaacaaccttcatgttgtcaaattcaaaacacagtcttctgtcctccgtgctcaatttttcaacagtccctgcttgccctttaaaggacttcttttgcttcagttacccttttaggtattgtcatagtcctctggtctctcatgagcaggatttggcagctccttgtattctatcagttcgtcaaatagatatttgagatgacatcacaagttctcttgtctttctacttattttaaatgatgttatctacacataattttttaaagaaaatgatgtttaacatttttataatatgtatatatgcctatggttccctgatatctctgaatttcaattatgttcaactaatcacttaacatatctgcctagaaatctctaaatcttctaaaatgtacaacttcaaaactgaactctcaattattctccagaaatctctggatgttcacactttattaaacattataattcactccatcctcatgttgttcaagccttgaaaattgagcctcatccttaattctttcctttttcttactctccacatcaaattttcatgggatattaaggcttttatcttcaaaagatatcttgaatctgtctcgttccctgccaacaccatagtccaaatctccactgtctttcactcagactactgaagaaacctaactaaaatttaagttttcttcaatcactgagctaaaatagaaagcatgatctactgaatatataaattggatcaggtcacttacaaatctttacaacttcccatcataggcaggtgagctaaatgagtaaagtagcctatgggtacacatggtgagccagggagatcctgcccagcctagagagacaaattgttaactggttctgagcagatgttaccctaaaagtgtgtaggtttaagttgccaaatataataagagaatacagaaatatgtgtgtgtgtgtgtgtgtgtgtgtgtgtgtgtgtgtataatattctgagttttaaatgttgtctccattaaaaaaaacaatgtatttaaaacaaaacatatcttcagtccatattaggctgaatggctgcctgcttactttctctgatgcaaatatttggtttctccttatttcctctacttcattctattattttctcctatttacgctctataattgagtttcactgaactctattttctggaacaggtaatcaagcactttcttttcaggctattccttccctgccggtgggacacatatacttcttccaatatccacgggagtaggaccttcttaaattatgtaggtacccaccttgagacatgtttattctctgtcatagaatcttattattttctttttgacttctgagtaattttctacatttgtgattacaactgaatggcttgaaatctactgcacttgaaggtaattttgctcattatattactatcacattatattatttttaggttgatttccaataaatcattaatctaatttgcaaatcattggaccaagtaaatattaatgtcatcagtaatattgtacatgttactttgtaatagcagtttgtattaatagagtacttaatttgtcaaaagctgtatggttactacgaggcataagttatctcatgtgatcttctcctcaaccgaataagatatacattattattctcaattttagaactgaggaaactaactcttgcagaagacaagataatttatttcagggatataatctgaatgaaatttgtttgactttaaagtgcaatatattataatatagtgattaaaacgtcaggttttggagtctgcaagtcaagagttcaaatcccagttccatcaaattattagccaggtaaataaacttcagttttctcatttaaaatgtagggataaaatagtaagtgcttataagattgtataagaaataaaaaatacttggaaaaaataattatttaattgcttatcactttgtggtctgtaagatataaccattagtcattaaggctgaaagatttagttgattttaataaaatcagtataacatgtcaaagtctgactagtccccaaatcttttgaatttctctttagtgtgttccttcaaatattattatctgtattaagtttcgagcgtggttaaagttatgtaaacattttagaaaattacaattgtgtttgtgtggaaattgtattattgtttttcactccaagtatagcaaaatgtaactttaagtcattctgaaagatccatgggggaaatttattataggtctatattctaagaactatttttttcttcatagagatattctttagagaatcacttgtgctttatataaataaaatgaataagtaaaaataaaaaatatgtggtatctgtaactataaacattagcataaataattgaaaaataaaatttaccatggacactgtaaaaataggtatttgtgagttttcgtgagattattatctaatattttgataggctttttgtaatcttttgtttgtaatagattctagaggactaagaaaaattcaagtttattaaaaagcattatttgatagttatgtaaattaatggctgccacagtatactatgtaaattctctaggttgtttaacttaattttaaattgataaaattaatactaatttgtgatggatataaaacttctactgaagttataattacacaatacaaataagatgtttatagaacatttgctggaaggttttacaggaattgcctcatttgaaactcaccattatatgtggtaaatgtgatttacatgttgcagaagaagaaactcaggcaaacaggatagagcaacttacccaagatcagacaactaataagtagcaaaactggaactcaaagttatgtctttaaaatctaaatcccatgatttttcacttactatatgatgagaaattaatcatttaaactaaaaaaaaagtgttctaataaagttaatgcattacttaactaatccctttaaaataattagatattattaataacaatacattgataaaatgcagtttgatgccactaagacttcatctttatattattagctactttaaagatttaaattaaaataaaccttgacaagataaataatgaagtcaatattttaaaatattacctaaaatctgatccgattctcttcccattttctggttctcctggatctgggcataaattggaagctgttttaatacctccctcatttactgcaacagcagggaaaaaagaaaaaagaaacaaaatatatgtgattagaaaatcgatgatattaattttaaaatatacataaaatgtattattgtattttgtcactataatcactgtcatttaagcatttgttaaactataattttataaaacaataaagaaagcaaaagcattttatgaactaatgagaaaataaatttgctgttcatattcaatgacttgtattagtcttgcctattaacacattaatatttatcacttttgtttttagtttccatcaaattggaaaatctctggaaacacattctcagggtatcagtgtccagagtttccattaatcactggcaacaaagaagtcaaccaccagttatgatagttttatttggatccttattatttttgaaggtgtaataaaaaatacgactttatgaaaaaagttcaaagttctaacacttcttatctggtatatgataaagcaatttgatctgccagcattaaaatacagcagtggtgcaaattactaggcatgcctttaaattattacataatggtgtaaaccaaaacaatggctttaccctcaagcaacttccatgaatatgatttatttagcttttgtgcacattttcagcagtttcttcaaagcagaaagtcaaagatgtattaattttttcagtgaatgtgaccacattggatatctaaatccccaagttagatttttattattcagtcagatagtactgaaatatctgagtgatattgtttaataaattcaatcttaaagtgaactggaggataaattctattattttactttttatcaatttacctgctttttttttagaaaaaatagtgcctaagtagagattccagagagaaaaaaaatctaaaccatccaatgcttgttgtcctccactgtgaactgaaaacacaggtagatctttcttgaaagaataaagatgactacttctacctctagatattctaatgcaataaatctatggtaggactctggcatcagttttttgggagtttttggtttttattttaaagagacagggtcttgctttgccatccatgctggtgtgcagcagcacaatcatagttcactgtagctttggaatcctggactcaagccatcctcttgccttggccatccaaggtgccaaagtgttgcggttgtaggtgtgagccattttaaaaataataatgactctcaaggtaattctaatataaagtcaaaattgagaaccactggactgctgaatatagtaatttaattcaaattgattcatcagataagaagatagctatcagacgactgcccaacagttatagttgtggtaaagttgtcgttttctaaattaaacatcggattttgcatgtttttacagcattctaaaaaaataattttcttagtattaccaaccatatccttcttgccaactgtattacagctcactaattcaaatcataggatatttatgtttttcttattctctaacttgctatacaatctctctttacctttctaggttttttggccactcttacttttgccgattctactacagcggacaaattgaaaggcattggctcacaactctctatatttgaatttccctcatgccttgacagaatgacctatatgctaatgacttctaattcttttgaagttcctttctcaatctttcaatggcctatttgattatctaccaaactttccattgtcatctaatctatctacttaaattcaacctaatcactttgatgcttttatgattccattttcatccacctacaatacatcttgaataccagaggaggactaaactttctaaaacacagttcttattactgctcaaatctccaattattctagattttctactgtatcaattttatttctcactagtcaccaacatgcatccatcacccaagtcccgttgtctgttcgctgttctgcaatttgctgaacatactgactccacacatttgtgttttctccatgtctccatgttttcctttccttcccctttagctatcaaaatcctatctaatattcaagacttagctcaagtcccacttcttccaaaagataatcactcattttttccatgttattctaatttatctttttaaatagcttggagtatttcatttggacaattttttatttaatttaaaattatcttaatacagtataaattaatagtttcacatacctttagttatctatagaaaaagattatatacttgataaaaatagagaaaaaacattattttaatatacctatttaatatattttcaacaaatatgtcctagttgtttgattgacaataccaccttatatttgttatcaaagaactgaacattttctgtgaaaaaatatcctctttccaatctttacaaggcttttggaaatattgtagtatatgtttattaaaatgtgactttttaaaatgtggcatgaaaatgaggaaaagaggtggcatgacttaagcctaactacttttttgtattatgacatataacacagattatagggtaatggacaagcagtttgtgaatacattattagaaaatagaaataagaaaaatcccattttttacatttcactgtcattttgtgttaaactaaaattttgttaaatattttatataaatttaaatgatagttaacacttacataatactataggtccagaactattctacatactttatgtgtattaccccatttagttctcacaaccatcttaggagtagctactattattttacacctcctacaggtgagaaaactgagtcatggagaggttaagaaatgtgtccaaagtcatactgctagttaatgggaatctatatttaaactcaggcagtctgatttgagaaattctactattaacccggagctctatagctgttcagaaagctcggcaaggcagaaactatgtcattaactacaattcaaaacacttttccaagcattttaccttaaaatgcagagcatgtgtataatttcaccactttcacctaattaatcccagttcttattattttgattgtcaagttatttctgtctgcttgaaagtgtcatttaaaccaccatttctggacatctgcaagaggaaaaactttccaatttaaaatgtaaggataatgagagagcttctgtgtggtacgtgtatttaatgttaactgtaaatatttaaaattttttaaattaagaaaaaaagtgcaatctatctttcatttcttttgatatttatgtatttcagaattgcccatagctaagtgatgccaagacaattaaatgaagttagtattcattcagtcatctgctttcatttcacagtgccattgatgcaattggacagatttatcacttttacttcttttaatttgcatagcaacttgcagcattttaagaatatgagtgctctctaaaagtttaattacatgaatagtgtaagtatgatttcttatggcttctgattttatatagcacataatataccctaaagataaaaataagtggactctgactaaaattcacctccacattacctcttccagctgcttacattgtcacttttctcagatttttaaaaattaatttaaatttttatttcaacttataatatcaagtgctttggatctttttctgaactcaaacaacactgatatcaacattgtattgttgttttttatactaaaacccttcacattctacaaagagttatctcttaactaatttagcttccctataaaatattgaatccttaagggttgaaaatatattttattcactcttttaccttcttagtctagcatagtgctgccatggaggaactgtggaataagtggataatatgaatgaataaaagtatggatttgaagaataagaaagaaaacacaatcatttatggcaggctcacagtttcctcataattccacaataatattctagaggagcctactaaagaattgagtggataatatgaatgaataaaagtatggatttgaagaaaaagaaagaaaacacaatcatttatggcaggctcacagtttcctcataattccacaaaaatattctagaggagcctactaaagaatttggaaagactactagttcattaattttaacattttaaaaatataaaacctgtttacttaattttttttaaatctatagtttcttttcttggtgaaatcaatttttgaaaaagaacacggggtagataggggcaattcagagttcaggtataaaagctgaaaaaaaaaaaatctgaatgagccttttaacagccaaactctgcccatgaacactactggagcttctttaatctcttgttaattcatttcttacttaaaatctaaaggtgccattatgagacctttaaatacacacatactttggcagtttgggaatttgatgtcctccatgcttatactgactttgggccgtgcccatcatagaattgatctttttttcaaagaacatgagctttattattttttcttatttgaaagacgaatgtcagataaaaactttctttttaattattttgtcctaggttgaataaataatattaaagagatcaatatctgaatgtgtatttgaaatagatatataataatgatacaaattaaaacaatataactctactgcaaacaaccatgaaagaatatgtttttgaaatgagttattaaatactttagaaacaaattatagtaaaatgaaatttaaaataatgttggcttgctattttatgacaggaaatttgcaaaaaatattttgactgaagtgagaattacttatcttcaaaaaaatgaaaaaccaagagtatttaaaaagatttttatagaaaatacaatgaataaatgcaaaatttattttaaaattatggagcaaattaacatttttgcctcatattagctttttgcctattttaaagcaaatatttcttaaacaagatatttttattagaattttttttcctagatatacacccatgtctaaattccctttttgttcaccttcacaacccatgtacaagaaaagtggaaataatatatatttccactaaggcaatataccaacagggatatagagttacatacatcttacaatgccttgataaatcctagatctcttagtacaaatagcctgaatttccctgaacatttggaagtttgaaccatgcaacatgtcaaataacatacgtgtagacaaattgagaagagggtaagccattctaatacgctgtaattctacttagaattcagaaataaatatattggctacacaaaatattagaaaaaaatgtagtaaacataacatttaattttgctaacatttaagttttatttcatgatgacctgaagaaatttgatatgtaagagtcatctcacctggtgattttttaaatttgtctttttttatcatagaaaatacatctttctctcaaaaatgtgttgaataatttctataaaagtcatattgtagcattgcttattttccttaaaaactaacagtatcaatcttgaaaatgattttagcccccaaaatacatgaagaaatattaattatacaaccaaaccctttgaaattagctgtttagtgcttttgaaacaggtaaccctaccagatcaatggtttcctagtgatatctcttctggttttggattaatattctcaagtctaactaataaaatgtaaaaatcacatttgaaaattatgacaccattaatatttgatataagactccaagtttgtttctcgataattgatataactgctcaatttttgtcaattactgtttatatgtacaagtcaataaacatatagataaagtcctttttgatatagctataataaatgatttttgttaaagaaataattataaacttatttcatgaggtcatttggaactgaagaaaaataaagttaaaaaatatactcttgttgaagaataaaagtaacaacatgtatgaaatttgaaataactacttatatattagcaatgttattttggaagtcaagtattgtgtcataaatggcttgcttcaaagtttctaatatgcaacagtattgttgacaatttcctaattttgactacaaaaatacatagctctactaaaaaaatttcgtgtttggttatggtaatttaaatgaatgctctaattcagtgattcttaatctgagattttgggatgaacttcagagccctgattttgtaagtgaaattgtgtacttcaggccatttttaaagattttcaagaagtgaatagcaataattaatcaatcattttataaaatatttgatttcataggtttatctaaattacctcaaattaagacttgttttttctgaaatgaaaattgctatcttaaaagtaatatttcttagaaaagcacttatgttgaaattaagatatagtcaatcaagaattcctacaagaaaccaccaattttagaaatgttactcattttcgcctcaccttctagaactaaacttgagtgtcctcaagacttaagatcaaaagaatatttttacatcttgaaatataaaataaactttatcaaaaataatctgaggctgggagtttgccacgttaatccattaaatcaatatacattaaaatataaaatattgaataatcatcatgcatgttacacagatattaatgcagttaatttggtaaatacacaaatattttggtaaaacacatacaaacaacacagacaccacaaacttcactcttgcactagagaaagtaacaaaaaagaagtacactcacagatagaaaacttgttgctgttgtctttccctggaaacaatttaaatcctctagatttaaaatctatggcctttttcactagttaagaaaacaaacaaaaacatgtatcaggaaatacaattttaaaatgaaattcaagttaacaaattttgttagcatggacttatgcaagataaagaaaccactttcttaagcctgatatagtacccagaagaattttttttaaagcaatataatcacttagtagtaaaatactaagcagtgtagaatgattttaaatattctacagggaaaatcctgcatatacatagttttttaagctgtgcttttttaaactgtccagatttttatataaaagtgaaatcttagcagtttatgataaaccacttgaaatcatcaacttttacggaataaattaaactagcaaagtaaaaatgctggagtattagaatagtgggaaggatttaataggtttgttctttaaaataaatttcctaaaaatttagtctatttgaaatgttagaacacatttaagaaaatgacttaattagaaaagtttaaaatttattttaatagctctgtcaatcatttccattcattatcattgcttttgacactacaattgctgttagtccatattgcacaaaatgtatgaaagtgaactacagctattttgagcccatctaaaatatcttactacaatttttagatatagtagttgtacatatttatggcgtacataggatattttgatataagcatacaatgtgtaatgatcaaatctgagtaattggcacattcatcactgcaaatatctattatgtctttgtgttgaaaatattccaaatcttctagctattttgaaatataagatactgttaaatatagttgccctattgtgctatcaaatgctagaacttatgtcttcttatccttctatcttactgtatgtaattttgtccccattgaccaatcactcctcatcacccttccctacttcaattattttcttttacaaaacatggtatatacaggaaataacttgctcagttacagtgtggaaatctttacatattactttttatcaggtttatagtgaaggatgacagccttaaatgttatgcaattaggttttcttcatgctataaatttaaaaaaaagcaaaaatgattttttgttagatggcttaaaattaccacttcactatttctgaacgtcattctaagcaattagttcaaattatggatatttattggtttatgaaacattttaaggtaatttttttcttgttaataacttcaaaagtaggatagtagagaaagggcctgatggtttatgtgaatataagatatgaactatctatacacacagcatatattttaaaaaaagaggaatattatcgttggagcaggatttataaggctgattcttagttattattagttgtgggattttggacaagaatctgcctttttacctgcttttttctcttaaataagcagctaagactagatggcttctctctttatagtttaagattctttaactgtgaatccttattcatggtgaaaaaatgactacatccctcccaagtgacgctttttgttgtgattctcttctaccctcatccccaccccgatggtaacctaaagtttaattcttctgaagtgttcaactgctctaagtttagttttgtcacatgtgaattttctgctgtctcaaaatactttttaacaaaatctgcattttgtattttctggcataattctagatttttccattggaaacatgaattataagtaggaatctacctctacttttctctgcattataagatttgactttataagtattaaaaataggtctgaagatttcatggtgattttaacacgtctggatttcaaaaagaataaagaaaactaaaggaaaagattatcagaccaaaggagaaaatgcaaaagaataaaatcctacggatcaaagagttcaatgttgtaaataataagttactaatattggggggcagtggcagtgtgtgtaaaaggggacagattagcatgcctacttacaagtatcttgatttaattatttggttgggtaaggttttcctgcttctaaaagcaccttagttttctcttttataagcatctatatgtcaatttatctttaataatgatacatctatactttttaaataaaaactataataattgtaatacagatgcagaagatgaaaggtcaggagaatatccatttttggacatgacaaagtgtgaattaacaacataaaatttaaattcacaaaaaatttaaaatatgttaaacagaagacaaatattttagctgtttatatttttaacggaaagaataatgtatatctcctaataaataaattaaaaaaataaatattgcaagtattaattacaagactattctaaatcatgtatcaggtatttaatattacaatatataccataaaatatagatttcacgatttataaaagatacagagcataaatcttgacttgtcatcaagtaatgagtgcttctaatgaccatatttaacttagaaaattaacctgattttttaacctgatgcatttcagtaataagcatgtaaaatttattgtagagttaatgttaaaataaattatggtattttatacaggttaaggaaaatgtttacacagtgtgtcatgtgtggcaattccctccactgtatggtaagctcctcaaaggcagaaaaaatattttgttcatgtcatatttttgtttgtttgtttgttttgagaatgagtatcgctcggtcgcccaggctggagtgcagtggcgcgatctcggctcactggaacctccgtcccccggattcaagcagttctcctgcctcagcccctcgagtagctgggattacaggcgtgtgacacacgcggctaattttcgtagttataatagagacggagtttagccgtgttggccaggctggtctcaaactcctgtcaggtgaactgcctgccttgtccttccaaagtgctgggaaacggtgtaaacccacagctcccgggcgtgtttgtgtgttttttgagacggagtctcgctcagtcgcccaggctggagagcagtggcgtgatctcggctcactgcaacctccgcctcccaggatcaagcgattctcctgctacagcctcccaagtagctggggttacaagcgcgcaccaccgcgcccagatattttttgtattttagtagagacagggtttcaccatgttggccaggctggtctcgatctcttgacctcaaatgatccacctgccccggcctccaaaagtgcatgtcgtatttgtatgagtgtatgaatgaatatatataatattgttaattctgagtcttttaactaaaggtattttgttgggagaattccctttattgatcgtgaactatgatgggaggaagtgattttaaaaaatgaacacccaagatgaagcactttcatttgtaaatctcaagatgaaatacagaaaaactatgtatgctctaataattttagaaagcattaaatgcaagattgataggcatatgcacaaagattcattttcttttctttcatatgctaaacaatttttaatcatttttaaaatttttcattacatgttcagtttgactgtttttttgtttagtgtaatagaaatattttataatacaagaaaggcctggcagggaagaatatcaggccagcaatcaaatccctctttatttagttgtaagccctggacactagcaaaagcactttgttttgtaacttgtattagagtagttttaagccacgtagtggattatcactgtggcgtcttccaggttgtccgttgtcttcaagatcaatataaattcaaaattgcatttaaaaacttacaaaaaaagatattgattgactcttacttaaacctcatctaattttcatgttaatcagctaaagtcattatttgaaatgatttaaattaaaatgcctactataaaaattaaccatatattcacgcatataaatcatagattgattttgtttccaatatcaacttttttgatgaaacaggcatttgtctttatgttttatgttacaaaaactttgtaagtgtaacttgagaacatctggtattggtgggataaaatagattgggaagtactatatttagtgttggtactggcctttaatgttaggaaatcgatcatattaaataggtgtagtagaaggaatttaagtacaagttggagatttggaaaaggtgaccttcaattggtccttttatcactaagcttctataacttaaagtaataaaacatttcctggcttgaagttcctctaaaaattgagtccttcattacataatctcaaaagttacatatctgaaatatattattctatttcattgctatgcatatatagtgaaaatatgtaatatgcagaacatttatctttgaaaaagaagaaacagacatgtttagtattagttagcagaacattgttttaattagaaataattaactttcatgtttgcatggggctctcttagaagacagtggcatttattaaatgttttcagaacagtctgaagcgctcctcattttccacttggattatattctaagacaataatgaaggtaaaatgaatggtatactctaactttgtatttattttattcttccaagtttgtggtatttattttaacaataaagtatcttggaagtgtcagtagctgtattataaacctataattcaatcatatcataattcttttaaaaaggaaaataagttcttatgaacaagtaactagtatcttgtttatgtttttgtttatttctgcttcattgtaacctttcttttcaaatgtacaataatgcctttctcgtcttcttttgtgctgtgtttgatatgatacctggatgtgcgtttcccactttttattttgaatttattaattataatcttatcttttactttatagtaaactaataaactatactactaatacaataatttccttttaatgttttggatattgaaaataactaacatgtctctaggcgtgtatttgattttgagaaagtggcacatatcactattgacaatagatttatttacatgagtactaagactaatcagtcactgactaggaggttaaagtaatattaaaacagagtgtgttatttttggcattttgcttagtggattaggagttagcagacctatgttctgagtctataagacatgggacatgtcgattaacttttctattcagttctaagagatgtaattcttaactatttaggagtagaatttgggtgaaaggaaataaagactaatgtcatcagaattatcagttctattccagagatttaaatgtgtaggggagttataaaattatttaactgtataaagatgacttttttttgtttgtttaaaagtaaatagtggctctatgttagaagtcagcaagtacaaaaatttaacttttttttttttctacatcctgtactggctgaacaaaacacttttcagaacatacttatcacagaggctgctaatgatgacttctttgatgtaatccttagacaaagaaaaatcaagaaactatactgctgctagattgaaaactaaacaatatttctgcagtatctcctttaacatctttcatataagatttactactgtattaataatacaatcttctgagaaaacaatacatcttataaatgtttctgtagcataatttttaaaaaagtgactagaggtatcctgcaacaattagataatgtttctgggttacacaggaagacgatataatagaaaactcagtgacataatgttaagtagctcatgaatctttgtgaaaaatatttcatttcaaaatatgtttaaaataaatgaagataaactttgtataaagaaaagcaatggccataatttgatgagaaatgtagtagtacaactaagtattttaaaaagcacacaaaaaataaaaattaaaaaaagttcttaaagtacagaaaaattcattggtagagataaacatactagggatacacgagagttaacatatttttgaattcataaatgatggaactgaactagttaaatttattaggaaatagtatatattcatttttataattatgtaaaatcgtaatgtactctccatttaaaaaatcattagagacaagtaatatggttcagaacagccaatacatttttttaaatcttaaactcctaattatgccacaatgctcatttgtacatagcacttactcttgcatgtttgatgtgtaaatatcaaatgtatgtgatgctcaatttttaggtgaaagaaaatatataatcacaattttactattgtgcttaaattacacaataaattttagaaatcaacatgtagcaagaatctttaaatgttagttatttgtactaatattatttaccatttataatattaaggtctagttagtctcagaagccattctgatttgtgatgcaatataccaaaaatttgttaactattttgtgttatgtctttttcactatgtagggatgatacacaaaatatattatctatgttctctgaatttctaacttaaattttacttttctatttaaagttagaaacctctccaaaactttgatcaaaatggaaaatttagtagaaatgtataaaaccatataaatacaatcatattgattatatgaataattatttaacgtatttcaagattctccactaacaagaccattttctattttacaaaagaagatcctgaagctacaatgtcttagtgttgaaatgaggttgacctagtttctaaatatttggaatcttatttttcaatcattttaggctaagaaataagtgtaaatttttcacttggaaaactgaacagagtggtgagtatggagaggagacactgtgttttaataaaactaatttgttaattttcataggcattaaggattggataaagttattgatttttatttaggagaccgtgaacagactgcaaaactatataaaaaatcatgtaactaatcattgcataaagactctaaaatttgtatatgggctttctttcttcctagaaatggagcaaattcaggaaaccatagcacttacgcagataacagcagatgcacctgcaatgcttggcgtaacaggtcttacagttatggtatgctgtaaaatgtcaggattatatgaaaaatgtgggatttttatattctctttagggattcttataattggcataataaaagtcaccatatgggaagggttaccattggtatagttcacagatacttttaacactttaaaactgtctgcccttaatttaattgtttttaatctttattttctgacagcttcaaattaactttttaaattgttttcggttgtacagttaatattaatatccactcaatttatgcactttcttgggactttttttttctgatatattatgttctctagaatacaagtgattttcttttcttttgttttgtttctaattggtattttcatttcaaaagttaattttatcatagataatttgattgtaaattgtaacatgaaaaatgataactaatattttcttactcatgataaaatattattacattaaatatttgtttcgcactcaacataagaaatcacttatgtatattataaggccttctaatatgagattaattaggaaagaagaaactttttgaaaaacagcagccaaagttaatgactttcttcagactgtggacagtggcatatagtcttccactatgaatttcattagtgcattgaataattttataaatttacaaaaaaaaaatacagaaagaaacagaagaaaattaattgctttaataaataacaacagtccatcatccctgtgatttcaggtcattatattttactaaaattcactagaaatattaatatcagtgcctagattctgtttaaaataaacatagatgggttctgatggttgtatttaatgcagtgttttactgctaatttcatggctattcaaaatgccaacacactcatcatacccatctatgttttatatttccctttccaggtccattctccctattctcctccttgttctctgcccagaaatttgatctgaatggctacatccttgctacacaaattgtgacattgcattagaagcactggcgtcacctgggagcttgttagaaaagcagaatatagagcactactgagaactattgaattagaatctgcagtttaacaagatccccaggtgattcttcctaacatttaagcttttgaagcagtagactctatcaacagactcccttaacctctgggggattccagcaggcggatgaagggagggaggaaagtaagaccagaatttttattccacaggattcctcaccattgcaattattggagtttgctggactcttaattaaagggcatttgtcttttaatgcaaggctacaataggactttgtccaacatctcactttcttccttatcccaacaacgtgggaatcgtaacagcccagctgctgctaccataggttacagcatggttccttatggtttctttacattcactcattcggaaataatcctttgtaagtaaaacttcctcaaattaggcaacattctattgttttgaaatgtactctgatgaacatacctctggtacatggaaattattagagatttaattgaaatctacatctcagatactgtattcaacatctcttaatttttttatgaccaccattatacttcaaaggataatatctaggtagaattattgttggctgttgctcatcatcctaccattggttgttcactcatttcttagaaaatgttttgaaaatctagacaacgcaactgtgctgttttctagcaattatgtctgtaagaaacacagagattcacaaagatagagtagataaacaaaatttaaatgcgttggctgtattgaaattgaaaagtaattcaatgaaaagtaaaactggcaagaaaaaatatggagttaatagaaatctgagatgagttgaatgttacactttacttttgtataacttatacatgagagcaatatgaatagtgttaaatcaaactgtatatattcgtatccaatattccatatcaatattgcattaaactatgtattttttcctaaggaaataagctacctaagacatttaaaactgtgctaatttttttaaataaatttgttcacatttatctttaccttacaggatttttatataaccagagtatattttcttcttgcaaatgatccagaaaggggcagtatcatttactggctgtgcatctaaagcattaggtactctatgtgtactatctcattgaaatcacaaaatatccatgcaaaattatcgcccctttcaaaaaatgtagaaatggagaagagctaaattaattgcccaaggttatctatatgttaataaaatatggtcattcatttgactctaaaacttcaatactatcatctataccatctgactatagataacataattccatatattcagtcagaactctctcaagtgcgtatcttagaaaaccataaatagatgcaattagtgtatcctatcctaatttattaattttgatataaaattttaagtaatcaataatatttgaccctaaatatgtttaccttcataaggcacaaaagctttattaactggatttaatattgaatgaagacatcaactatctgatgatagtgccaagtataaccccgtggcctgaagcctcataatactttattttaaaggtgtgaacagatgaaattaaaaggtgtagcaaaaccaactgctatgtgaaattcaaataatcatctagtccttttagtaaaatcatctttggctgcattcctttctaaagggaaagttcagaagagttgatgagacttttttttcccccttaatataagcctcctcaatgaaaaatttctaacatctctgggctctggataaaattaatctagaaatttctgtcactttagtttcatttgctattatgagaaaatacaattggaagaataatttaaataaagagagatcaagcatcaacagtaaaaagcaatagtccatgctttagaatacaaatgatgtaattgtgaagagaaaaatatcctacgcaatgcaccctaaacctaacaccacgctgttctgccacatatgaaggttctgctcttcctaaaattgtaaagattagttgtgtggtttcactctgcgcacagcagggtagccatatgctctagaaaactacatgcaaggaaagcagcttgttgcaaaagtgggtgaaaatgccctgaaataattctgaacaagataaaaatgtctctacataggaccatttcttcatattccaaaaggcagaggagtctgctttggcatcagctttgagcacaaatagaaagtctagccccatcaaaatattttaacaaagaaaaagatttaaaagtcacatacgccacattcactgtgacgatctcattcacaggtaaaagaagctctggtaaccatttggggaaatcagctacacacataatggtttcatctctgatctttaaagttaagctttctcttttgatcaattcagtacatattattatctttccttatttactcattctattaaaaatgagatatagtgtgttaatataaaaataagctaacaagatatctgattaacggttacaggtgaaaaaaacaaagtggctgaaaatctgaaaaaaatatataggtttccttaaagacctactcaaaggaaataagaacattgacatcagaaattcttaaaatctttacataggactaactcaaaagcatggcttgaagggtagcattggataaaaatgttaaaatggttacttgcagatttgccatttgtgaataaaataaattttcattgtttaatattgtcattcaagtcctcaggcattctgagtacttttatctaatacattttaaatgtgcataaacccgttaacaagtaaattctaacattttattttttctcttctttcttcttaaaaacaacttatttaacaaaacataaaagaattagaaatataaaaatgtatttactgtcatgaatgacattgctttgacaatttcaaaaatgtgatgaaataaggtaatggatagaaaataaggatgctattcaataaatatgtatttaaatgataaattggtacatttctgaacatgaattattaaatagctctataaacattaaacacaactttccattaaataacataattagggaaagtcaagagaacaatggaaaaagtaaacaaaaagtatggcaggatattgataaagcatacaatgatcaatatttgtatgtaactctccacccaaaatgttgacattcccctattttttgtattcactttaccaatgtcaaagttccgacatccaaaataaataaataaaatgaataaaattaagtaattctataagaattatacataaccagataattttttaaaagttataaattctgcagtctattattagttatgctttaaagatgctattaaaataaatacattagttagtctcataaataaagacctgggaattcaagcagacaaaggtaatttcaccatatatataaaataagaaaacaatgcttaaagattaactcctcagaatttttgatttggcatcaacttttgtatacttttcttttttctctttattttcttttcttcttctttttttcatttttaaaaatttttttttttactgttttacctccatctatcaacctttcagggatttgaaacatggtaagtaaagggaaactaaaccctgatgtatttttctctttgttatttgatacattgaaaaataacaaccattttaaagtatagaattttgagtaaaatttaaaatttagagctaaaatttgacttggtgttgattttcttattcatctattcctttattgatctttccagtaaaatcataatgaatgtcaatagctcagccattcttaaaggttgccaaaactaattagtgtcattaacattgattcagaaaatccatctgccttaaaatatcccttgcactcataaatttcccaccatttgagtcactcgtatggaataaagtttagtttttactatattatccaagatagcttgtcaacactgtgattatcctagtggagaacaaaatcctatgaggaatagacagtgttgggactgtgtgataaatgttgttctctctccatgatgatcatcttcatctaagttcttgctactcagtgtatgagcaaacctagagatctgttagaaatgcgaaatctcagatccaactccaattccatcaagtcatgatctgcatttgaacaagactactagatgattcatgtccacaatgaaatttgaaaagcgtactataagacctatactccaagaaactatcaactgttacttgcatttctgtatcttattatttgtctgcttgctcctattcacttgaaatttcttcttcaaattcatgctaaagtgactcctttaaaaattacatttgataatatatgttccctgctaatgtccaccaatggtttagataaaaataaagctcatttttgaggcctaaaagccaaatggtgtttttcctacctatgtttcccacctcatctaccttactctcctcctggtgcactgagtacaagaattagtaggttttatttttctcaagttaaactgaagctttttttaactagctgttttttttcctggtgtgctttctcctctgagaaatttcaaggcatagctccaagagcatctctgtctgctttctgttgtttaggtctcagtttaaattttaactccccagagtcctttccttaccatccaaactaaggcagcaatccatctatcatatagcctattttgattttctgcacagcccttattaccatcagacaattatttacttgtttattgtctttttcttcctcacttgaatataagttcaataaagcagggtctactaagttttgttcaatactgtatacccagcaactggaagacagcttggcactcagtggatatttgtgagagagaaaaaaaaattaaaagaaaagaagatggaacagaaaaaaactgaaaagaagtaaagagaaaaaagaaaaacaaagaaaaaatgaaaagaaagaataaagaaaaatgagtgaataaatacatagtagaatgtggtagtgaagagagtaagaatagcactgtcatctgttgttagaaataacactgcctaaaagaacagctaggactggacctccaaataaagaagttttcgaatttaaggcatagatgtgggcattgggcccagaaaaaaaaaagtaaatatggctgatttcacatttaatgagataagtagattgttaatctctaaattccttgatggtagcattggccacttctatgtttgtttttacactggctataaataatcattaaaataagtacatgtcagctcaacaccagtagggaatataaagtgatggtaaatacattaattaatatataatatttctctatagaatcatagacttttgggattaaaagggacagtggcaatcatattattaagatattatttgatgctttagtgatttctaaatacccacattgtccattacaacctatgcttgaatgtctttgagaattcactgcttctagtagcacacaatctatatttgaaaaaaaaaaactgaatgttaaatcagtcttctttataataaactgctttgcactgtcttatggttccctacactaaattctacaacctatgccagaggacagatttaatctctcttacacagaacaacatatcaagcatttcaagacagttttacctcatccttcctcacatgccatacccattctgtggtaattctttctcttataattgacctataatttttctctgtaatctaatctctacaactttttctttgggaataaacactatgcaatatacttttgaattcaccacttgctcagtgaaagataagatgtacaataaaaccctgataattgattacttgctgggcatacattagtatccataaaaatatatttacatgactactcataaactagctccctcattgtgatgatgcttattaagattttaaaaacaacatattttagatttagaaattcatactttataaaagtcttaatacaatatttgaaaacagtgttagttgcttgcaaacacttgaaaacatttaaaatatattttatgcataataatatagcctattagtgatgggcacataataagcacctaaaaattgttactttcacacaatgcagtttttgatgtaaaagagtgttacaccagttcttgaatcaaatttgtgacatagtaatcttctgacataaactggcaatttaatgtgaatattaaatctgtatgattgtttgctgttttcttatttttgttgagccttataaatattcagatgagcttacttgaaaacaatataaattatggtaacaataaaaaattcctgcttctttggattaaaattgctcacctaaaataaacgttttatgctgaattaaccattcttaccttaaacctaagaataataaataatgtacttatttaaaaactgttaaactagagtttcttttaagctctagtgttggaggagaaaagtctacatcatattcaatctcaattcagcataatttcatgtaactttattaaccaaagtaatatcctactgatatgatcattaccattaaatgtactgtggcataattgactatactaggtcaaaataaacagtagtaatgtctataaaaacctcataacatatatttatttaattccataagatgttgtagttatctaagttaaattcccatcgggaagtccaataaaaaataataattattatatgtgtatatgaaaacgttcccagaagaatatacccaaattttgtacttaaaaacagcaactatcaaaactgctctttaacagctgataggacttgtccacatattgaaaaaatttctattattctactaaagtctccaagaaaagtaatgctaaagcaaaatacagtggagtaaaacacatcttaattattatttaacataataaaatatgacaaataactccttgagaaaggatacccaattgtgcttataatctgttatttcaagtttaacatcacttaatgaaagaccacatatcagacactaaatgaatcttgaatgaatcaatactagtctaggactatcaatactagtctaagactgggtttttatacagtttctgccagtccataattttctccacaaaataatgatatttactagataatttgtaagttcccacctaattctaaaatagataattctagaaatccaggaaaatttacttattatttctaaaatcatgtcattacataggttcttctattttcaagtcaatgttaggtaaattcctaaggctgtaatattgagctttagggtttagggattattgaaaaagatattttaagttaaatattaacttaaatatggcatgaacccaggaggcggagcttgcagtgagccgagatcatgccactgcactccagcttgggtgacagagctagactccctctcaaaaaaaaaaaaaaaaaaaaagaaaagatatcaaaagagatcttatagctaaggcagtaaattattctgatgaatttacaaatgtcactagatatatatccgttatctaattttaaacatctggatattttgtaaataaaaagtcaattatttttaagcttacttacattaatgtatgtcttccttcaaacataaaacaacttatttatttttgttgcagactaatatttctattcagcctaaatacccactcaaaccattttgaatgggtcttagtgacataaatataatttactagtttcaaacattaattcagcttgctttcttttctttttttttttttttatatggagcctctctctgttgctcaggctggagtgcagtggtgcgatctcggctcactgcaagctctgcctcctgggttcacgctattctcctgcctcggcctcccgagtagctgggactacaggcgcccgccaccacgcccagctaattttttgtatttttattagagatggggtttcaccgtgtaagccaggatggtctcaatctactgacctcgttattcacccgtctcggcctcccaaagtgctgggatgacaggcgtgggccaccacgcctggcctcatctttcaataattagttcaaatattctctgagcagccctctttgactcatatttagaggttgtcagtccctctactgtaattcaataacatttcaaaaatactgctatgtaagtgtttctcataataaatttgtgattcttcttttttatttaaagttatgtagaccgctctatggcattgattgtattgttcattctcatgtacctgctatccagtacaatgtcatgcacatcacaagagctaaaacatattttgtgaataaaatgaaaataacaaccatcctatgacacaggtgttctcagctactgagaagttgtgactttgggaattgaacttattgctcaagatcataaagctaacaaggggcagagtatagtctcagcctagttctttgaccaaaactcaaagttgatagtaagcaattcttttttatctttccattgggagaaaatacctaagagtttatggcacttccaatcattactatgtttaatgcttataacaaccctgatgtaatattttgatactacaaaaactactttgcaaatataaaattttagctataattgttcatttgacctgaacaaactctcacacatagtagtttgcaaaggtggactaaaatgcagtcaaaaatattaagttctcattttgaggactattgtacactaatacagcaaagtgaggtgtggtgttaatatgcatttttaatagatctaaaccaacattgtttattttcttcctcttttgcttctttttatctcaacgtgcaaagaatcttcaaatggaggagactgcaaataattttctgctactgagaaaaagtagaaaataaaaattttaagataatttaaattgttgatgttttaactatagtacaataggaaaattaattggaatggtaccctataaagaattgaaaatatctttgagaaatattttaagtttttccagattattcattaattttacagttgttatttaaataaaagttatagtgagtttatttaatttatctatgtgttaattcacttaattaacacatagattagtctgtacacattaagtacaaaatactgtgtgtaatccatgtttctatgtgttcataataatattgatgtcaattattaatacatgccccagtttatgaaaacagataaactgggaaccattaatgatcaaaagacataaaactgaaagtttaactggaatgtgaataaaaaaattaaaaatattaaattattacatactgcaaaatagcatgaacttgcagacatcgaacggacctatgctatagtaatctcttatatttatgttttacactgtaattaacttcaacaaaataatattcagtagaatattttttcataggatatttttgactttatagtttgctaatggttaattataaaattattttgattttataatcattcaagggctaaaagcaaggcctttatatccagttccattttgtgaattttgaaccagtaatacaataaaagcaatatattattatggattaatgaaaatattgttgcctttatttaaaaaaaactggtattataactgtgacaaaatgtagttatctttaatactgaaatatgtagagatttcattatcttgaagaaggtaatttcaagcctttaaataatttaagtaaattttctagcaagtgaaattataaacacttattcattagtttgacaactattttttaaaaaatatctattggtcagaaactgtactaagtactgaaaatgcagcatgaataaaacccacccactccttatcctcagagagcttaaattttacaggaaaatttatagggctgatgattacaaatgcaagctgcaatggcaagttataagaggaatatctaaccttcctagaggtaacaatttaagctaaatcttggaaattagaattatgtggttaaaaggaacaaggattagcttctcagagtatccttagggagaaaagaatacagtgtttggctaattaaaataaattgtgttttgcaaaataatagagtgattgtgagagttacatgcgatgaatttggaaatatggaaaaaagtcagatcatgcagtttcccgtgggtcatcaccaagtctctgctttattcttaagagcattgattaatcactgaaagctttaaaagagtagtgttatacgactggatttttatttgtaaaagttcattttaactatattgtggataatagatcagaggaataagtttttttctgaaatatctaaaaaaattaagcaattggttttcggttgtttaccaactcattgaaaaagtaacttaaaagactcactctctgcatacacactgtaacttctttagtactttgatcagaattcattttacaaaatctatcttgtaccactagaatgggtttttctatgtcctcgactctattgcaatgtcctgcaggaaggggacatgcattatttatctttatttcctctagaacagaatctggtactgagtaagcattttaggcatgtgtctgagccaaaattattattttaaaaataatactagttagatgtcagccatttccagtttagaaatttggacctgctggtaatcaagtcttagaagatagtttcataactaagagcatagctatattttgagaacttcagaaaacactaagcaatagaatagtaggtttcccctactcttaacattgatgaatatttttgcccataatattaagagattgtgtctagagtgtaatagataagtagcaaaccaaaatcactgaactagtagtaagttattgaagaagaaacagaagaaccaatttgaattaaagtagaaagttgataaaagtataacaatttaagtcactgtcaataatgatgaatacattaaaaatgttttccatataatgttttacatctactttgaaaaataaatgaggaatacatttccaaggtacatggcaccactgaatgcatattaaattcaaaatcaccattttgtaaagaatatggggaaaggtaaaacaggtatcaatctctcaaacagcactgggagcttatgataataatggagaaagtttgagcactgattgggaatctacccgggaagtactcttgaagcttaattaaaatttacttgaagaaacttaaacattttatatggaaccaccttaaaagtatttaatttaatttaatggttgactattaaacttttctattttcagtctgcattattgttccaagttacataaaattttaatttataaccacaaagtttatcacaccacttgacggcaaactttggctaaagtagaaattgtattattagttggttttacaataaacttatgtcagaaattatcctccttctatatgatgggtaataaaataatttccagatagcctaccaatattagctcatgcaattttccaaagagaatgaaaaaatagtttttaacattttaatataattttacctatttaaattttctggtaataagacaaaaactgtttactttattgagtaaatcacaaattttaacacggtccctatattcttataaatggtaatatttataataggaaagtgaatatagaatcaaggtgatattgatttaatctttttgagaagactattataggttaaaaattcattttagaatgtgcctcattaaagagaatcaaagtaagtattttcagtacaaattcgaatggaaacaaacttctgagatatttttgtattatttttaattaatgtatgtaaagatgtcttgatttctatccttcttgtgctctaagtattgagcacaatacttatacagaccattacttaaatcatggtctgtataaaccatgcctaatcacactgcaaaaaccatagccagtttagagaaaatattttgatatcttggaaatgtagtagatattttatacttgaaatatgttcaattaattaatgttcttacagatacatatatcgatataaataaagaccttttattattttatactacattgaatttttttcctaaacttctctatgacacttgccaccaagaaacagaaaaatgtattttctagacttccttattttgtaaaaggtaggcttatattaactgagtagaaaattaccaatgtaagatgtggttttatgtcatttttctctaaaaataaattagacatttaaagaatacttaaattttggaggcatactatcaatgaatagctgttaccttttcaaaatgagaaatctttcaatgcaatcatatgggtcaggcaaagaataagctatgtaaaacgatcaccagatataatgtttctatgtttcccaatcaaactgtacatattctcaagtactaactaacatttgcataacataaaaatatcatgcaaacgctaaaaattactacatgggataaatcatctatgtgtaaatatatgcacttattaatcaaaactggctactttattttcctgttttgtgaacatcatcataactggtatggaataaataataagtatttggtacttgtttttactgtcctgtttaaaaatgatttctgttctacttttaccccctccccctccaacatttgcattgcactttgacttatttttaaatttcaatttctatgctttcaaattattccagttttggttgttactatccatatttttcagctactttgaactttttcttttgctttctatatcttggctctctttcagctcattctctaattagaatcattaccaaaatatagctttggctgtaactaaatgggcacaagtaaaataacatccaatacctctatgagtaacaactgcaagctctttagttctttctatctgttcagcatgtcttggtcttctcctggtactttgtgtatctgctggatgaggagagagcccgtccttggacgtgttggggtccagacctgaatttctgagactcgtaacttgcactcgctgttcctcggaaagtctatggatggtgacagctgtaacactggatacagtaacatctgcaggtgtgctagcaacagcaatagcaccagtggtagtcctgttatgctcctctaactcaccagtggaggtagtgtgggtcaatgtagaagaacctgtgggacacagtagcactagatgctaactttttctttttaaattttgtttattttttctgataaatttaatcaatcatattctcttctattaccttaaggataatcaacatgaagaggcaaaacacaaacacgcgagtaaattgtgaagcgcactagatctgtcggtttgtttctatcaaccatcctatggatagatatacacacaaaatataccacattttaactgtaatacattgaagagagcaggtaaaagggtaaaccctttatgtggccctgaatcaatcttttaaaaaaatctacagatgaattttagcaacgaatgcctggcaagtgtcaggttttgatggaatgggtaactatgtaaccacacttttctcaaaagtatgctttgaatagtctgccatatctcttcacagtttctgggaaaaatatcaaaattttctattttaagacaagcaagtgaagaaaagagaatttaaaatcaaagccaaaatgaaaacaaatgatgaaaaaaaaggggcactaaaataaccactatatgaaaatgtgtttcttaacctcatttgtgatgagctaagtaccttagaatttatcaagtttttaaaaattagttaatactttctactatttttaagtaatattttagtttaaccaattctgaactaattaaaattaagcaaattatgaaatttggaagtggttgaaacttaactattattatacagcacgtaactttaattcacacaacgctagttttaacaattggttgggaatttctaaatatctcataagcatttcagagtgtgtatatgtgcgcatgtgtgtgtgtataatattaccacatttttattctaattaaatattttttaataatttagaagtatgtattcaaagtgtcaaattagagtttgctttttcattttatttaatgttttttaaaggaggttgttcatggtagttcataatacttatataatgaaaaaagtaactttataatagaagcatgaaattgaatgggggtatatttaaaaggatcttgacagctaaaatccttaacagcaacaaccaaaaaaaatattgaaatttggagctgcagctactcattaggaatcatagtcagatcccggttggaaaacttctgaatattttctaaagcccctgagtggtatatgtttttatacacttttcttcgcaacatttcaaaattctgttagcaatgtttacttagatattttagataacaatgctagggatattttaaccattctgaaagagaaaaaaaagcaatgtcaatatggtttgagaatactctgccttttttattttcctcttgtgctgtagacaggtgattagtaggactaataattctgctttctgccttaaattcaaaaaggaagaaaggaagtcaaacctggagcccctcactcacaggcaaacagaaaagcccatttctgcccctgattcttccaggttgagtcgtcatatctgaatttgattctagaaattcagaagtattaaatgatttttgtattttgaaagagccaaaagtaaatgaggtatgacgattatcaaattattttaaatattttaatgtttttaagcatgaatcagatagcttctattgaatatttatccaagttgttttgtgaataacctatttcatagatcagaatctactaagttcacattggttatataaatcaggttgcaatatttagtcagctaatatttgataataattttttaaccacatggttaagcaatagctatgcttgcactactaaaatacagtaattgaactcatggtaaactgtacatttgtgatgtgcagtttcatacatacatcatgatgagctcatgtgctcattactatgaaacctgatccatattgtcctcctagagtttaattgagcctttttatttttgacaggaatatgaaatcagagtaaaaactaatgctttaatatttttataacctcatcataattttcagactttcaggtttaattttaataaaagaaactattaactataaacatatgttggtaattataagctaaatttatgagaaataatggaatttatactatgtcacatgtctgagcacgcctacctttaccaaagggatggattaaattatcatattccatcagagtcattatgatcaatctcaaataatccctcgaatttgagtcaataaatctgagataatccttatgaacaggcttagggggcttaggctgcttctctaatcactcaagacctgcagacccaatccaaacactcactttcttgaagacctcaggggagaaacacagttccagaccaaattttggagttagaactgatctttggtaatgtctagacccaggactttctagcagtcccaatcttaaaatatttagcataagagctatacttcccaccaacggtgatgaagattcagtactattcccttaacctaaatttgggacagtgtttaaggttgaaataaagcattaaaccccagaatttatttaataatcataatctaaccagatatgtattccaaccaggtattttactaaccagttcttatgttttacttatatattgtgttcatattctttccacaccatactgggaagcaagctccctgaaggctaaaatttttgtatattgatttcactgctgaatccctagctcctagaacattgcctagcacatagtagatgctccaggaacattcatcagaagaaataataaataaagaatgaattcaataggactaaaataatattagcaataataaaaagacacatttcacaaatggaatatgattataattgttaccatgcaaaagtcgcatttcaaacagtgacatgaatgaagagcaatttcaaagcagggggaacataaaattttggttttaactttcaaaaacatcactttgaaaaagtgtggaatctgaagattaagttgcataagtaataattacttcaaaatttttgttgttatttccaaaacaaaagtttaatctgttagtataaaatagatttacttagaatattcaacgttgtgtagaattaaaaggggatatatgtcatgcttacagaaagtataaatgcatctaaacttagatatgtttgatacatatagtggaactataaagaaataacactgatttcctttttaaggtaataaagtcatccattaccatacagttatgtcatatattgcatttaccattttattttaatattaatggtttgaaatactgatattggtaatattttaaattggcagtgtatgaaacacagatttttaaattgtcaagattcaccacttaacagtttaaaaatactcaaaatttttgaatacacaactattttattaagtaattgccaatgctggaaaaagtcttagaattatgtatagcaataattcaatattaaatatacacatagctatccaatgttaaaaggatactttactttcatttttgaaaaaaattaagtatgctacacaattaggtaagcattgtctgacagcacagttaaatgtatatattacaagacataaaactcaaaggaagaaaacgtacattcagaaaactttcttcatttgatatcaaatgatatatacaaggtgtagcttatcacaattagattatcctgtcattaagttacttgagaaaaatctaaaaataagacgttcacaatatgaacttatctgaaatataattttaataatgctatttaacaaaatattcctaaactaacaaaaatgaaataaaaatgatttacatatataaacatgcttcactaagtcataactatatgtcatctatgaaattatgataatggaaaatcacttgttacacatataagtttgaaattttatttaatagtaatagtacaatgttaaatttgaaattttattatgtgttttcaaaaattttttgaaagttattaattttaacaaaatatgtaccaaataatacctcatgatagaatttgaacttcattttgattaaattttttgtcctatagtttaaaaattttatgttgtttctttgtaattattctctaactcattaccaaaataaaaaacagaatatattgctagagatatgcatggatgacccaaaatatataagaacatgtaaaaataactacatattcaaagaagtttttaggtacttatgtttagcacattatgttacataaattagtttaatatattctgttccttcctttaattttagtgtttcatatgaaacatttgaatggaaatttaacaaaataataataattttgtgacattgtgatatgtaataaagtaaaatgccataaatgtttaacattaaaacatctaaaataaaaattatatatacacaaataacaccaacataaagtctaaatactacgactaattctattcaagccatcatttggagagtcattagcatatgtaatttaatgtttgttatttttttcttcttttctttaatatgacttctgtgaaacttataggaaaacacaccaataaatgaggacacttgcgaactaattgaatacgagggtatgaagtgaaacaaagctctgatttgttacatttttaaaaatttcgttttcattaagcgtatgctagttgcgaaaataattgaaatattttgcattataaaaggtattaatttcagtattttaaaatctggctaccatagtattcaacagttcaaactggtagatgggtgcaaactatgaatatgcaatttagaaaagagatggattaactgaaagtagcccttaaaactgtaggggaaatagaaatgttttacctttgattaactgttattaagtataaaaatatctttctgactaggagaattttaagtaaatcctggaaaagaactagtttataattttcaaaaaatgtatatctacattgatcttataaaatttgatttcaaattaaaatgctgtatttatgttgaaacttcataagattaaaatcttaaaatatattactcaataatacaatatagccttgattataagaggcatatctaagaaaaaaactgcagcaattaaattatgaaatgacaatgcaaaattggctatcacttgtgcccagatttctgagaggttaaagtaaaaagaagttcatcttagtgatgtaagaaaaaattcagtaattcatgtaacagattttctaagattaagaataaataaataggtaaatactaatttaaaaatataattgagtttaaatacatatcacctttctgaatttactgacatattgatatgtttatttttatgttatatattttgttaaagtttataagcgttaaataggaaaccagtattaaattttgcatttggatttgctgtcatttatcatgtacaagtggccttgatgaaataatatgcaaaatgaatgaataaataaataatatatttgcaattcaatctgaaactgatgatagtaagatttgtcagtaaatgtagtggtacatctactaaaatcactttgtgactaaattaataattgtaaaacaaatattaacaaattatacactattacacaatgtttatatgcaagataaggatctcaaattatgaattgctagaaattttaataaacacacatgccaagcaaccataaatacctttttatatgaaatatggaaatatcaaaacttttagaaagccttaaggagactacagttttggtgaaccatgacaaaacaatacgtacacataaatgtatgaatgttatattaaatattgcagttttaccctaagaaggagaatggatagacatctcatttcttagtacaaaaaatataataagagtgtgctagagaaaagctattttaaatggagagtttaagaatcttgaaaatagtatctctctctcaaaagatcgtttcttgcttcacccagttgattaagagaaatttgtagaattaaagttcaaagtagtatcactttaatttttcatgcgttttggaggtttctccgatgtgtagaggtgcatcataggtgtcatttttaaatttagatatgcaaatccacaaaaacacacaccacttgcagaaataaatttcacacaatacaaactgaattctttttaagtaactaagtataatagtcttataaggtcacaaaactgacaataaatgttgaagacctaggttttaaaagaagaatcatggcatcattgttacatttcacaataagagaaagaataggatgcccctctacatctttgtacaaccatcaaccagaatcctgaatctttagatctttttgttgagacacctgtcatctcttaactagagtaaaagcatttgtcattctgggcttcccctaaacaaacaaaatgaaacgtcacacacacttgtttcattcatttccacgtaaaatcttgtggaacagctggcagctctcatggaagaatattttattgcaagatgtcatgtcagaagcacctcattttcatacccttgttttctctgacaatccttgccttattaatatcatttgaaagcagagaacatgtcttacagaggccttatcccctatttctgactgaatatttgatatatatgtgaggagagaataaattagtaaaaatgtctaaatatattaccttctttctgaataatataaaagttttgtatttaattaatacttaatgatggcaaaatttatttttcaggatataaacataagtaaagaattggatctgttcagatacatccaaataatgcaaaacacacttataacatacttttgttttatatttcatgtgctagaatagaggtatgaaaaagaggaagaaacatccgacacacagaaattacttattcatttatgttttctcaaataagagtatcatttccccatctgcttcttctatctcccaatattctttccaaaaacccaaaacctgtattttataatgatagtatttgtttattttgaaagagaaaggagaaaagtaaagaaaatttgtgggtggggttcccttttataccaataattattgaaagaaaaaataagagcagtctttatcctaacctactcatcatatccctgggtcacagctaccttcactacctgaatgtatctctgtttatcctttgttttcttccacaatgactggcctttaagtttgggacctatggaagtgtcatcatttttcattaattgtagatgttctttaatgcctaaaatatacataagcctgcttttatgtatgtgatatgatttaatggaaccaagaaactacgcttatcccccacatctttctctctgtgtacctcaatggtgttaaaagatgttcttaagaattaagtattgcccaaaaaaattattctctcataaccagacaaataactttttgattgatagagggccatactagattaattgtttaactattccactttaattagtttattattaagttttcttcccttacaaaaatacttggggaaattttagagatacatgttttggggagaagtgtgaagtttgccataagaccatttagtgatttttattgaggcatttatcataagttgatatctgatccatatgattgttaaataactggaagaatagggttcattattaacaggtctggtgtaaagaaggtgtgggtggctaggaagggctgccattctggaagaaagactattatggtgttgactgtgaaagggttgctgagcaactggtgagaagctgcataaatacgctcaagtaaagtagcctaataagaaacacaggccaaaaacgtcttactttcctgcaacagacattttgtagagcatttggtattctgtagcagcaaattaattagtagaaggagttattttctcgaaaataaataccaattttggcttagaaaaaaatagcatgttggaggggaaaaaaaacttcagaaatgataagaatatagtctatcatcaaagctatcattgccctaaaagcaaatatattatatatgaatattatatatggggtattacatataattatatatttggatatttatatttgtccatatttagagataaatgtatttcttatgtgattattatgctaatttcctttacacaaatacctttcatttagagaatataagtaaaaaagaacaaacaaaaactgtcttttaataccatcaataaacaaaggtaagaacaccaagatatacatcatttatatttgacttcaagtgtgcttactttagttttactaaggcaacagatgatgttaaaatttagccataaaatgtaactatctgatcaataaaatctcacaaatcatatattttaatgttataatatctcgccaactgtctttgactctttctactctagaagtagaaagttggatcctcagggtgatacaaattagaaggttaattagagcttccttcactcaaatcttccctggaggagagacagataagtctgttgcttaattagaaagaaattccatcaaatttagaacagaatatatttggaaagacagaaataaaatgggtgaaatatgaaggaagagattcaacaaactacttcggctttacatatttgtacctattgaaaaaacaaaccctatcttgtattcattccaaaaaatgcaaatgttatacatgaatctttctaataccctactttttctacaccaatgagaatggagatttttcctctttctctatgtttcaatcacattctaaaccatcctaactgtaaaaggtattacattccatcttctctttacctcatccttgctatttcacaaacacaaattaaatgactattatactttagatacatgatagattatgatagatagatagatagatagatagatagatagatagatagataatcttcacccatgtctttcaagtaaacagtctaatagctatttaaaaaataaccagagcaatgtgatatgtttaatagaggatacagtataactaggaaaacacagctgtggaaccccttagatttgcttacacaaaccaggaagactttctagttgaagagacattggcattgatcttaaaggatgagcagattttccctgatacatgagggataaaataacattttagtcagaggtagcagattagaaaaaggtgcggtaggggaaaaggcaagacatattcagaaaacttcaaattatttggcatggcaggaatgaaaaaacgaaatagtaggcaccgagacttgaagagccaaaacacttcaacttaacttgaaaaaatgaagcatcactaaaggacataaagcatgagactgataacaagattggcattttagagagaatgttcttgctataatgtggacaaggtattaaagagctacatggactacaggaggggtcaccaacccccaggccacggactggtaccagtccttcgcctgttaggaactgggccacacagccgaagatgagtggtgagcaagcgagcaaagcttcatctgtatttacagctactccccattgatcacattacctactgagctctgccacctatcagatcagtggtggcattagattcttataggagcatgaactgctcaagcaagagatctaggttgcaaactccttatgagaatctaatgcctgatgatctgtcagtgtctaccatcacccccagatgggaccacctcattgcaagaaaacaaggtcagggatcccactgcttctccattatggtgagttgtataattatttgattatatattacaatacaataataatagaaacaaagtacaaagtaaatgtaatgtgcttggatcatccagaaaccatccccacccccgatctgtggaaaaactgtcttccacaaaatcagtctctggtgccaaaaatgttggggactactggactacaagcaagacaaacatttaactgcttcaaccacatgactctgagtattttgcaatagagttgctagatttagcaaataagaatatggaacactcagttaaatttaaatgtcacgtaatcaacaattgttttgttattttgtttgcttttagtataactatatcctgtataaaaatgtttcttttctatctgaaattaaaattcaactgggcattctgtatattatctggaaactctaccttgatattaatttagacttacaaactctgaaaattttctacataccaagtaaaaactagtaacaaatattaatcctttcaatgtaggtattatttgattgatcctgtgaaaacttttggaatgacagagaatgggcatgatgacatcacaaggacatctaggcaaaactcatgaaagcatcattttattaaatgagaaacggaaagaaggcaagttgaatatagtgttctaagttattttattccaaatatatttaagtcttcaaccattttagtattaaaaccatcgaatgctctagtcctatattcattataaaaatacatgttctatacttgaggaaaaaattcatattgagaattaaatccatagatttacatataaaaaagtcagctttctgaataatgattcaatccatagaaaattgaatggaagatatttccagtaagaacttattgctctttgaattatatacagacaccgtaagtggcaacaaaaactgaatatttacccaacctcacaatatcgagtaatactttttgacctgttagtctttttttattcaggtaatagaaaatataaaatggaaagtaaaaaattcaatgttctcaatagatagataattaggtagataaagatataaatatagatagtttctatgagtttccctcatcttcctctagcatatatgagactatatatctgtgtgtatatatgtatatatctataactatgtggagagatatcaggtacataaagaaatctctgaactctgaaaaggcatttaaagtaagagtgttctattttatcaagatcatatgcatattatttggtttgaatttttgatgacaatattaatgcaaaaaaatttaatcattagtgtagttttaaatatctaatagttttatatccacccagataattttgctgtattctaattacagatatgaagatgaatattcaatcattttcctgaagtatacttttaacctttataaaggtaatgaaaacttgcttcagtcatctgtgagaagatacctttgtatttctccacatttctgaagagatgattaagacactataaacgtatttgacattccaatatgtttactttaaataaatagataccaaaaatatttttaaaacatggcataaaaagcaatagacatttattgagcacttagtatttgccagacatagtgctaatttattcatttaatccttaaaggtaacctatgagctaataatgataaagcgcagagctgcttcaaaacatacactgagtcacatagctataactggcacagctaaaagatggaccaaaattgcacagtctcaaaatgatcttaacttctgtgaaatcagtgcctttatgcagcctccccaatacagtatagcatgtaaacacttgtatgtgagtcaatatgttatttacttatgttttattttcactatatttcttttccatcacctcctttctcaacagaggcctgattgcctccaggtcctcctgtaattccctcggcaggattttcatgcagagctcaaagggaaattttctctatattccctccctagtttttgtttcctgagagtctaggtcctttcatgaaagtacaccaaatgaaaagaggagggcaatgatggggaggtgttagagtttggggagaagcaatgaagatgatgtacacatcatctctaaggaaaatagaagggtctaggaatctgtattctcacatttggctaggatttcctcactcaggcttatcatggaaagaagagggtcatctgccttcatagaaaatatgggtttggacaatgatgactaaatggctttctccccatagtctagtcgctacaaaggcctattggattcttgcgcaaatcaagggaagagaaggtgccaaatgtttcttctaccctcaccccacaatgacctacataatgtttttcctgtcaaatatgataggggctttcaaatgtatttgaatttaagagaacaaagtaacacttcttgcctatccacatctgtggattaaatttcacacctgtttaatgtgtaaatgcattaaaaatgtacaacatatctcaatagcttatttttgcttgtttaaataatttagtttaagggtgaagtttgatacctctatgttctattttgtcttttaacaatttgagttcttctattataaaacagttcttagtaatctaatttcactcatctttgcaaagtatctgctgctcaatagttacaagactcacattatcatacttgtggcttcttactatgttgctaatgtgtatcatttttgccacctttgggcatgaacaaagattctgcaagtttctggttcctaacttttaccaacaaagtcttctccaatcttcagaaaatttcttgcaagtcgtcttttttcccagtcacacatcaatttaatttttcatggagagtggatgttttatgatgaggacatttacaccagagactcaggcatccattagtactcagccaactattccccactgtccctaataatcatagcctaacacttattgatcattatttaatgcatattccatgataagcaattcatatataataatcataacaaccgtaggcagcaggtaccatgaaaatttatacagctgcgggtaaataagttgatttaagtaattcattcacgtattcactcaacaagtatttattgtcttaggtcatttattcattcttccagaattttaggcaacaagaatttgtcgagtgcttagtttatgccagaggctggatgatccagaggtgaacagtacagacactgtgtttcctaagaaatattacattcaaatgggagacaaaaagaatgaacagataaataaaacagcaggtagtgaaacacaaagtgatttttgagctaaaaccataataaaatgaaagagttatttaagaaaaagacctgatatatggcacttttactcagactgtcagattacacagatttttttcttaatcttggtgacacaatacttcctatccagttatcacttgggcatttcactttatttctctatactatgttccacagtctcttgtgtcctatgtttctatgaaacaatacttatttttagccaagataatattttgcatcaatattttatttcattcaatgaatactacatactgagtttctaccttttgctagctattgttacatgatagaatgcaatggtgagcatgggagataacgtgaacaaagggataaacaattaacaaaaataacagaatatgtttgtactatgttgctgtgttatattaaatatggtcacatattctttgtgactcttgactaagaggtagagtaggtgtgaccctactaagagatggagtctatttcccacccacttgggtaaggatgtcctaatgacttgctgtgaccaacagagtgcagcaaaagggatgatgtgtgacttctggagcttcactttcaatattctttgtagcttccaccttggatctcttgggatgctttcctcaaactgccactgatatggtttcactgtgtccccacccaaatctcatcttgaattggaataatcctcatatgtcaagggcaatgccagatggagataattgaatcatgggggcagttttccccctactgttcttgttcttgtggtagtgaataagtctcatgagatcggatagttttataaatgggagatcccctacacaagctcttgcctcctgccatgtaagatgtgactttgttcctcattcaccttccgccatgattgtgaggcctccccagccacgtggaaatgtgagtcaattaaaatttttcctttatacgttactcagtcccgaatacgtctttattagcagcatgagaacagactaatacagccacgtaaggaagtatgtctggctaccagaagataaatggcacaaggagcaaaactgaagtgtcccaatttacaaaactgtgttacgccatattggaccttctatgatagtcaactatctagctgactgtaactacacatgcgagcaaaaaagcatcttgccaacaaagagaattgtgagaaataatgaagcgttctgttttaagcctctaatacatgacttgtctttcacaagccatgtttaactgaaacaatgggttaaatgcttgagttttacggaagtatttaatagaagcactaatctggtcttgggggtcaaattaataaacagaggctttgtgaaaaatgttatgtttaaactaaaaccagaacaatgaataggaaatgccaaggtgaaaagaaaataagtaaatagtccaaacagaggcctgtattgtaaacaccctgagacaagacagattttgttagtttctaggaattaaagaccacttagtatgggtaaaggataaattgcaagcaggaatatcacagaaacttagcttggaaatataagtagagagcatattatgagaatatagtacagcagattatgacacaagccatgagaacccatatggactttataataatgccagcagacacagtcctccaactccactcactgtagttaccactacatttctctcttcccttctgaaaaccaaatgtgtttcttaaaagaaaagataaattttctttctgtggatagaaaacatttttttaaaatcctgaaattaaaaagtaaaatttttgttgttcctaaatgtgattacctcgggtcatctctaaagaaaaatggaaaaacagaagaaattttaacccataataattatctgtctgtattcattcactccatttgtcatttttctattttccaatttcatacttatgaggacctacttaatcatttttcatttattttcaaaatgatatgtagaattgtttgctgaattaaatatatatatattgctgctgaatatatatatatagttgctgaattaaatatatatatatattcctgtaaaacatatttcataggaagatcaatgtaggtatttcataagaggataaaactcatgttgtagaatttcagtcactagctaggagattgggaaggatttggtgggacatcaggagttctcagatcccccatttatgctgtgtagtcaactacagtacatgtgcaaaaatggtcagccagtatgcattttattttggattatattgcaaaatatgctctctaaaaatgaatttttctttcagaaagatggtttatgctattaaatatcaccgaatctgtgcagttcttgctttcctgatagaaagaataaacagtttatgtacaggtgagtaaattctagaatttaattaaaatgaaattcaatatggtgtgccttggaatcaaaattacaataaaaagtaatataccagtcagtcagtcagtcaataaaataaactgaagtgtgttgtgtagaaaacaaaagatgagacacaaaaatattattatgtgatactaaatttctaagcataaatattttataatgcatttccttgagtcaacccagtgaagtgatgtttagtaattaaaagttatatgtaatgatgtgactacataggtactttcgtttttttgcaaagtatgattacttacaatcatttttcacaccacctcttagatgagctgtatatcacatgagaaagaacaatcagtgttaatttaattatagtgttaagtaaaggaagttgatattttagtgagcaggtgaggtcctgtaatgagtaaattttgattaagcatttttgcaataatcaaaatagtagatcctcattattcttccagaaaatatcagaaaagaatcactgggctagaaaatgtttaaggtctataaaattatgagaataaagaatttaattgaattatataatacatgtattttaatatgtcttcgttccttccttcttttttctttctttctttcttttttgcttgctctcttgctttctttctccctctccttcgtccctccctctatctttttttctttccttctacaattatattaagtgttggatgtattctaggaattcctctgggtgccaaaatgataacacgaaggaaagagataggaaagaaaaatgtcaaaacatacacggtgatttcaaaaatgttagtacatgaagacataaatagaaggccctgattgtgaatatccgggttgttgagggtagcctagttcgccttggtctatcatctcaaagaaggggatatctttgcttactcctgaaaaatgaggaaaaacaagtccctcatgggaagatttgagggcataactttccacgcagaatgaagagcagatgtaaaggatctaaggaagaaaacagcatggtatgtctaagtaggcagtgactgaataataagtattagggaattacaggtttgtaggctattgtaagaagtttgggttttatttacttaaatttattctaagtcagcaatggagaagggaagatctgatttaaatttaaaacaaatcacttcactgtcaatgggtagtgtttgtgtgcctgtgtgtgtgtgcttgtgtatgtgcctctgtgtgtgtgtgtgtgtttttgtgtagggagttgatgaaggtggtagtttgctgctataagaaaaaatatgtgacacagtggcatgtggggataaatgaggtagatttcctggccctttcccctaacaagatcatcccaaagatgaaaaagtttgaaaatcactattacagagcttctgcactggaatgcacatttgaaaaggctgaaaaagtaaatacatcagaccagaggttccacattaagagtcaagagcaggatccatgcagaatgagaaactgcctgggatgatacggaaagtataatgagtactgcgatttaaaaaaatatccaaatggctaattgaaaccaatgttccaaataaataacagaccaagtgctgggaatgctaaaagctgaggagcagagtccctgaaagaaacagatgctgtgagcagcagggaaaggccagtgtaattggcacaaatatgactgtgaataatgcttttctatgaccctttaagctggaaaagtatatcctagatatttagaaaattttcatctccaaagttttaaggaacaagaaggataccaaagctaaaatgggacataaaatgatagtatgatattcccacagaatggcatgcgttggattctttattgaattaagaaaacaggctaatatatttaatgagagacacgcatttcttgacaattcctttaataaatatttattgagtgcctattatgtgctatgcactattatgctgaagatataaagataaaaatcatataaggtcttcttttcaaggaaccatatttttagaggggtacagaaacaataaacccataaattaacaaagaaagaaaatatacaaaagtaaattgaggacaattttaaaaggagcataatagagagtgactggtacctggtcaatgaagacctctttgatacaagtatattttttaaggccctaaaacacaaaaaggggccaaccatatgaaggccaggggacctttttccagaaagaaggtcaatatttctgagacataggcagagagaggagaggtagagatgagtttggtgatacatgtaggagttattcacatagattcaaacagtcagctgtatcaattaacttttattatgaatgtgctagaaatctatagtgaagtttcaagcttgacagcttgtactacaaaacatcacttatcttacatgtaaagaatgggttgtagagaggcaatagtcagagattacaccaaggaagaagctcatgaagttattaaggatagagataatatttcttggtgataatggaaaatgggttgactcaatagaccaatcaatgctcataatttttaattatattttacttgatttcttctaaatatcagttaaagatgtgcaattgtgcttgttacacttatcaagaaaatttgtaaagcaaacagcctaagtgaagtaatgttctgtattttcatcagacctgtccaactcaatgaacatgtacacactactagcagaaagtgggctgttgtgaagaatagctacatacaaaagacaactaaaaactggaaaggaccacaccaatgtgcttcattattattactccaatgcaaagaataaacacaataagaaagaagatataaaatgcccttttgtcaatattttttcatgaaaaattatcatacaggaaattagatatgtaagttcccaatatgtctattatagcaaggtactgtgaaaggtgctttccaaaatactatgggatataattatcacaataatattacagattagatataattacttctatgttacactgataaaattgagattccaagggctacaaatttcatggatttgtctccaagtctaatgctttttgttctatactacagagacatcacacatcttcatattcaggccttttcacgttatagtacagaccagtgtagctcagtgttcatatgtgccatgtttacttataagttagaatacatataaaagtaactcagttcatttattctcacatgatggagaatgttgactcagccaattaaaaatgatagaatgatgtatcaccagtgttacaaaagtcttttattcttatatttgaaaagacaaaatggtaagagtttggaattacatgaaatgtaatcagtatataatattttatcaaaaaataataaatatttttcttatactttacagagtgtactcattctataaaacatattttctagatttagaattcccaaggcactattctcagtcggaagagaaacataatagttaataaggcatagattttactttaagagagctataggatgtatacaaaatagctacaattaagagaagaatgggaaaatagaaagatcatgtctgaattgctacataagaaaaaaatatgaagattgcatttgagtgacataggcaactgtgagaaggggcaattcagattggaaaacaaagttagtgcaatgattaaaagatatttaaaaaacagaaaatgacggcacatttagttttggtataataatgtgaggggaattagtaaaggagaatatatggagttgcttcaaagatattaaacagctcgaagcagatgtttgttgctttctggacacctagcaaccatagttctagtatcagaaatttatttgaagagttttaacgtttcgcaccagttagctcttatctcttatttctaattctaagtcttacttggaggtatgatgaatatttaatttaaaatttacattaggaaatcttaagtaacagaaaagtttaactatttaagtcctaaataattatggttccttaaataaatattttaaatattttagatatttatttaaggacgatggaagcaaaactagtcaaaagaaaaagggagtccttgtctctaattttcacatctctaatagttccaagactaaaattctattaagatgatttaacctgcaaaatgcaatataattgttcgttgaattttctcatatctggctgaatggggacattttcagttgtctttaccattcttagctagagtgacctattgaaaaatcatattctgtctctctgaaggattgtgcggtttaagttgcccttctatcttaggaggtttagaatcttaatttcatgaactctgtgatgagaaagaagatttttgaaaaatttacctatttattttttatatatttactgtgtataatatgatgttttgaaatatgtatgtatggtggaatggctaagttaagctaattaatatatgaattatgtcatatacttgtcattttatgtggtgagaacacttaaaaatctactttcttagcaatttttaggaatgtaatacatagattatctctagtcattatgttgtataatacatctcttgaacttatacctcccataaaactgaagttctgtacattttgaccaacatcttcccaacctccgaccctagcccctggtaaccaccattttactctcgacttctatgagttcaactattttagattccaaatataaataagataatgaagtatttgcctttttgcacctagattatttcatataaataaatttagcatctaatttaatgaagtctgttaagaaagggaattttgaatgtgactgcacagtgctttagtatttctgggagaaatgtacataagcacaggcagggaaataacaggcattatctcaaacttactgggaaacatatacatgtaaaattccaatttaaagtgcactcactgagaatagttaattaattaagtagtttctttgatatggctatcacttagatattttgaagagagttttgagacacctgtttcaagcatatctgcaaatatatccataattttagagtagacaaccatgaaggattgtgtatgtgtgtgcatcctatatcttagcaggtttttaaaaatgacagattgacttttggctagagatgaactttaattcaaagggttaaatttattattctagattataaaaatcaatatattagtatttctgaattctgaaaaataccaatcaagagaaaaatagtataataaataatagtgttagtttcttatggaagtcttacagcattttgtgttctcacccaggataacagaactgtaaaagagataaaatgctgtcttctcatagcctgattatgaatccctacttcggtgattattacttagagacttttcagggtactgattagtgtctatgaatgctgtacttattaatttgtaaaatggagaaaagtaaccacatcataagttgtaatgatgaaatgaaatgtacaggagaaaatatttggcaaagggcctgacatatactcaatgtttagtgataatggtgaaaacaaaaagttgatagagcttattcaaatatagagatggaaaataatgaaattattttctttttctaaaagtcacattccagcttttcagtaaacttttcacacagttaaaatattttattaactaaaaactcaatttctaaattatgtattcttgagcatctgtcttaccacattttaaagtaattactcatctcactcaatccaatttataatgtacattaattatttatgattccttaatggatacctgttttctcaatgcaactatctttatgaaatttagttgtataaaaatttatatatgaataacagctaatgatcaggaggcaggtcatttttgactagggaatttacagccatcagaataatgatacaactgtaaagaataaataaaggtgagaatttgatggtcaaggagatattatatctgacttttttcttagtttgtatcagttgacattttcacaggctaaaccctcttcaaaactaattaattgaagatttttaaaagtttgatagattgctttttatgctaaatctctcctattaatttggttctcacaataaggtaaactaccaataaaggagttagagtatatttttcaaatccatcttttattaatattgtaatagtccccccaaaattttaattaaaatatacgtatgtatgtacatgtatatgtgtgtatatatatatatatatacatatatatatagtgaattgtattatagcacagaatttgaaataagaagacttgcattcaaattttgcctctatatgtctcatttcattcaggatttccttcccaattttctcatctactgccttactttgagccctactcatgttggtaagcatcagattctttccctttatctttccttctattctacagaatgatttatacattacataattttattttttatgttggtgaaacatggaactctttccacattgaaatatagccttgaagatagctattattccttgagaataatttaaataaataatgattgttttaatgaatattattcagtgaacatttattttccttttccttctcattaccctggaagaattatccttttatcaaaaacaaacaagtaaaaaaccaaacataatctacctacttgcgctataaatcacatcccaggacacctctgggtctttgtttctatcttatcttctttgctcgcctgaaccattattttctcttattctatatggtcatttccatcactacagaaatatgttctctttcttcaaggttaaaagacaaaaaataaagtaaaatcatctcctgactctacatttcccttctgacttccttcacattcttctcttccctcttcactaaatttattgaaaaacactctctccacaaaccatttttactccctcactttacattcacacctcaagcaagtttgtccagggttttcctaaatttcatcactgcaataacccccatgttaccaaatcccatttaatatggtttggatttgtgtctccacccaaatctcatgtaaattttcaatccccagtattggaggtggggcctggtgggacgtgatggaatcatggaggcagatttcaccctttggtgctgttttggtgatagggttctcatgagatctggttgtttaaaagtgtatagcacctccccactctctttttctcctgctctggccatgtaagacactcctgcttccctttcaatgactgtaagtttcctgaggcctccccagccacactttctgtacagcctgcagaaccatgagccaattaaaacttttttctttataaattacccaatctcaggtatttctttacagcagtgtgagaacaaactagtacaccattctatctcttcaatttactgatttgacaaaatatttgagaattctccatatgcctggactcctctactcactcagcatatagcagtgtacaaaagagtcagatatccctgtctttatgaggcttttactgaaaggatgaatagcactatgaaaaaaaaataatgcaagggatggaattttttaacatcagaaaacagatgcaattttaaatagagtagttcggaagaccttactaagatttaagatttaatcaaatttatgaagagtatcagaaattgagccacacaatttaggaaattttctagacagaaggaacagcaaatgcaaaaaccctatgacagaaggaggtgtgacattttgaggaccagcaaggatgccactgtgtgacaagagaagtggggaggcaaggaatgaagtcagagacgtaagttagtaaaccatgtaagtaaatgcaacaagctttttactcagtgagatggaaccactgaagggttctgaactgaggaatgctactatgtgacttggattttttaaatatcacttggttgtttaattgctaatataatatgacaggccaagaatgagagcagatagaccttttaggaaaggtcaaaatgatccaagcaggagaaggtgatggcaggaaactgagtgtttaaaatgcaggtggagtgaagtagtctattgcgaatgttttgaaagcagagcaaggcaggacttgctgatatgagaaaaaatgaggagtcaaggatgattttaaacatttgtcctgaataaatgagaaaaaaaaaggtcatttgctgatatgagaaagactggaatgagcagaccatgagaaaatatccggagtgaagtgaggaagatgttaaatttgaaattcatattggaaatctaaatgaaggtgttttacaggtacttgcataaggtgaaactgaagtttctgaagacatgagctggagatatgatgttgggagtcatgggcatagaggatttaaagctatggaactgcaggggatgacccagaactttaggcagaagcctgaatagagatcagaaatctgaggagaaaatgacaaaggagactgaggaagaatcacggttaaagaaaaatgaaagagtattattccagaagccaaattcagaaagtgtttcaagaaactgacaaattctgatcataggttaaataatacatgaactgagaaattgtgacttccacaaatcataggggtgaaaatggttcagaaaagaatgagaagaggatttggatatgattaattgtaaaagaagataaattcttctatgaaattaatgtaaaggagaacagaaaggctttcagagcatgtcatatattgaccacttccatccttgaaacatgtttactggactttgacaaaatcactctcttctagagagaggtaaagtgttatcaccacaaaatgataaccatgtgatgtaatgcacatgtatatgttaattagcccgatttagtcattccacaatgcatttatacttgaagacataatgttgtacacagtaaatacatacaattgtatctgtcaatgaagaaaataaaactaaatttgaaaaaattactcttctagttttcaatctaccttatggacacttggttcttgagttctcagtgcttaatctttggttgtattttcctgattttacattaagtctttgggggaaatcattaaactccatccatttaaatgctatctttctgggctaaatgtcaactatgactccagcttagaacttctcataaacttcagacatagataatcagagataattttccttcttaacacacctactcaatcatcacttgcaaccacaaatatactcttgaacttaaacatcacagtccacagagaaggcattcttttttcccccatctaaattattttctcattagagatttttacccaaaggattcaaatcagaaatttcagaattgctcataatttcttcttttttggtcatagcaacattcaatcctgtcaatttcaacataaatttatagtaaatctgccttctcttcatttctgccttccatcttaatctaggcaatcgtcttttctcaccaggatagtgcaacacaacgctgtttcctacattcatttttgtcacactatagtatattttccagaaatgaaaaacaaaaaacaatttctcaaagcttaaacatattttccctctctcctgcttaaaattcttctgtgtcttccttatcacggcctgaggacaaggttctacaaccttatttcagataactctcacttaatcctgctatgttttagccacatgggcatttttaggttcttcaaacttgttaagctttttcctctgcagggcctttgtttattccgattagcctcttctcttcaatgttgctgtcctggcactgcctcaactctaatcttctcatgccaaacttattctcagcttttacaccacttcattatgataatatgttccctggctatctgcctaatctagatcctacatcccctgtattattctctattccagccccttccattttttcctttatagcaggttttcaaatgtaagattcctttctttggtctgtttaatgtgtactcacatacacacactatatgtatatacaggaagtcctcacttaacatcattaatagattcagggaaactaatggataacaacatcatttttttcctcatcaatgttttaataaaatgatgttattcgaggacctgctgtaagtcattttacttaaagccacggtatctaagaacctattggaagaacttgcccttctcttttaccatcctgtcccttagcaaagtacatagtacattgttagtaaacttttgttgaataaatatatggatggatgaatgactactctgggcaggtcacagtgggactgagggagtgatttctgagagaacttcattaagagtggtctcttaaggaacttcattaataagagagagacctacaaataactataagacaatatatcttagctggcttgtagaagttgtaacagctgtttgaatagaatttgataacatgaaagctgacttttggtttttagcacttttattgtgtgagacaatgtgcaaatttcctcgtctagaatttcatttaacacaatagccctttgcaagtttatgagactcccggagcagctaaaatgtaaaaacaagctttgaatttaggtgtcctttttccaaagtatgcactcataataagaaatcttataaaagattccagcactcagaaattttatttaaattattttatgttttatcctaatgcatttattatttttgatcacttgtgctaaactatggttttcaaaaaaatgtctttagtaaaaacaaaaataaataaatgctcattctcagaaaggagaaaatgtggaatcagaactgagtcttcctttaatgatgcaattagcttcaattaaaaataaactttgaaataatcacttggacttaaatgtctctatttgctcaagtatcatgctgaacatgccttcactgtcttgatgagaaaactggaggtaagaattttgagtcatataaagactcaacttgctagtttatcagttttgtctcaagggctgaagtaagacttaatgtgactaggttataactttatcacatgttatacaacctctttcttgtgttttttgacatttgttataaagagatacaaactttcctgtcaacatgttttactaaggatcatgtttttatcacctgatatctaacacaattgacctttgtgtttttatagatttcaagttttcaaaacagttaaataaatatatgagtttataaattacaatgtgagagatagtggacatttagagcataagtttatttttagtcatgatataattaactagtgttggccaggcacggtggttcacgtctgtaatcccagcactttgggagactgaggcaggtggatcacctgaggtcaggagttcaagacaggcctgatcaatatggtgaaaccccaacatttctactaaaaacaatacaaaattagctgggtgtggtggcacatgcctataattccagctacttgggaggctgaggcagaagaatcacttgaacccaggcagcggaggttgcagtgagccaagatcgcaccattgcacttcagcctgggcaaccagagcaaaattctgtctcaaaaaataaataaataaatagataaataaataaataaatagtgtttcagttactaatttttcttatttgttgtttgcttatttttccttcaatttttgttcttcaaaatattgatcatttatttctcaccctataaaaatctgagtaacctatgatattttagcaaatactttccatgttaggattttctctgtaatatttttgataagtgtgtttttgcttgtctcctaacttaaaataaggataatgtctattttatctgggaatgcaaataagctattagaataatagtaataatatcttagtaccaatattttatggtttaatagaaaccaaaataggccctgagtagatggaatacagaagggaggttttgagggaggcagaggaacaaattcaggaatctgatttttttagcgagatgcttttagaaaaggaaatgaagaaaaagcataactttggattaagtttaaaactaggatttgattccagggaataagattgcagaaacatgattctacgatgctatagaaaccagcattgctactatcttcaacttaaatcgcacaagagattatctgtttcatcaatatacaaatcaaatatatgtcatacaggtatagctttgtcaatgtatctctattacttctgtgaatacattggccttaccggattaaaaaaaacatttatttttctaacatatattgaaacaattccccccaaaaaagtaaacagtaaaaactactgtcagaaataaattgtaatgataaaatttatttagaaaggaatgctactttttggggaggctttcatgataaccatcttgattcaagagttcctcagccatagacctttttcgtaaagttttctatgaagttaaaaatgtagaactatgagtagttttaaaacaagttattctttagcaacaaaatattaaggactacaatcctcttgtaggaaaaaaaacaaatttgtcccatttagattcagattgattttggcccacagccctacttattatttaattaaatgggaatacactatgcagagctattaagttgtttagccaaagaatacaaaaaaatgtagcatgaaaatacattataaattatacaggaagaattctcacaggaagatacaagtattgcaaggtcatctacacacacaaaggtatattaaagcattcaacatccaaagaaaatatgtgagagaaaagaagagttattgaacaatgtagagcaggcttaaaatgttgtatcctttatttgcaaaataagattgtcataacaaaagattccctgaccttctttgactttaatcagtggttgtaggaagatgattccatttcagagcattgagcgcaagatttagggagtgtcttttttccaaggtaattttatagctgtggaatcaatagtctaacacaatgaaaaaagttaaaaattgaagtctgtgaaagaactacttttagcacttcttatgcagaattttatggaaagtagataaatgaatcaggtaacttttaaacttgctaattaaagtataaataaattatttatttatggttgaaatgtttagtaaattttattaagaatttatgtaatttaatgataaaattataatgcacttctaaaaataatggtatcacctaatttgtgcgctgcttgtatttctatggataaataattttatttaaattgtactatcattgtgtatgcattaaatgttatacatcattatatatataccaaatctcaagagacatatatgtatataaatgcatattccaaatgatatatatgtgtctgtatatatacacacatatatatagtgtgtgtgtcaagtgatatgtagagagagacagagaaacagggagagagagaggatgactaaaataaacccaaaccaaaaactactactgagtcatttggtaaacctagaaggaaggacaaatcattcgttttctcagtcatggttttaactaccacattacacaatcaaccaataacaatggctatataaccacggtttagatgacctaggatttttataaaaataaatacagaaatgaaaaatgtcatcttaggacagaaatattttacatgttgacatattcacaatatgtaaactatgtaatttaaattaaggccatatagaatcaaaagtatttgattctcatttagaattagagctgcaaaatagctctcctaaacattagttctcataattatatgtacgacttaaaaaaaatgtaacatcaaaatatactctcaaatgttttgtcatctgtaagtaatttttgagagtcactgacataccatttaaaagagaaaggaaatcactcaagatttaaaaaataactgaaaaggaatataatgacaatgtaatccatcctcctcattttcattatgagtaaattaagattcaaagatattcagcaatttttatataatgtaaataggattccaattcatacatttagattatcagcttaatgtcagtgcctctcttaatttctcttatttttaaaaaataataaacaaatttgaagtgtgtaggctttttatctctggttcatcctagcctgcagtaattctcaaccattcattaattttgtattatctattccttgttggttttgtatatatgatttgcctgataacaagatttatcacaaaaaatttttccaaactgcagcttactacatgagtcacacaaggacagctagccacttaaacaacagttgcctgtttcaaaactgtctcacaaggcaagctaaaaactgcaagggcctaaccataacttcaagactacaagttttatctagcaaccactgacacttgccaatgaactttcctgcaaaacaacttgcataacctcctctcttcccaataaatccctaataaattcctttctttgttctccagagatgacagaggctatttcagtttgtgcatacgtcctggattaaaatcctattactttgtttcttcccaaacaagtcctttactcttgaagatttgtctctatatgtatttatttcaagttgacagacttttggactcttcaggcacagcaagagtttaaaagaagaacagagttaaaagaagactggtggaaatatttcgtttcagagagcccttgtagattggtgaggacccttctaacagcctttctgaaaaagtagtggaagagtgataccttttagcaccagcctagtagggtgggctttaatgggattgccctgctataggatgtattttttgcagttggcacacaaaaaggactggtgtccatgtctgaaaaaattctaagcaaactcatacagaaataagccaccagtcaaggaaatctagagagtgagagaaaagagagcatctgtgttgggataagcctggtctttttgtgcttctcggggcaataatgtgtaacctgttttatcaaggaggatcatgggataccgataaaatgaggtcatttggggtctatccaaccaggccctctgagaggtagaactaccttagcagaaggagactgggatatggaggggcaagggactaattcgggcaagtgtccatttagatgcatccatctggaataaggaatcccagaagagaaaggcccagcttcaatcacttaaaaggccctggacatcccatgacaaaattagcttaaatgtcaggaccagagaacatgtagccatcttaggtcttaggcctgggtcagtccttttatatcttctccaccctacctcagctagatccaagaaagacctgaaacagtggcaagtaagaaatttggaaaaagaagtaaaatacaaagaggagagacaagaacagttaatcttgtccctcttctttccttatataggcttcctctggacgacaaggcccaggaagggagaccgtaaagaaaaatttgaccttgaatcatatttagtgttttgattactctctagggcttggaattttaattataaagttgaaactgtatttctagttgttacaggctgaattgctctccttaaaatttatgttgaatatctgactctcagtgcttcagaatgtgaccatacttagacaaatgactgtaaagaggtaataaagtttaacatgaggtctctagagggaagcctaatccaatataattagtgtgtttctaagaagaggaaatttggacatagagagcaagacactagaaatatatgtgtgcagaagaaagaccatgtgaagacacagcaataagacagccatcttcaagccaaagagaaaggtctcaaaagaaacaaaacctactgacaccttggtctcagacttctatcctcaagaactgtaagatatatatttctgttgtgtaagccacccaagtttgtggcactttagtaatttgcattaatttagtgtggtcatagaacctaaccgagttttaatcctagggaaggtttctgttgagggtgtttttcttccatcaagctgaaatgatttatttgaatttgtcagtatacctaactggaaaaactagaagatacctaaggttataactaaaatctcatatgcatttgtgatatttttctttttgcatacagttgctgcattttctaactcaaagaattaatatccttatggggaaaacgtaatataatggaatgtataaaattagacttatgctagatagtattagaggacactattaacccccttatgtaaaattatatataaagaaatgagaaatattcattccatttcttaaatatctcaatatcttctcagaacctttttggcggggaaaagacctgtgctacttgtctaacagtaagtatgcatttagaagtactaaaaagaaaaaaaaaagagaaattagctttcaaaggagtattttttaaattattaacagtcagaattttgttgaagtcccttattttatatactccttttaagttgcacagtggtggagggaaatcacaattttatgtgaattatggcttctaaagttctgaaataaggcagtccaggaaatacaataatcatagaaaataaatcataaagagtgaacaataacaaaagctgaggagcaatggagaaaaatgacactgtatcatgttctctcagtgtatttatgtgatttttgaactaatttcttattttcttataattggctagcactagcttagctgccataagacggctgctcaccttatctgttaaggatgaataatcaatatggtagcctccagccacttgtaggttttaatcatttgaaattagctagtataactgagaaactgaatttttaattttatttaattataattaatcttaattttaatttagaaacaggtagtgaaaaatacttttcattacacacaactttattgttttataggctacattttaactgttgcatcatataagatgtagctgtattgtagtgaagatttgggaacatgcatctttctagtactatatattgatactaaaatctttctagtactatatattgatataacattccatgtatttgtttgaatattttatgagaaagcaataattacagtgatactgaagtaaatcataattgctaacaacctatttattatattaattataagttttcttctagtctataaataaactattcccatagaaaaaaatcaatgttcaatatgagatgtgctataagtataatgccctataatttcaagacttaatatgaaaaataaaatgtaaaatatattagtaatattttatatagattatatgttgaaatgttaatatttttgccatattgcttacatataattaaaattatttttgcctatttcttaaacttttacatggctacaagaaaaattaaatatttatatatgtgtgttatatcctttttggctggtgctctgcaaaggagtctagaaccatgtggaggttaatcagaaggtgagggataccaaagctctccacgggaatgataaatggggatacttcatattactgtgaagccttgctaccatgcaaacaacttttatgttactgacattgggagtagtagattcagtacaagaattttggacctagaaagaactcacagtcctgagatattaagtaatctattcaggttcacagactgaagtcggtattcatatttactaacttctaatccagtgctctttccagaacaatacttgtatgaagaaaaattaattcctgggaatctctatttcactctgttttccaatcttagcttctatggccatttcctgctactaaaacatctgctttgaaaaaaagcccttgtcacgttgaaaaactagaaaaattgtgttcacttggaaatctgacagagtatatgaccacaaaatctggagtctcatgttagttatgaaaaatctaaacagtaattgctatattttctgtagggagggaggatattatccaatgaaataaggttatgttcttgttagtttgataatatgatgttttgatttgaactttttcaacaaacatgcactgagtattatgaaattattacctttcccaataagggtcttataattctttcacctcaagctgttttataactacagattccttcttgagtttttcaataacagccggtagtacctgaactaataaaaggttaaataaacctgtaatagcagatggtattattatttgtttcactagtatacatacagtagcaatgaatagactctgctgatatctcatatgattaatttgtaatatatttgtctgttaaatgtttgacataatttaatggggataatttttattataatatctattatatagatacttgtaattaagtggttgttttaaattaacaaaatgataaataagcacttatattaagactcagaaaaggtgtcttggagtacaaggtggaccgcccaccttgtgcacagcagaagtagatccctacaaaattttcagttacaaggaagtgaagcctctagtgaaactatctaatattcactagttgggtgcatcccatcacttttaagactcatgggctatcaagaaactttttatctagaagctttcttgaaaagggaaggaggaagtgatataagccctgaaagtttgaacatttatcctaagaaagctgacttttattctagaagagattggcaaattttaagtttattctcttatcagcaggaatgtgggaacaaacaaaatagttatgcaaaatgatctatcattttatcagtttaataattaccaagtactacatttgaacctagtttaaattttagaaaatattgtccatattataactagttattgacagattatctcctatttattgtagttggtacatttaaagatagtaattgaaataaaaatcattaagttgtatgtggatttttacaaattccatgagatcataacatgaggctattataatttgtctttgactttataagtactccaataaagaataaataaatatacaaacaaacccatatttacatgtattgaacactgtcttaaaattgcaaaggtaagcattaaagttttggggtttttaagtaagactatccatgatattttctttttaattataaaccagagtcactacagtatcaatgctatgaagattaatccaactccctagaaaaaaattgtataagggattctctaatcttcaaaatcctaaatcctgtgacgatttattaagtacactctttttttctttatactttcctgctgtactttgacccaaagcttattattttctgattttaagtaattatttttatcagaatctgaatttaatgtttctacaactactcttttctcatgaatgatgtcctctaataattctggcagtctcaacattaatacatattgttaactcctaatcagaaaaaaggattataaaacagctaaaaaagataaaggaaataatcaacatgactcctaaaattatactttatttctaaaaccttattttatatattaaaactgtaccccaattctaaacacagttatatggattaacttttaattcatgaattttaaaatgttaagaaagataaaatgttttactagaaattgttatattggactagagttaagcaaaaaagtgtcactagcattgtgtttccaatgtagaatagtttgttcagcttaccagggtatgtttcacagcaaaaattttatttcagggaaatttgaagtaaaacaatatttagccacttttctatcaaatacacatacaactaatgaacagaaatttgagacaggaggtatataaaaagattgccaaatctaaggattagaattattttgttaaaagtgtagtcaaactttcattttcaatattgcaataactaaaactccttctttacatttataaactttcccagtattattgacttagattttaaattaaattaatgaattttataaaataggaaaaatataatttaaaatcgttcttgattaatttaataaaaggccttaaatcttatactggcatgactgtaaaatattcatttgtatcacagaataaatgctatcagaaaatttttaataattgctttagacagaccaatgattatttagatagatcattttgattattaatgtttgattatttttgctgtttctgtagacattgtactaaaaagaagatgagtctcatagactgtcaggtccataaagcaagaagtaaaataattttctatgtttttgcttcacaacaaaaattgttttaaaaaagaatttccaagtgaaagtatttatttagcattgaaggaaacttgaagaaagatgataataatgtcaaaatcaaatacaaagaaaaaagtgcaagattagagattattctcaaatactacataccaatgaaactcaaaattctgttctcttaaaactcagtaaataaaagtagctctcttacttcataagcttaaaataatgcagttggcctatgtatgaaagcatgttttgagataataatttaaatatattatttataattttcccatagcatatactcagtaaaaattaaataaaacctactatactatgaaaatatatatatatttattgaatatttctggaattacactaacgaagttccatctacaatctttaccataaaagtaatctactcatctatgtctaatatggtttggctctgtgtccccactcaaatatcatcttgaattgtaatccccatgtgttgagggaaagacctgtaatcccgatatgttaagagagggaagtgattggattatgaaggcggtttcccccatgctgttctgttgatagtgagtgaattctcagaagagctgatggttttataaatggtaattttttcggcactcacacatgctctttcatgcctgccaccatgtaaaacatgcttgcttccccttctgtcatgagtgtaagtttcctgaggcctccccatccatgcagaactgtgagtcaatgaaacctcttttctttataaatcatccagtctctggtggtccttcatagcagtgtgggagcagactaatacaatgtccaacatccctttgataatacagttcatctaaattgtctgaaccaaaagttattggtcttctcttttcatgtcacactcctccaccctatccttagaatcataaatacaactcatattgagagttataacattagagtaggggttcatgactagaatggtgggatatatgattccctgtattttattaacaacggatatggtgaaggtacaacaagaaagaaaaacaaagatagaaaaaatatatcattgaacatattagtgaaagcaaagattagaataccatctctctttacagaaatttgctttgatcctgtgctctatttttaagcctggactatatttatgatttcagaaaatctgttatagaaaaaaaaattgtttctcagttttacttacaaactagcctattttaaaaatcagttccaagaaaaagtgtttttcccttgagaaacgtgggcatcctcatttgtgatagtgagaaatataaagcctagtgttttatctttttaactgtagctcctggattcaaattttatgtttcatcacaatatttaaactattcatttttcatagttagaatgtgtgctttctcatctgttccatatgttattatctctttccagtgaagactctttatttacttaatgtcttacttatactataagaaatctttagagaacaaatgagatcgggcgagttaagggtggtatggctatccattgaggtggtttgattataaatatcaaaactcaaatctgactagaggtaaaagggaaataattataaggtcatggtgggggcttccagagccaaagggaaatctacaaaagcagaaacctaaaaggacaggaaccagggcgtttggaggatctagatagctaatcttcaggaaactgaaggatccactggctccaaccatttttcttctgctctttaaccactgggctcaagagcctggggagcgagtccattgtttatgtagtggattgatattcagtatccattctgccctcattctagagccccttcagtcattgttaaggctagaaagctaaacactatattccatagtatagtttgcagacagtgttccagaaggtacttaaaaatattcagctagtcacatgtgtttgtgtgaggtcagaagggcagaagtgaggtggaggccacatttgtgttacttctgcaatttctggtgcagaacatagattgcaaggttgttgatttttctgcaacagctttagctgaaatcccagtagctagccacttatcagatactgagaggatggcatgggtcatccattttgttggtgcagtcccagcaggcatgtcgtgtctctggagccaacaattgtggccatggtttctaacctgttagtcacagctaacgttcctatttctggtaccagtggttacagcaacaatcagaagttggcactgtggttcccacttccttggctttctgatgttaacagttctctttgcagactattatttgttatataacaattatttgttctgcaaataattagtggagactccattctctgtaataaatccccttctgcttaaacaggtaaacagttccattttagtccaactggccatcatgcctcatatgcctaccgcttggtggggctgattggcagccccaccaagattgcacacacaatggaagagggataattcccccagaagaaaatgagatgcccttatcaagaaaaaattaaaaagggatgactggttgtgggtggcagaaaataacaaccaaccatcctgtaaatgaatacaaagataattaatcatcattttcagggtatcttgtaagcccattacacaaagcaaagttttctgaagtcctgaaatattacaacacattatgaaagcttaactacccccaagggaaggagtcagggaatgtttcagagacatctgatctcagtcttaagactcaaagaaatatgaaggtctttctaggtagtgggaaattaatgacttaatttgtactctgtgtctgtatgtgtgtgtgcacacgtgctcatgcacatgtgtgttgagtatctaaataaagattgaagagtcaaaaaaagaagaagtcttaataccttttaatttacaaaacaataatatgtctggctactgtgactctgtttgataaaagaaaaaccaatgctcagagaactcagcaattagtatctttatgattcaattctaaccttctgatcctattctttacttaatatactatgctgcatcccccaaaatcttatttacctttgttcagtaactgtacacaggtatttatgtaaaaacttcccaaatataaaaaatggatgaactatgccaaagttacttgtttttgactgaaacaatgggcatctaaaatgccagaagtctctgtgtaattaaggtatatgaaagggcattttcgatatggtttgaaagttctgtccaataaatatgcttttctttcaatagaagatgcccagttgatcccaaaatgatcatagcctatttgagaatctatgtaaaatatcattatctttcataacttttaaatattgtgtgttgctattaatatatctttatttcatgaaaaataaatttctgtaaaatatttgcctgcataagaagaatcacatacaaaaaattttggaagaaaatataaaaatcaaattgtgattaaaatgtaaggaatttagaggcttgaatcaagaatataaaattactcatatatttacatatttaaaattgattaaatactgcaatgcctaaacttacatgataaatacaattatatgaatgcctatagctatggtatttatgattgcacattgaaagagaaatgctgaatgttgaataattttaaaaatgagatatttcatacttgtattattgagccttatgaaataaaaatacttttaattaaaatcttctataggtaagattttctttcttggacaattgagtgttatctaaaactccccttccaatttaaaaaataagtaaatatgacaatgtattcatcgaaatggaaaagaatagagtttagtttatactaatgaccaagtgacaataatatagagttttcaaaaaataagtaagaggacttccaaacaccacaattaaagaaaagttttactatttaggtgagaagtagcacaatccaagttctcattaatagagggttaatggaacttgaatggaggaacaatagtttaaaacaaagacaaatataatgacataatattgaagtgaatttgtgggggcagagttaaaaactaaataacttttttttttaatcaaagaagagacagtaataaattatttaagtaagagatttctattataggtaaactaggaaggcaaaagatgttttattttaaatacgagtgggcatattcaatacaggagctcagagtgagaatgtattttacgtattaaaggctttctatttaaaccacatttttaatacttttgaattgatatagaactatgctttttagcatgctattctcagtctctacttaatcctatttaaaattataatatctaaagcattcaggaagctagcatataacataacttaaaggtggttatatttgggaaagcacagcagtgtgtgtctatgtacctactccatcaattatggaacacactataaaaaatagctaatggcattcaatgaacccactagtagtttgcagttaattttcatggtatttaataaaggatagagattaaatagaaacgttatgagtaaaatattcagtctttggaaacctgcagattcctaaaaatattaaataattataggtaaatcaataatagttactgagtactcggtaaatatatgagttatttagaaactgagctgcatggagacttagttttgacttttgtataatatattacacaaaattttcaatcttgaattagttttaatgtagacaccactaaaatgaaatagtagcatggaacaatgtaaaaagcatcgttaccatttcatgatagggcatgtattttggcatgacagaattatgattttgcagccatttaagttatcttagtacacatatattttttaatttaaatttcttcattatgatttcaagatttacttctcaattgaatgtatgctgttgaggtagaatattattttaaggtaatgcaatcagaaaaagcaagcctaaattaggaaagttttaaaagaataatatgcaaaggcatatttttataataaaactttcccttaatcttattataaaatcaaagcttcaattttcttaaccactgcatttcctctgttatatcgatataaatcccatccctcttttgagtcccttttcctgcagcaaatagaaataagttgtacctcataaaacacatcttttccattttactacagtgatgctacttttcagtgccgaaaacgcataatgcttgaaaaccacaattccaatcttaaaaatactgcaaaagtcaattaaagaccaatgagtagcatgctgaaatttataagtaagtacacaaatcgactggtagctttgtgccattgtcttatagtgcaaaacaaccctatctgaaggtaccagctccatgaaatcatattgcacaaaacaaatgaaatatcgcttaatatttgaggtaggagatctatttttttgctccagtttctacatataaatataaaatatatgctactttatttctgtttagaaaaataatagaagccatttgaccagaagattccatgaatctagtagaaaagatcacaggaatcgaagaggattgatttttgaatttctgccatgccattggccttaactaattgtagaaaggaatcagagccacagagttaggtggatgaaaaactccacaagtaaaagggtcaacctagagataaagaagcttcacaatatcttattttcaataaaatagtcctctaaagtacacaaacttttagaaattgaaattgggaacaggataaaatatttttgcaaatttaaaagtgacattgccttaaactgtttaagattcaagttaccatgcctaaacagctatttttaataaaatatgtgaaaataaatttttctatgaaagtttatttttgaactctaaagatttagtgttttgtgatggctaatattttctattatgatacatgttaacacattgcatagttttaaaagcatatttgcatttatgtttccattccaattaactactttagaaatgatcattattgcagattttctacgtggactttgtcgaaaatcttgattttaagttactttcctaagaatttttattacagtgatactcagtgcactattacgaaagtcaaattacaaatcacatcaagctgttgcagtttttgagagaaatcttattaatagaacagcttcagagaggttactggttttcaaaatacaaattaattgttgaattttgtattccaaagaacaatatatgatttaatgccattttgagtactaaatataagcttcctaaagtcatcatattaaattttcgaagtgcttaggactgaagactactaaaggggaaagcattaaaaaaaacaaaaaacacagataaatggaagaatgtaactgtggcaatgcttactattccctgaaaagtagctgatacactactgagaatgaaatgaattatttacataagtagtctgaagataaagtacactaagctcacatagtattacagaacattgtagaagctacattttcattagtactccatcttcataataatcttgttccaaagagtttttcaagttaatgcatcaaatattatatcctatgtattgaaaattatttatgttaacacaattggtagataaaactcctaacaaggttaattaaactagcagtaacaaacatgctgcatatggaggtgagtttcgattgagaaagagcgtacatgcaactgaaggttttctgcagtgatttgcggtacaacttcagatagtatatccaattgctgaagcactttattaaagaaaaatattgcatctgctacatactaccttttagaaatcataatattcattattctgaatattatactataaaatcaactaactttaatactgtaatttagttatgatcacattattgtctcagcaacagcatgaccatttttttcaatacaaattccaatttctaaatgctaaagacatttttctatcacaaaacatagttgtgtacaccaaaattattttacatatcaaaagaggcaaaggtattccataagtataccttgatagggagcactaaatccacggtatcgatgattgctgtctgtaacaaaatgcagtctgagccagtttttgttgctgataattggtggtggtatattcattccagataacctgaattacaaaagacaacaacaaaaaaatttaaaaagcttttcagcagtaaacgttttcacaaaattgggaccaaacaaatgtccaactatattcatgactttgcactgtcaactttttaagcacaaatgaaatagttcttttatgcatagaaaagtcaatcacagaatagtgcaattccaaacacatgctgttccaatcaggttgtgtgtattaatacaatcaactataaaactttaagtgcacatgatttttgatttatccaaatttatttactgcaccaataatttatttatggtattgttttattagtattatatagtttatcatttattaatatgttatatattgtttattatttattatatcttatttattatttattatatatattgtattcttattgttaataataaacataacagatattgagctgatggtgctagtcaacgtgcttctcatatatgtattgatacaataaagttacaaaatcgaaagacctcataaattgatatccttatttccagagtgagactgtacagttattttcttatactccctcctatccacttaatgttttttcagtatttctcactggatggcaaatttcacagtttattttcatagaacaagcattgcttttatgtaatttcataatcttataaatgttcatgactagctttcattagaatatataattctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagaatatataattctataatgtattagaggcctgatccaatggagaggcagaaaacagattgtatatatccaaacaaatatagttggatatgtagtcttcacatatttggttgcaagaataccatttataatatactcaaaacaagtatcttaaaacaaaatattggaactatgctccagatattggtcatgattaatatataaagtacctcttgctttataattttttgaagatttccagcaaagcagtttttatgacatcatgaaatagaaaaatactgctgtattatacttctaccatatatctaaccatttaaattttaagtgtttgctataaagccaaagtaaaagagtctccaaagcaaggctattacatagttaggaagagtttcagattaaggtttcttaataacacgttcttaataataagagtttcagattaagagtttcagattaaggtttcttaataacaagtatatatttcctattcttcaaagctcacagttttcttcttcagaaggcaaaataaacagctgatttattatactatgtttgtggggtgggagtgtcaagaggaattacaaatattctctcaccttttggcaattagtcatgctaggggaacagtagaaggaggatggaaaatctgtcattgtatatgtaatcagtgttaaggtgtaggtacagggatgcaaggaccctctaaccaatactcttcatctttatccctgaaaacccaactttcctaagatgtgtgggagctagccaccacttttagtggatgaccacctgcccattaaaatgtaaaatcacctttattgtattattgtgtctactggtgtacagaatgttgaattccaatatgaaaacattgggataatttttatatatttctcatttttattcttggtttgcagtgcattttccgtaatgtttccctataaatctattttctcttttcatagggatgaatctgtttatttgttgagctgactgactttttttccaatctgaatttagttaacaaaaatatataatataattgtataattttagactcaagttttaaaatttgctttcattactttcagaaaatatacaggttatgtttactcttgttgattaaaatagtaactcagtgaaaaactatttggatttgtttcaattatattttcaattgagtagcatagttcatgccagattttgatttacaatttggttttgttcaattccctatttcgatgaacatgaatatccgttagggaaagtttaaattatttttgacaggctgcacacatttccagatgtaatgagactacaatgcatggaggtgtgtaatacaccaaagcagagtttggagatgaccccctaaaagacccagttcagtacatgagaatcggctccacaaggacattaagaaatgcgagaaaagaaaaaagacaaaatgttcaataaaaatgataaactttccatcttttccagggacatgaaaggtaatttcagtaatagagtacagtaaaggcaagtaatagctactgtgtaactgcagtttgcaacttgaatttactttcagtaatctaagggagtggacctgaagaaagtagagctgcagtagggagaagtagaatgtgcatgaggtggagcaaataatgataatttaacaagggtgaaactaagaagtattcctgacagcctcaatgcttcagtgtatgaggcaagaccttagataagccaagaaactgaactagaaagcacttgtaccacagcatccctctgccaccagagagaaatatacagtcattggttataggcgagtcacatgggctttgaaaatcacagtcactgaataatgttcattatttacactcattctaaacaatatggtttggtttatggcttatggagaaatctcacaaataaatctctatatctctgtccttatttcacatgttatcaggaaaaccaggaaatgagggattgagaatatatgccacttggaaagattccattaaactacttaatttagataattactaaaggagatattctaaaatataacttattgttatccctgtgtcaaatcactgtggtcatttaagagtaagcaaattctagcataaagtcaatgagaataatcttttaataagaaatagattgtacacatttattcaacagttatttaccaaacattaactatatgacaaataccaatggtaaaggttggaaatatgatagtaagcaagagaaaaatcatggttttatacagtaaaattaaaacatacaaacaaataaataaataatatatatttcagatagtggcaaatgacatataacaacaataacaaaaaacccagtaacatgataaagaatttctagaaataaagtttccattgttttaatatattttccatttcaccctaaaaatctccatactcaggattatatgtcttaaaccactaaaggggatttaggataattatatcaagaaaaatatggtcatgataaatgtcatacatttgttccctaatactctagttatttgtatcagaaaatttgacgtgtctcttgagtaataaatacattgtaatggaattactaaaaaattattaatgacatcaaatttcattgcatgtttaatgaggaaagaaatactgacaataatacagagtaacttataattaatctttgcaaaaaatttttagttctccaatttactgcagaaataatgattaaatcatcaatttatatttaaaatcctatatgtttctattgtaattaatcctttagagaatgtaattataatccttacaacatgattttaagaattagttaaacataagaaaattgagagaatgacagcttttttgataaagttcataaaactattctgagcttattcttttttttctttaatgttaaaccgcttttattataagataaattgtcaggtcctcatttcagccatatctggttttcaaactttctcaaattttgtagtttcatcaacagctatcatttttgattgctctgacatctactttttaaaaaaatcttcccaattccctaaaatcatccaaatgtaatggcctatctatattatccataggtggagtcaaatcttaaactcaggatttttcacatcattacctccatgactttgtatccctctttttcacaattctcccactttcctctaattttacttgtctctctctctctccctctctcaagcatgctcccgtgctttctcactctcttgcttttaaaccagttttgacctccttccttctctagcacttagataagatgtatccatcatgaatcttcatgaatgttctttatgaccttgttagattatggccctatgttgagctgctattagttgctcaaattttattctttcatcttatccctggaactttgcatatacttcgctttgaggctgaaataaatatcctttctttacatttattgatttactctaaatctttctcaggaaaaccagacaaagttccatggttaagagaggtgcccaatctccttctctgtcctcacagaccacctgcacatgttctcatcatatcttaattttttatgtttaacagacacataacaattgcacatacttatggggtacaatgtgctgtttcagtacatacatacattgtgtaatgatcaaatcagagtaattagcatatccatcacctcaaacatttatgatttctttgtagtaggaaattcaaaatcctctcttctagctattttgagatataaaatatctttttcgttgactatagttaccctacagtgcaataggacactggtacttattctgcctttctagctataaatttatacccattgaccaacctctcctatcaactcaccaccttcctcagtctctggtaaccactgttctatttgctacttctatgagaccatcgtttttagattctgaatatgggtgagaacatttgatatttatctttctgtttctgacttatttatcttaacatattttccttgaggtttacccatgttgtcccaaatgacaaaatttgtttctttcttaaggctgcatagtattccactgagtattgtgtgtgtgtgtgtgtgtgtgtgtgtgtgtttgtgtgtgtgtgatcacactttcttaatccgttcatacatcattggacacttagagtcgattacttgactattgtgaatagtgaagcaataaaaataggagttcatatagttcttcaacctattaacttcacctcttttggatatttacctggtagtagtattgctgggtcatatggtagttctatttttaattttttgaggaacatacatactatttttaataatggttttactaatatatattcttgtcaacactgtagaagggtacctttttctctgcatctttgctaacacctcttttgtctttttgatagtagccattctgactaaagtgaagtgatatctcattgtggtactgatttacattttctggatgactagtgatgttgaacatttttttcacacacctgttggccacttttcttcttttgaaggttatctgttctggtccattgccaattttttcatcagtagtaaagtcagagcctttagtgtatccatcactggagtaatgtacattgtacctatcaagtaatttctcatcatccacccctctgccatcccttgacctttccaagcatccattgtctatcattccacgctctacctccatgtgtaaacattatttagctcccatttataagtgagacatgtggtgtttgtctttctgtctctgagttgtttcacttgagataactgtctccagttccctccatgttcctgaaaaatatattatttctttttttttaaggctgaaatgtctagatctttttcagactcttcataaatttcctttctttagtgtctgctactgaagtcttttgtgttcctttggaaggctcacatttctttgctttttcacatttcttctttccctatgcgtatatctgtgcatctggtagaagagtcacctttccgattttatgtggtagttttggtaaagtgaaacattttcatgtatatgcgtcttagggtgtggtttagtagggtgttttggctttgattctgggtagaagcaggagtgtggtttatgtgcagtttcttcagctgtaattcgcatcagcaatgtctgagtgtgtcagtgctctggactgcaaaaacttacggtaataatggccaccatgatagtttcagactacgcatacttgggtgtgatagtttggctggcactagggtgggcttgctggagtccaggacctccactaggccagctatattggtccaggagcataccgatgcagtgaattatctagggtggaaataccttgcagtgggaccaccacaaggctaactggtggttcgggcaaatgctcacatacatgagttgactggttctggagtgggttggcaggggagtggagccaccactgggttgaatgttgagctgtcaggcacacatgggtgtgataggtaagccatctctgtggtgattttctggggagtcaggacaagcccagggtcagctttcccactctgtataactgcctgttccattggagcagggcatagcatagtctcagacactggagtcacagctgttctgctgaacctaggctccaagtagccaggtttttgttactgcagccatctgtgtgagtgtagtggaatgtcagtagcacatcacgatggataaacaatgactattggctcccataataggatgcactacagctatgggtctggtaccatcaagatagtgatgtgctatagcaccctgggtcacagggatagggggtgcacataggctcctcactctggagcaatgcagccatgttaactccaggaagctccccaaactacattcagaggcagtgaggactgtgggcctttcttgcagcaagaactgtagatgtgtatgtcgggaacggggactgctggtggcctccagcttaactttttctcacaaaaagaagtctctcccatccccaagctcatcccagcagggggaacagagtggcagagataggtgcttcacttactttctaaacttccattctgggtttctgtgcttcacagagatttcaccacttccttgtggtgaagtatccagcatactcttcattcactctagttggaatgtagttctctattcattgttttggtcctttgtttttggttggacaagtaccaggcatctctaggaaactatcttgctctgaccacaaaatttatgattagccatttattactttacttagtgataagttttctatgtttcctattattttacattttctttaacagggctgttatatccctgatacttagcataatgattgatgcatagtgagtgtatactgtcttatatatgtcaagaaaataaatgaagagaagttatttgggcacatgccctaactttcagtctctttgaatttttatactctttataagttaggtcaatatttcaatttatattattattaaatgttttagttcttttcttattcaaggcccatctaaaattctatctccttcatatgtcttcttcaactcccctggctaaaatttatatttttgttttctgaatatgaaaagcacttggtataactcttcctatggcatgtcttactgctttcaccttgtttatattatataatctatgttctaaattataagaagctgaaaagatctgcatggtatatatcgaatccataagcacatttcaaactgtagataatgaattatgctaattaagtactatcctattacaaaatttctccaagtgtgttctgaacattagcaaccaaaaatgcctggggatggaggaaattacactgtccaataattactaaattgctcttttgtaaccatattctcttcctgtagttttaaaatgttttcatctagaatttcttaaaactgcccagcaaacattctcccattttcatgctttgccataatatcagtaacatgcaatgaaatttattctaagccattgatattgttcattgcctcatgtctgaacaagaatgcattttatagtcccaagaaaaactagcatattcaaaaatactcaaaaaaataaaaaaaactttctgttgtgttgtgcggggtactaaaagttgaaaaaatattttaggaactaaattaattcacttatggaatgacgttaaatgcattaattttccacactgtgcaagtcatgtatgtagagtgtacagatgtttacatagaccaggtggtgtttccttgtcatagatgcctgactgtgctattgattaggtagtcaaaagtcactggacatcaggacacagaattctgcatggtttaaaaaatagcattacaaatctaagtattgtgttaggcagtccactcttcagaagcaagatattacaaagtagttacaaagcaaaggagataattggctatagtaagctttatttcctttccttctccccttttactcttaaccacacaccataaaacccacataccctattctgtaactctcttctgatttcccacttatcacttatttccaggatctatcctttagatgaattctcttataaaaaatggatcttatagatctgggttccttttatctagaaacatgcttcagaaaaatctatgtttatatattagatataatatgtatagattcaaataccaaattttaatcaagattaaatgcacagtttgcatagaattacaggcatacctctttttttgcatttttgtttattgtgctttgcagatattgtggggtttgttgttgctgttgttttacaaactgaaggtttgtgacaatgctgcattgggcaagtggcatttttccaataacatattgtcacttcatctctccatgtcacattttaataattctcataacatgtcaaaattttcattattatttctgttatggtgatgtataaacaatgaaatttgatgttactcttctaattgcttttgggtgtcacaaactgtgcccatgcaagatggtgaacttaatcagtaaatgttgtgtttgttctgacttctctactaatcaaccattcccttgtctttcatttcatccttgaacatctctatccctgagacacaatattgaaagtgtgaaaattaataaatatacaatggcctctaagtgttcaagtgaaaggaagagtcacatgtctctcactttcaatcaaaagctagaaattattaacctgagtgagaaaagcatgttgagagccaagatagatctcttatgccaaattagccaagttgtgaatgcaaaggaaaaattattgaacgaaatcacaaatgctactccagtgaacacacaaattataagaaagcaaaacaatcttttttgctgatacggagaaagttttagtggtttggatataagatcaaaccaaccaccatattcccttcagccaaagcctaattcagagtaaggccctaactttattcaattccatgaatactaagataaatgaggaagctgtagaacaaaaaatctgaagctatcagaggttggttcatgaagcttaagaaaagaagacatcttcataatataagtgcaaggtgcatcagcataaagtgacgtagaagctgctgcaagctatccagacggtctagctaaaataattgatgaaggtgactatactaaatgacagattttcaatgcagaagaagtagctttctactgaaagaaaatgtcatgtagacctttcatagctacagagaagtcaatgcctggcttaagtttcaaaagacagactgactgtgttgtcaggggttaatgaagctggcaactttaagttgaagctaatgctcatttattattcaaaaatcctagagcccttacaaatcattctaaatctacactgcctgtactcaaaaatagtccaggaccatatggattcacagcagaattctaccagacattcaaagaagaattggtgcaaattattttgacactattccacaagataaagaaggaaccctccctaattcattctaagaagccagcatcaccctaataccaaaaccagggaagggcataaccaaaaaagaaaactacagactgatatccttgatgaatatagatgctaaaatctgtaacaaaatactagctaatcaaatccaacagcatatcaaaaagataatccagcctgatcaagtgggtttcataccagggatgcagggatggtttaacatatgcaagtcaataaatgtgatacaccacataaacagaattaaaaacaaatatcacatgatcatcacaatagatgcagcaaaaacattcaacaagatccagcatccatttatgattaaaacacttagcaaaattggcatacaagggacatatcttaatgtaataaaagccatctatgaaacacccacagccaacattatactgaatggggaaaagttgaaagcattccctctgagaactggaacaagacaaggatgtccactctcaccactcctcttcaacatagtactggaaatcctagccagagcaatcagacaagagaaagaaataaagggcatccaaatcagtaaaaaggaagtcaaactgtcactgtttgctgatgatatgattgtttgccttgaaaaccctaaagactcctccagaaagctcctagaactgataaaaaaaaattcagcaaagtttccgcatagattaatgtacacaaatcagtagctcttctacatgctaacagcaaccaagtgaagaatcaaatcaagaactgaaccccttttataatagctgcaaaaaataaaataaaatacttaggaatacaccaaaccaaggaattgaaagacctctgcaaggaaaactacaaaacactgctgaaagaaatcttagacaacacaaacaaatggaaacacatcccatgctcatggatgggtggaatcaatattgtgacaatgaccatactgccaaaagcaatctacaaattcaatgcaatccccatcaaattccaacatcattcattacagaattagaaaaaaaaaatctaaaattcatatggaagcaaaaaagagctggtttagccaaagcaagactaagcaaaaagaacaaatctggatgcataacactacctgatttcaaactacagtataaggccatagtcaccaaaacactttggtactggtaaaaaaaaaaaaaaaaaaaaaaaaaaaagataagcatgtaggccaatggaacaaaatagaggatgcagaaataaacccaaatccttatagctaactgatatttgaaagctcaaaattgatcatggacttaaaagtaaatctacgaaacacttagaaaaacatatcacagaaaatctttgagatcttgagttaggtgaagtttcagaattaagcccaaaaacaatattcataaaaaataattaacaaattggacatcatcaaaattaaacacttctgctatgaagaagatactgaataagaagatgaaaagacaaatacaaaatgtaaaaaaaaagtgttaatatatcatacacttgacacagaacttatatctagagtatataaagaattcccaaatgcaactgttaaaaagaaaaaaattcacaaaataagaggaaacttgaacaggtatttcacagaagaggatttacagatggcaaatagttacatgagtagatatttggcaaatgcaaattaaaatcacagtgagatattatgatacacctaccagaatggctaaaattaaaaacagtgactatgccaaatgtgaggatgcagagaaactgaaccactcatataatgctagcatgaatgtaaaatggtataccaacactggagaagaatatcagtcttttataaaactaaaattgcacttgccatgcaattctgaaattgtactattgagtactcattatcccagagaaatgaaagcttatattcacacaaaaacctgtacatgaatcttcaaagtagctttacttataatagcccaaactttaaagaacacaaatggtctacaacaggtgaatgattcaacaaactgtagcatatccatatcatggaatactactcagcattaaaaaggaacaaactactgatatacacaacaacttgcataaatctcaaggtaattatgtataaaacagaacattaagagcaaaggaaaaagcgaatctcaaaagttacagattatgtaattccattcatataacattcttggaatgaaaaaattaaagatatatagaactgagtagtggtcagtaggtgttatggtggggcaggttaggtgggaaatagctgttcctctaaaaggatagctgaagggattcttgtgatggaatttccctgtatcttgactatagcattgtgataaagtgcacagaataaaatacacttgcacactcacaataaatgcctgcaaaattggtgaaatctgaatcagttcagtagattgtaattgttatgttaattttcttgttgtaatattgtgccatagttatgaaaaatgcttctcttgggggatagtgggtgaacaatatatggggttcatatggtttggctttgtgtccccacccaaatctcatcttgaattgtaatatccacatgttgaaagagggacctggtggaagtgattggattatgggggcagtttctgcctgctgctctcatgatagtgagggagttctcatgagatatgatggttttaaaactggtaggttctcctgtgtgtcctctctcctgctgccctgtaagaaagcgttttcttctctttcgccttctgccatgatagtaagtctcctgaggccttcccagccatgtgaaactgtgagtaaattaaacctccttgttaataaattacccattctcagataatatctttatacagtgtgataacagactaatacagagagttggtactagtagagcgagttactcctataaagataacctgaaaatgaggaagcgactttggaagtgggtaaaaggcagaggctggaagagtttggagggttcagaagacacgtagatgtagaaaagtttggaacttccttgagacttgttgaatagttttgaccaaaatgctgatagtactatggacaatgaagtacaggttgaggtggtctcagatggagatgaggaactgactgggaactggagcaaaggttactcttgctatgcttagcaaagactctggtggtattttgcttctgctctagagatttatggaactttgagcttgagagagatgatttagggtaactgccagaagaaatttctaagaagcaaagcattcaagaggtgacctggcttattttgaaagtgtacatttaatatgaattcataaagagatggtttgaaattggaatttacgtttaaaaggaaagtaaagcataaaggtttgaaaaatttgcagcctgaccatgtggtagaaaaggaaaacacatattctggggagggattcaagtcaactgcagaaatgtgcataagtaatgaggagctgaatgttaatagccaagacaatggggaaaatgtctccagggcatgtcagagaacttcacagcagctcctcccattccaggcctaggaggaaaaaatggcttcctgggctgcactcagggccccattggtctgtgcagcttcaggtcttggtagcccacataccagctgttaaagctccagccatgcctaaaaggggtcaaggcacagcttgggccattgcttcaaatggtccaagccctaatccttggtggcttccacgtggtattgggcctgcaggtatgtggaagacaagagtttgaactttgggagtctccacctagatttcagaggatgtatagaaacacctggatgtccaggcagaagagctctcatgaagaacctctactagggcaatgtagaggggaaatgtgagttggagctctcacacagagtcctcactggggcactgcttagtggagctgtgagaagagggccaccatcctgaccccagaaaggtagatctaacgacagtctgcaccatgtgcctggaaaagccacaggcattcaatgccagccatgaaagcagccgcaggggctgtaccctgcagagccacaggggtagagctgcccaagacctgggagcccacccattgcatcaatatgccctggatgtgaggcatacagtcaaaggagatgatttaggagctttaagatttaatgactgccccaacagggtttagacttgcatggagcctgtggcccctttgttttgataaatttctcatacttggaatgggaacatttacccaatgcttgtacctgcattgtatcttggaagtaacttttgattttgatttttttttttttttttgcttttgcttttgcttttgcttttgattttacaggctgatatgtggaagggacttgccatgtctcagatgagactctggacttggatttttgggttaatgctggaataagttaagactttggggaactgttaggaaggcattattggttttgaaatgtgaaaagtacatgagatttgggagggtctggggtggaataatattatttggctctgtatccccaaccaaatgtcattttgaattgtaatccccatgtgctgagggaggtacctggtgggaggtgattggatcatgggggcagtttcctccaagctgttctcatgatagtgggggagttctcaggagatctgatagttttaaaagtggcaatttcccctgtatactctctctatctcctgccaccatgtaagaatttgcttgcttctcctttgccttatgcaaaccttatattctatgtttcctgagccccatcccctcacatccatgcagaactgtgagtcaattaacctcttttgtttataaattacccagtctcattagtatcttctgaggagtgtgagaacagactaatacaaggatctctctgtattatttattgcaattcaatgtgaattatttcaaaataaaaaggttttaaccttaaatattagatcaaaattattcataaatttacagcaaaattactcttactaacccaaaactggaaacagcccaattgttcatcaactgatgaatgtatacacaaaatgtgatatattcggcaataaaaatgaagtacagatacatgctataacatgagtaaaccttgaaaacatcatactaagtgaaagacaacagtcacaaaatatcatacattatatgattctatttatatagaacaatcagaataggcaacaataaaggcaacaataaagaaagtagattagtaattgtccagtgctcctgctgttggtggtggagatggggagttactgctagtgagtgtatgttttctgctaggagtgaagaaaaacttttaaaattagtagagagtgtttcagaacactgaatataataaataccctttgacttacactataaatgggctaatgtcaacatatgtaaattatatctcagcaaaggtgtcagaaatacataatggattattagtaaaaatagagaatataccatgcaaatattaatcaaatcaaataaagaatggttaaactaatgctatacaaaacagaccactcaatgaagaatactaccagaggtagaatattacataattatagaaaataaattcatcaataaattttaactatctaaccatattcatgtatattaacatgaagcagaaactgatactactgaaggaatagacaagtctacaactacagttagagattttaacaatcaacaaccagaacattaacagcacatagaaaaacttttatagagtattacactattgagttagaattgcctaagcttccattttaagaagagagaaaaaagaaaacaatctatgcaggagtaaaggaatgataatgacaagagctcaaagcaatgaaattgaaaggagaaaaagagaaaaaaattctaaatccttgttctttgaaaaaatcaataaaatcaataaatgctttcctagactgatcaaataaagaaagatagggaggaatacaaactttgtcaggaatgaaaatggattatcattagatgatgtagatatttcagtaataaggcagtattataaacaagtttatgtacattcaagaacatagatgaatctcaaaaggattataagtgaaagatccatatactgtatactgtatggatgcatactatatgatttaatgacattctgaacaaagacaagactatacaaatggaaatcagaacagtagttgctgagggctggaggtaatgagaaggaagtaactacaaagggccatgaagcaactttttggcatgaggtaaatatttaatatctttattgcagctatatgattgtatatgtttgtcaaaatacataatgttttatgcataagaatgaaatttactgtaaataaaatatacatcaatacatctaagaaaaaaataattttaagatgtttttggcttgccagtcaataacattaacaaaatgttactgtgcttagaggcataaaattggagaaaaagaaatttattcactgaaataaaaggatcagaggtatttgaagttttctggaaaagatcatcttccctatggttagaggaaataaacctcaactattattagtacatatagaaatgtacatgcaaactataaatattctaaattgcttttccttgcacagtaaggaaatgcattcattatttgcccataattgcattctcaatacattccattcccataaataaactattgcttataacaaattttctttaggcctcttgaactgatacaatacccacgagactggtttagaaagccaatgttttaaaagaaaaactaattataaatgagctagctacttactttatctacttgagattaataattttatttattgttttcattggactaactaaataaaattaatatctatgttggatctagtcttcacattttctcattcacaattttgagggttattgcaattaaagaacatggtaaatgttgaacatgaaataaatgatcagtgcgtctattcaaggtgatccctggaaagtgtaatgcctaacttttccatcatttttcttattctaagcacaatatatgaatacttatgaatttaaaattggattttaaatatctttaccttcatcactaaataaaacttttattcctatattcctaggaatagaaatgtaacagcttcaggtttactcaacagtagacatgtgtgtcttcaattacctattcaagagcaccactgatctgtttctccaaataccacatataattaccttattttataaggagaatgtgtaaaattttaaagataattacagagcaacatgtgcagaaaggatgtggctgctaaatctagaaaaggtgcaattcaatcccactgtactgcccattccctctttctccctctgaaaatcaaagaaacaaagaaaaacatataaagcaaaaccttttgtaaaactgtttatttaaacaaatattactcttcttctgtagtttatctctatttcacattaggtctgcatatttctgggtaaataagtgaatagttaacctgcaaaatttattaatcctgatttatggaggatgttagaactttcaaaaattccctcgttttctcacttctttacataaagtctttaccaaaaatatttaaggagacattttagcatgtgaactatgcatatattttgcaggttgatattagtaataataagacacagtatttacagagagctatttgctatggactgcatacagtttcaggtgcattttttatttaattccagaaaggaatacccatgcactatgcaatgaagtagaaatttttcatggtatgtggctgtgaaacagatgtatattgcaaatattgctattttattgataagaaaaccaacatgatttgtattccagttattctaagagaagggagcattacaatttgtagtgacataatcaggtatatattaacatttattttatttatctgataatctggcagtttaagtactaatcttatgttcatataagcctgaaagtagttgaaaaagcttgaaatcactaataatatctgtggtcttcaatttcattactttaatttatttccaatatatttttaaaaatgtatatattatgcatttgttttctatttatgtcattctcaagactgatacctctcaaaagaatgtctgataggagagatgttattttctacattatttatctttttattttcctgtattcatttcattgatttttctaacaatctacaagcaaaatctggtctattttacaagcaagatacctcaaatcccagtatgttgtactacattgacaattttatgatgtagttacaattttatttgaaaaaatgacaaatgtattggtattcttttagagatatgactataattagcttttttgctgtttttaattttcactatgcatcaatatctatcaaaccccaaactccaagatctcaaattaaatttgttttaggacattaggcaaggatcagacaatggatttattatgcaaaggcaaaacaaaaaaaaacaaaacagaaactgaatttcatattttcttaattctccagtcaaatctgtaagcacattcaggaataattttgaagataatataataaaggggttatttatatggagttgtggaaaaggaatcaaaatggaatggggtggcaccaagggtcatgtatttccatttggaaaataatggaaacacccgtgcagaatgacagctggtggctgggactgtcatagggaaaacatcagttccactcaatggctcaaaccaaaaggaagccagagggcaacagggtctgcagacaattaggcagaaaatagactggggcaaaagggcaggaacagagaatgagttacacaggtgtcagtcaacatacgtattacttatttaaagatatcaaagatgaaagactgtctagtaacagtagaaaaaaactgtagttggaatataaaacatatatgtaatagaacatttacagttagacacagtcataaagataacataaaaatcatcacaaaaaaataaatcgtgcttatattgaggtatttttttcttaagctaagaaaccattcattgaataattgtcaaatgttttctatatgccaagtactctttctgaaagcatattaatgaataaaacagatacagagtcagctttttcatgctagtgaggagacatcacagaatagaatttagcaagattacagcaaaaatggaaattattgtataatgaagtagaagagagtaaagggactgaggaatcaaggggtacatggcctagcaaattctcccatcttcttttatactctcagtgaggggaaaatattgtgacaagttgagtgtgtgctttctggcagctccaggaagtgtccagcaaaagtacctgtatagtttcactgtcatgaaaggaaaggaaaggaattccttactgggagcccttacaggaaaaacaacttagggaagaaagaccataatataaaatccctccctcccaacatgcatttgcctctggatttcccatacaaacaggtctccaaacttatagtatttgtaacggttatagtcagaaaatgaatgctttttctttggggatgtttcattttacttcatgccattttatctttttatccaattttaaggctaataactattaacatgacaaatggggaatgagtctctgtaccatatttcagcccagatataatttttgtcccttgagggttctctaaatgtatttttaaaaataaaatgtattttaaagctgatttttatggtatagtgttctatgaaatcctttgaattacacgtttactgaataaatattgtagtacaaaatccatggtatataactctataaatttatttgaatgagtaatgttcactgaacagctaccatagtaaaaaaaaattaaccatgttgtatttgcattttttcctaccagtttgaattaaagataaaatatgtttatacatttaaacataagtatttatatctatggttagaatcttatacatatttgtatttttaattttaaatgctatataacctactttcagataaacaatgttgaacaggaagacccttaattaaatgggttgcttacttcacttttataagaaatttaaattgtggtatacaattagcttatgaagatatattcacaacagacacaatttacatacacccttgcatacatatgcacaaataatcaggcatttatttatataaaacattaattatgggattgtcccctccaggatactaatcacactaactatagttctcatggcctccacacacatttatttgtgttttgtcttttagaaagagaagaaaaaaataaaagcacataagtggcacatacggattgtgagagtaaggagtagtaaaaacttaaagaaagaaggaagaacaaaaattgtatcaggactatttaaatgaaaaacaggacagtacagaattggccagatagttggcaacaaaaattttaataaaagaaaaacacatatgcccgtactccaaaatgaaaaccatcaaatacaatattatagtaccttccttttaatttattcaagaattattttttcactcaacactctcttacaaaagttaattgagcactttatatatgttgggtacccttctaggagtcaaaacaacagacaaagatatcatcctcaaagaacctgcattcttgttggagagggaaaaaataaacatgaagtagtaagtacacagcatgccaggtagtgataagctctacaaatgaaactaagtggtgtgggtggtacagagagatatatggttagaggtctgagaaagacctgtctgataatggtcctattagcagagttatgaaggaagtgaagacgtaagccatgtagttatatgagatatatcatatatatgcatggaatcttgagcaggactctgtaactcgagtggagtgtccaagaaagacagtggttaggaatgctgttggaaagatagcaatgggccaggtataatatgaccttgcagggttattgcacagtcttgtgattatagtcttccataaggagaaagccattggaacattttagtagaggaatatcatgtctgatttgcatctgataaaaactgagctgatgtgttgaacagagtagggttagggcagggacaggtggaagttacttgaataaccaagtgatagttgctgatatgttctgggaatagaattgatggcaatggaggtcaatagagaggttgctttctgacttaattttgctgagagccaacggagtttgtgagaaaggaaagagtcaaaaatgactctaaattcttggtctaagcaattggagagatggagaatccttgattaggtggagagcaccatcagatgttgaaatctgggagaaacagtgaaagctcagtgttggagatgttaagtttacagtgcttagaagtccaagtattgatatcaaatacacaggtggctaaaggagtcaccagtatatacatatggtgtttacagtaacatttctagatatgcactaagacagtgagcataaatagaagaccaataacttgctccgcttctggattccccccacacaccaaggtttactccagaggcactataaagacaaaaggtggggccagaagcggtggctcacacctgtaatcccagcactttgggaagctgagttgggcagcttgcctgaggtcaggatttcgagaccagtctggtcaacatagtgaaacccggtctctactaaaaatacaaaaaaattggccacacgtggtggtgtgcacctgtaatcccaggtacttgggaggctgaggcaggggaattaattgaaccagggaagcagaggttgcggtgagccgagatcgcgacactgcacgccagcctgggtaagagagtgagactccgtcttaaaaaaaaaaaaggggggggtgggggggaagggaagttttgagaaattttctccaacaatggaatgtgtgggtcctaccttgtacccctctgtacattaggggtggggaagtcaggctttggtgtggaagaataaaaataggaagagaaatgttagaattccactctcacttctcatccaccctcgccttgggatgtcattgtgctgccctcacattgggggaaaattcctcaatttctccctaccttgtccttgctaagtgatacaggactgtcacttagatctgaaacttttagaaaatcagttaaagaccacttggaggagccttgggaggtttttgctcaccatcagttccaatctaaagggatttggaatagcctaattttgaagtatatcatttttattatcaactggtatgagttatgtttacactaaggatattaaacttttttatttttccccactttattgtcttcctttttaaacttttttcatgaaaaaaattgttatgtctgtattgtttcattgtgattttccaaattgcatttatgcttagaaagcctttttctattcagaaattaaatgaatcttcattgtgtacctcctacgatatacttttgcttctgttttatacattaaaatttttaatcagtctgagatatattttgcttcaaagtaggagatgagatattgattgattttttcctatgcagctgtcagttttctcagtaccatttgaaatactctattctccatttgcttatggaaattcctacctcatctaaactatgttctaaaacatactagaattaatgctttgttgtactgatttcctcaattttaatatgtatctacaacatttttaaatgatcatatctctttgtatttctacattcatgtcatgaaacactagcttcattttgtatgtttttgtaaatttttatgtccacctgcatttgttttcaaacttgttgagttgctgaaaaagaactttgagcttgtcactggggttatattgcactcgttttgaaagaattaacagcagcgatcatggttagaaacagtaaaaaaactagtatagtagaatcacaaattaattagaatagactcaccaatgagaacagataccagatagacagcaaaagtataagattaatactatgtctttgcagttatctctgtcttctttaatatctctcagtgaagttaaatagttttctttacagtacctgcacattttcttttaggaaaactctttatttgacattttgcagaggtatattttagcattataatataatctaacgttataatttttctaatgtattttgtgtatttatcttatgctcagtttcttgatgtctcttctcaattttaagtattatttacataattcttctggattccctagatttatgtgtcttttcctttcaaaattaaaactcttccaatttcaaattttatttatttaaatcagaacttctagtgttaaataccaagtgtactttcgaacagaaatataggaatatgaggggagccgggaactttggttgcatataaaagaaggaaatggaaataatacaactgaaggaaaatataatagatcacccagccagataaaccttaaatgtgctgcttttaacctggcctctaactgcatggaaggaagccaacctccacgttgttcttcaatccagcaatctgcatttccacctagttccaagttatcatcaattattatttactcctacttcctaaatattcttcttctgaacaatcaggacttagaccagatcctcaacatatataaacaaaattattataatagcatcctaactagtttcgtgtctctaaaaaatattctatgcaccttatgtgttgcaaatatagtattctttctaaaacttgttaagttgtcacacgaatcttaaaatcagtggtactcaaacacatacataataggtcacccttaaatacaaacatgcagggtctgcaagatctaacttatatttatgtcttaatcatcacttctcaattcttctccctccttgccttgttcttgctacgaaatcttgcacttttatgaagacatgtactgtatcataactaagcctttacacaggttttattctttttgtagaatgtcttctgttatctcctcttatgtattttattatgccagatttttagagacttaagtcagcatcattttaacaggaaaatgtttccagaagttgtccaagctgtgttaaccacccaacttcagagctcagtatcctcagtatcctgtgatcaaaacattttttacaatatgtaagaaaatttagagtagaaaattatattcccccttccctatttcatccacactgttttaaagcctttgactgactgaattattcttgaaaaatgttttgctaaatatgtttctttgtaacttagatttcaaattgtgagctaaagcaagaataagaatatagtgaaagtctgaacccataaaaacaaaatatatgatcaagtacaaccatgtttagttagtaattttgtatctaataatttagaagaagcaacttcttcctaaaaggaaatcattgttctaggcttaattttggaaaaaaaaatgaagaactctttgagaataaagctgtgatataaaattagacaaatatgattttataagcacatacatgagaaatctcaagaaagaaacccattccatcacatatcctaggattttaaaaagcagaaatttaaaagttaaaagataagtagaatcctataattatatgaattcactcagccctaccttaaattcttttcatataggtcaatggttttataaatcaataaaatttgtccagtgttatagaccagacactaaaacatacgaagataacaagagtgtttccatcactaaattcttcttgaaaagatgaagaaatgaggataattaatatctgagattgatatttcaaagtattatgatactctgactttggaggatagttggaagttttacaagcacaagacagaacagaacatcctattaagagtaagaaatatgaaatagcaaattttgttttccttcactttttcaatttcaatttttaataggaatttacttcctctaaaggaatgttactgtcttcagtgtctagaacagtccataataggtagtagtcattcaataaattctgttgaatgaatagataaagattgttaaacatttttttctgattttgaccctaacactatgcccagcctagactgattcacagcccaactcttgagagacacagagcagatataatcatacaatattctataaagtatcttttcactacaaataagtaaaatgccaaaaatttagtcatttccttaaaatttagtggattcttatatgccttattgaataacaaagaaaatgctgtaattagtactagttttttggaactggaatataactgtgaatatatcaacataaatgtggcccacatgttaccaaagtttaaaaaccactaatttacaccatctcatccttttttaacctatttcattttctccagtttctccccaaatatcctttgcattttattgttctgtaattttgtttatgctgttatttcttttgtctgaaaagataaagtatagaaaatcttgtctggagagtgtgaaactagttaggatgctgttgtaataattttgattatatattttgaggacttgcccaactgacttgacaaactactacttatccttaaatattcagctcaaatgtcactttttcacttttctgtgaaatgtgtgtttcatcttgatcccacaacactttatattgcctctattttatgtgcaacgatctaaaaatcccataaatatttgtctacatgtattactattattccttaagggtagagaaaaaaagtccagtatccatacactctttaaatcttggttaaatgaaggggctaaacaaaacaaaacaaacaacaacaaaaaaactgcttatgataccaagaacaatcgccttgcaatgcttttttgaatgccctactagttttctaaaggcatacctgcatatattggttactcaatcattcctgacaccaccctttccataattgtaccattttaaagaattttattcgtttcaaccaaaacgtctcacgttattgtctttttgtcctaacacaaactttggggttatttggaatacatctaactcttcttctaaatatatgcctttaaatatgtaaaagcagctggtctatatgccactaaattctaattttactctagtctatggtttctaaattaaaatcattgatcccgttcctctaattcaaacaaaaaaaataaagccaaagcaagtaataaacaaagcaattataaatctaccaatcttaaaaattcatatgctataccatgaagacttcttctagcacctgaactgaacactgggaactggagtgtggttcagacagcacacacctctgctaatatgaaaaattgtaactatttccatgtttcttctcaggctaaaattcaacttacacttgtgcctcaccagcacgaaactcggcacatcattttactttcagttgttgttgttgtttttaatattagacggaagagtacaaattctaaatactaagtttttttcctgtaagccctagcaataattcttttcataagacaagttgtatatatttttttcacagaattttcttttagaccaaaatatctgggaaatttgtaaacgaccctttttacttttgcctgcctttaaatgactgaatcgatttacttttaaatgttttacaaacaaacaaaccttttattgaagtaattccagaaaaagaaactctggatcctcagctcatgtggtctatcgggaagtaccctcagcctggcaagcgcttccactattctcattgcccagtcagcggcctccttcagacctctgctgggatacgactgtctcagtcaggctgacgccaaccacacgaggtgcgaccccaggtgtgtgagggaaaggcccctaccccacagggaacaacagccacggggaaaggaaaagccctaaaaccctcttgcggagttttaaaaaagaaagaaacaaacaacaacaacaaaacaaaacaaaaaaagccttatttgaacaaacaacaataacaaaacaaaataaaaaaacgccttatttgtgccctgagtctttctccacaagagcagccacccaggtgtctccctctgagagttctgaagtccgcgggcctgagaggaacgcaaaactccctcattccgagtcagtcacaagaggccccgcccccagcgctgctggatgcagcgtcgattggctgcccctactgtcaaggcctctcctggacgattcttctccaccaacaacctatatcagacatgagattggcttatgcactgctgaagtcctgcccccggcttgaggaggccggcgtcaaagagctctccacagcctctgctgtttttattgatacaaggacaagattcataagggagtcagggacttggaggggcgagggtctgagcggccctggaaatttctgaatcccagggctggaaggacatggagacttctccagttctcacactttacagacgatgtaaccttctctcacaaaaggtctaggggcagatctggtctccaaaagagggacatgatgctaagcaggtcctgggagagcaggctgtgccaggaagagtttattctgcgtctctgttctatctagcttttgagctcagagatgaggcgactatctaagttggccaaggccagggtatacaccatcaggttgatggagttctgcagaaagtgcagagcaaaagcctggcctccacggaagaagaggaagttctgagtggtctgagggaggctggacatgcactcagggagctgagccccgatggatgcctgtctcctttatcccatcctgttgtttccccattaacacttaccactttctaatagttaccgtaaatatatttaattaccatttcttcacttatatttcttgtctatctcttacttaaaatgtaagcctcgtgaggaagggattttctgttttgttcactgatgcaacctcaaaatatagaacggttctggcacagagaatgtgactaataaacattttggaataaactaattctaatatttcatttgtttttatggaagtccaaaacaaaagtgctatttggtttcagttatccaaagtcaaccacatagacagtatattatttgttaaatcttgtcaaaaattaactgaacaatcaggatttcttcctctatttttgaatttaccagaataaaaagccaaaaatgttgaacaattaaatcccagttttatgttcaccaaattgtcttaattggaaactttttacaaaaagaaagatgcaagtatcttgtgataatcaaaataagtatcctagaatttttaaattatttgtagtcatttcaggaattatgacatttttcttgagaatttgtgaatgcttaaatgtatggctccagacagttgcagaataatggaacaaattattactaattacattgcttagtggtgtgcatttgattctataaataatcaggataggtctgggtgtgtgtcacagtggcaagcataatcaaatattaaagaatccgtaactaacacaatattgtttcagaatactactgtaacttctttgaaattaggtctgtatcttataaagttttatcttgttttatatgtatgcttacctagcgtaccaaagaggaaagacagacttcctaaggaaataaagcaactctgaaataatagccaatgtgggaccatgtactgttagatagtttgatgtaacttcaattctttttttttttttttttttttgagaccgagaccgagtctcgctctgtcgcccaggctggagtgcagtggcgcgatctcggctcactgcaagctccgcctcctaggttcacgccattctcctgcctcagctttcggagtagctgggattacaggcgcccactaacacgcccagctaatttgtttgtatttttagtagagacggggtttcaccgtgttatccaggctggtctccatctcctgaccatgtgatccgcccgcctcggcctcccaaagtgctgggattacaggcgtgagccaccgcgcccagccaaacttcaattcttactcggaaaaatcagtggcaataaagtgaatacaaacagcttttctatggatacttttttaacaatccacagaattcatgcttttgtcagttatattaaagtctttataaagcagtattttatgacatgaagcaacatttttctgaaagaatactctagattaaaaaagaaagattacatttgaataattacatacttcttaaacttttatataatattttattaaacatgattgcatttactctgcataatgattttgcgtgtcaggtaggctcattggacctacattatccttgtgatacagtattaagatgacagcagaaaaataagaaccatggtagatttgtcagtgttcttttcccttgtcctgtgtctaccttcatttttcactttctgtcagtaaactaaatttatgtgaataagcaaactcagttacattaatgatctgaaaaccctacaagtctgaatattttctctatccaaacttttgaattctactcttagaaccagtgagtatacagcattttgtgttttataagtctcttatagaagtcaaatgacttcaggccggcctataatcccagcactttgggaggccgaggcaagcagatcacttgaggtcaagagttcaagaccagcgtggtcaacatagtgaaaccccatctctagtaaaactacaaaaataaggcaggtatggtggtgggtgcctgtaatcccagctacttaggagggtgaggcaggagaatcacttgaacctgggaggcagaggttgcagtgagccaagatcacgccactgcactccagcctaggtgacagagcgaaaatctgtctcaaaaagagagaggagagaagtcatatgccttccagcttttatactctgaacactccaaaagtttcaaggacacctgagggcagcaaacaaagtgcccaggggcccatatcctagacattcctgactactaagttgcactctttgattttctctgttctagtaggaaaaaaaaaaaaaagtgctcagggcttctaaaatgcaagtcagtggtgctaatattaataatgaactgtctacttttcaatacagaattggctttaacataatgttgacagatcaactgacaagaacgattattttttaagaataggaaacataaaatcacagcagacacacacaaaaaagcagatcaataaatatgaagatctcagaaacaaaagggcaaactatattctatggtacattgacttgttgtgcctttatgttgacattttcaattgtatggaagctttttaaataagcaagatctgatggtagcacgtattaaaaatgatcttagaaaggaatgtaaaaaggagaagcaatttgaaatatttattttctgtttataattcatataaatattgataaagagaatattttcagggattacatgggtgtatgctatccatatccatatgatatataataggatatatgattcagaaggctgacaacatttcacattgcagaatgtgtcttatggtgtgtccaacattacagcacatctcatcattttacaaaaatctctcaatggccaaaatgacattcccatgagaagatttacttttaagcaagtaggtacaatcagttctctttagcggaaataaaaacattgttgcttcatttagaaaattatcctcaattttaacataaatttaaaaatttaaaatagatatttaaacatatgatttctaaagttaaaaaaagttttatatttcttagaaggcatagatctgagtaatgtatatatctagtttccatgactgcatatattgtaacatatatgtgtatgtatatgtgtgggtgtatatacatatatataaaattcatgaaataaaaaggaataaaacaatgagagaaagaaaaaattgatttattctgtaaacttttaaacctatcacatttaagatgctcagatatattgttaaaaacatttgtattctacacagagcacattcaattacctacagaaataaattatggatgattggtgatctgatttataagcttgccaacagagttcagaagcaatgtatcagaaacaaaaagactaccacatcttaaataagaaaatggcattaaggaatttgccaactattccaatgatataaagatcacacatgtcaaaacaagaataagtttatatcaagctttacagaatagtacagaaaattaaagaaaaaacattttaaaaatatatatttgtacgtatctacccattcattttaagcatagagaatctgaaagagtggttttagcttcatgacttatgcccagaagagactgctctctgattgttgttgtctaactggcaattgttaaaataaatatatgtgaagtcactttaaatataaatattaagcatatgagccaatccaaacctcatatacaaatcaaaatactttatatatagatccatgattacctattctttcaactacataatttgagggtagaattatatattcccattttacagcaatttaaaattctgcaaggatgaagtttccagatctagcaacagtgacataacatttggtgggagaagggaagtgagaaagggtgtgttgtgaaggaattatttccaaattgtcatcttccaattttatttcaacaatttagcgaagattcaacattaaaagtgaaaaaaatactctaacaatttttccacaatatactgaaaatgtggtaattcttttgaagttgacactttactaaataaatgctgtatttctgtcctacaatgaaaaaatacgctgttggttacattagcctggaaggctattctaagagttatttcattccacctactgcttccagtgagaacaacacatagtctggatagataaatgattgtccattataattgccaaatgagggttattttttttaactaaacttgctgatatctccaaaattaatactttgggtatttgtcaaattatatatacatttcaagtatctccattctgacaacaataatggtcttctatagaaaaactacagatttttatgtttaataaattgttttttaccgttaaagctctatttgcaaatttctaaattttactctctttgaatttgtttcagttactcaaacttcacacactaaaggattacacttagaatatacaaacagatatttgttgaccacctacaatgtaaatacatatttgaattgttttaaggtctaatatgttaactacagcaaaaatgctacatttgtgataaagacactactgatcactttggtcacccaactgtattataattttctgaaggtcaggtcttcatttgaaattcatcacattgcttacagcatgaggacataacaggcgctcagtaaatgtatgctgaattgcattaaatgtcaacacctaaccttcaatgaaaagtcatcacttttttctatcaaggaaaagagcaaatgtgacaagatgatatgtcaataacaaactatgaaaagaggaaatgttttcaagacttcactcaaaacttaccttcactttttacattataatacatttggagatctgtttctggtacttgtttaattttttgtttcctattagtaggatttggatattttgactttgaaaatattttcatgcacctaacttgtagtaaacattaataaacactaactttacaatacatgtagttacatatttaataagtaaccaagtaaagatgtaaaaataggttgtccttgggtttttaagtattggcttttcctcatcaataaatgggaattagatgtatctgtgaatctttattacattaaaattctgaccaaaggagaagtgtgaaaatattttagctgtccaagttaaattaagggtaacattttcttttggagtatgtaaatgagattttcctctagcctttcaaccttaaaaacttacatcttctatgggaaaaggggaattaggtatctgtaagtaaaggatacattcaacgggatttgaattcaatttttttaaaaagcaattctgcaaatatgcttaccatctaataagaaaaattaaaaagttattaatcaagataatagtccaagtgtggtggctcatgccaggtgtcatggcccagcacttcggtaggcaaaggtgggagtaaacgtttgaggccaggcattcgagaccagcctggacaacgtagcaagactctctgtctctaaaaatttaaaaattagctggtcatgatagctaacgcatgcctatagtccaagctacttgggaggctgaggcagtaggtttgcttgacccagttcaaggttaaagtgagctgttatcatactactgcactgcagcctggataacagagaccccatctcttaaaaagataatagtgacctctgttgtttcacacttgtgttactgcataactaagagaggtattagagcatgtggattttacaataaaatattattatacatggatataatagaaaaatctgatgtgaattcaacattctcctccttataagtttcaggaatcaattgaatgacttgctaaataacattatttgtgcttaagctcatttcaaattaacttttacatttagtagcacttctgataatgtatcaataaaacagcctgtatttttttcaatcaagtcaatgactaatgccaacaaataggcttccccttctccctcactaccaacccaacacaccaactccagtaacataggatgtttaacaagtccttctcaggaaaaaagaaataaaaaaagaacatcaaagcaaaatatgggcatatctccctttgtccttccataattatgcttttgttcttcctagctacagaaagcctaccaacatccatctggtagccagcactggattgtattcttaaactttttctaattttagctttgtactggttaaaattatataatttaagtaggaatattgtattcttaaactttttctaattttagctttgtactggttaaaattatataatttaagtaggaatatattcatgtttttataaacatatataaataattatatgtgcatgtggagttaaatacctaatatccttattgacttgctgacctttgatccatgagatcacaaactttcctataccacttctagaagtaatcattactattaattttatgtatatttaatatacttatgaacttacttatacatatacaagtgaaaattgaattataattttcacaaatttttaaagaagtttgtataaatgggctattactatatgcactgtcctataatgtgtctcctttactatacatattgtagaactttatacatcagtgtgtgtagtatttgctgctatgtatcatttcatggaactaatgtatctggttttatttatgtatatcagcttaagcatacatgcaatggtttcttcagaataaagaagagtaagtggaattattaattatataaatttagaatcccacggccttaaatttgaggtgagagcaatcagcatgacatgttattttctccagcaaaactgtgtatctatgtatccttttctatgactcagttcaacatcttaatggtggtctgccatgcctctgattcagccctggcctagttcttcaaattgatttcttaccaaactaccctagaactatatggaaaactttagttcactcttgttatgacattttgtattactcacatctcttaaattctctcttttttaatctggcttagagttcgtggcccaattacataattactttctcaaaattattatttctcttttcccattttccttctattcagaaaaatatctaattttattcacaacaaaattgttgtctactccatacctagactctcataactaaacattttgagagaaaataacattattgcttaattttcttacttcagactcatgactacaagtacgtcgacactcaaaactactgggagatacgtgtttttctcatgaatatatgtaccaattcttcaatacatttttttaagaaaatgaaaacaatcccatgaagatatcatatttctaccaggaaatctaccatccactcttatatgtatctttattattttctttgtgttctgtagcaattgaaaaattgcccatattcttatcaagacaaatttcctatttgtttgtctatcatttgctccttcaatcattcccactagttttctcctgaatcattcaaaacaatattaaaatatgttctaatctccctcatcttttaagaaatcccaactttatgttttcctccagcaactgcccatttcttgcttccctttaaagtgatactcctggaaaaaactttctgtacacgctgtcttcatttccttgtctaacatttttttctttaatccattcctcatgggctttcatccactccactttacttaaatgtctctagtggattacaaggctctttggtaagagcttctctctattctggaacactgtgccctagatgtctgtataggtctctcgttctcacttttcttacataacctattctgtaagaacctccctgactgctacatttaaaatgttatctaacatttgaaatgttatctactacctagatagatcgtcccctttccctactttattttccttcataatcttattcactacatagcatattttatatttcagttagtttattatctgtaacaccaaccattgtaatgtatgttttattcaacactgtattatcatctgctacaactctttcttccaccaaaaagtctcactctgtcgcccaggctggagtgcagtggcgtgatctcgactcactgcaacctccacctcctgcgttcaagcaattctcttcctcagcctcctgagtagctgggattacagacgttaagccaccgcgcccggccttgagaagtatttcataggttctcatcattctgcactgtttggatttccttctgtactattaaactctcatttttcacaaaatttgataactcctcctattataaagtgtttgagtccattgtcctgagacttagtcataggagaccttcttttctgagtgtgcactttttacccaagtgatctcaacaagtccccaagctttaaatatcatccatattctgctgactctcatgtctataactgtaatcctaaattttcccttgagcttcagacttgtataaaattatgatgtgaattgtatgttaaaatcattttctacattctggtttactgcaaaaacagaaaatattagaaggatgagcataacattctttaagttttaagttcaagagaagaagggttataaaggaagattggttgatttttcagggatagcagagtttcttgagtatatctcttctgagatccttacttctccatagtagaggcaaggcatttggcattgttatttatcaagttgaggtactgtaaaaattgctcttaaagtttgaagatgaaccttctcaagtaccaggcaaaggcttgcaaaccgcagaaggtcttatatgagaagctggcataaaaactgtgacagttgggtgaagaggataagatgagagggcagcaggacacagaaaggacccatgagattcccaagatcctgaaagaggataaggtagtgttgtcctggtagagtgtatccagatgattaagaggaaaaatatcaccaaacattataatgatgataactcttttggacatcagaaaggatgcacccccactctgatgatttcttgtgtcttaaatccagaacagaggaaacagtgcttgagtgcttgaacagagcagaggaaacactgtctacacgaaaacacttaagcagcaggaaccataagtgtggaacacccatgtagtatgaacccatcctgcaactactgaatgccagtgttagaaagaaaactttcaatgacagcagaaactgatgcaccatcctagttatcatacagcagcataccaaagcagagataaagcaagtttctgatggtgatgtttaagtgttttcattgctaaacaatatattcaaattatctacttaacattttcacctgggtttctaatatgtatctcaaactcagtatgtccaaactggaacttttgatgttttctctacaagcatatccttcttctattctttaatatcacatggaatggcagcattacacaccaattggttgaacattcaagagtcatctttgaattatctgttctcttcactctcagaaggccagccatttgcaaatcctcttctgcttccaaaatgcatctgattttgttttactttctttgttgttactatcatatacggaaagtccccatggtctcacctagacctggaaatagtctcttctgattctattgagcactctacaaattggtcttcagccaatagccaaagcattttttataacctatgtgtcactgctatgcttaacttctcaaacttggaatgaaattttgactttttattgggctttacatagcctggaaattctggtcttcgtttactctcttatctcctttcccatgaagtaattttacatttactacttttctagtcacactgacatttcttaatctttaaatttgggaagctgtttgccaccaccaggcctttgcacatgctgtttgctaagcttggaatgcctttcctcaaaatggctctttggatagctaatttttcagttatctactcaaaagcttattcctcaaatggctgtactacaatgtctaacccaaaataggccctccctactgcagttcactatgccattttaacactcataatgttttcagtttttggaactattttacttatttatttttcaataatttcagaagccctggccttagaatgtaagagtcatgcaaccagagaccttgcttatattattcaccaatctatcttagaactttggaagaatacagagtctaatttagaaaagcttctgaaaatgtaattgaaaagaatgtttagtatcaatttatctttaagaaaagaaaatttaactcttctttttcagtcaaaagaatgtatctctatcaggggtctttggacaccagtgtgaatctcattagagccaaaaatttaccagaacataaatttagaacaactcataataaatatttatgaaattataattttggccatattattatcactcaccattatccagaacacaaatttcaaaattagcactcaatgatttcatttgaaataatcataagaaaattttgttattagtaatattgatagatataaaatatttacatacgacaagaaccaacactcccatattctatacataaaatgaaaagctttcttttttaaaaattctattctacttttatatatcagatggcttcaaaataattactaattttagaagcaatgagatgaatagatatgtaggatatgaaaatagatatgtaggatatgaaaaaaatattaatagaattgtgctcaccttggtagataactatggtattgaactacattgtaatacgtgtcctaaataaaagactaaaatagaaattatgcaaacattttgtttaatctattatagaatcactaaagaaaaattagctatttttacttagtaagtggaatattttaatgatctgaaagggaggatttttaaaactgaatatgctgttcttcataaaataagaaaatatgtttatatggaaatattttaattgaaatatcaaaattccatagaatatttacatcagttggtacacagcttctttcaaataaattttattaccctatcaagaaagcttttgagaattataatctaactttatttctttttattgtttttaattagttatatattttatttcatgggttagccagtttgaaacattaagtattgtgggttgaagtagaacatgacctgattttaaatattcccagctaaagttaaataaaatatgcatactttagataaagtttgaatattatgtttgtattgctttttacctaacttattgagtttgctgggtttttttaataaactttcaaaacaagggaaaatatcctatgatgtaggatagtacagaaaaatgttggaaatacagcccttaagtttagttttgtctggtattgatacatgacatggaataagtcaatttattcattagcattccaatttttatattagaaacattcataataaaaataatacacttaaagatgctaagttgatgaaaaagtaacatgggggtacttatattgcaatttttattttaaatgttcccttaggtactgtttctactttaattaaaactatttcataaatctaaagaagaagcttccctagcgatacctgtaaactccacattttcttatggcttcacttattttaaagtgctgaaagagccaaaattttattttttactctatagttagtttttaattaaaatattcaatgccacctactaaaaaaacccacacaatcaaatacagtaaaaagaagtatactggagataatatagacttcaacaaattaactataattattcttgattaatagctaacacatcacactatagctagcatggcaaaaggtaagtggtactataaccatctggaaattaacaaatttattcaataaattacataaagtaacattaatgttttattatacatagcagaaagcctactcatgattccccaaagacatttgtgatggttaaaaatctaaacagtttagaaactgacagtaaaaacgcatacaaatgttcatccctgtaggcatctcaaagcaatttggatgattttattttgtgtaagttagattatataacccaaaacatacattcccatcactgcatgaaacaaagcttattatactggtgctttgagacactaatctagcacctggaaaatggaaaagtaagaaaagatttgtctctggtacccttggccttcatttggaatgatcctttcacagtaccttgataacagctgccctgaaattgttgcatcttacttccctagtttacaatccactcattttccctcctatcttttatattgttctgcatttgatgcagaacaataaatgctggcacatgaatcagatacaaattttccatgctaatattttcacaaactacttattaactaaaaggaaactactatttaaaacatatttaaaattgacatatttcttcataaatttgaaaagtggcttaaatgttgaaaaagatctgaggttatggttgtatgtaagatgcagatgtcatttgctaattagcttaagtttcagaactatgaatcactttaaagatatcagctatttctaagaaagtttgatctattgggaacaaagaaaggaagacagagatttagagaaggttctgctacttttgcttctgggtgttcattggaaacagccctgggaattttccgtttaaactgcaggaggaaaaataagcagccagagagttagcagaagatataggcaagggtaattttttttcttttaatatgatatgcaaattaattagaagcaattaacctagcagtaggactgaagactttagggccttgttttatttttatttatttattttttttttattatactctaagttttagggtacatgtgcacattgtgcaggttagttacatatgtatacatgtgccatgctggtgcgctgcacccactaatgtgtcatctagcattaggtatatctcccaatgctatcctctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatctgggttggttccaagtctttgctattgtgaatagtgtagggccttgttttaatgtcaaggtttatgtggaactgaggagctgtgggtccttagaactatataccataaacctgaggttacttcactggcaacaaaacacaattaactatagacacaaatatagtaatacttctcctttatatttgttgcttatttaaaatttttgcttttaagctatggtattcatgtatttaataagacatactctattttacaaaaaatattaagttcatattatgcatttggattttctttaaaaaaggtagccaaaaaagcaaaggggttgtctcaaaagatattgcagaagctgtgcatgtttctacacagcaccagccaaaactcagttaaaaaattggagaaaagcataactctctaccctgcatcgcaaatcagctgaggtttaggaaatgttaaatgaaatgtctccatctgctatatcaagaagaataacaatacctgtaattgccaacaccaataatacccttgaaaaatagtctttacatatcatctctatttcttttctatacaattatcttctcaatgtgatctgactttaagtagctgcactctattgagataagtcagattactaatctcacaaaccccctggagattttttgtcatccttcttagcttctcagagcagctggaacatacccacctcttgtcttttctgtggggccataaccctgttatctctttccactccttctcagatcttttaaggtcccatatttctctgatctattgtgttgtttggaattgcatgcacatcactcttgtgttttggaaggtatgcagtccctgaaaattgtagctacacattatagggttctgctatataggaaaagaacatcagctttagtatcaaatagactttactagggtttcagaggaattattgtccacatgaatactagattcatccaagagtttaattataattcagagtagatatgtgagtcaggaagttaagctcctatgaggaactaggagcctggcctgaataactgagtaaaggaaaggcattatgaggctgagagaaaacaaaaacaaataaacaaaatggcctgatgttttcatgtgtttttgaattgattagtaaaaggtatacatggaattcactgttcacatatttcaaatagacttttgtcattaaactgttttgatttacagatggtttaggtacccatatatttttgatacttgattgctataactctagaatttatatccctagaattatatgcatattttaaggtagaagcatttttatttaatgttgttgggatacaaatcataggttaataaaaaaaaagttaaagcaggatatcaaaaattctgtaaaggaataaatacataacttaaatattgtattttatcttaagatgtgtagatgcatagcccattcactaatcttatgatatagactcaagaacttttctttaaacatctaataattgtaattatttcattatgtcttctttgtacataattcatgatacatagtttcttatcattccaagttgaaaaaacttgagtaaaaattagagacaccagttaagcaatcttagtttgaaaactcttaatttgtctattgttaattctattacttttctattattttctacttttaattattttatattaatggcttcctatttttaaagatatcttgtccacacctaattcaggcaaatttttagtaactcatccttaagttttctctaagcattcaaattggtttttgtacaaaaaaagttcattgtttatttattgacatttcatcaagttacatatatacacactaaaagtatcccaataagcctaagaagtttgtactaaatacaattgattctaaataagcatgaatatgaactgctcggaacaaaattattcagacaatatatgtggtagtctgctaaacaaaatagcttattgcactatagaaacagttcagtatattttatcaaagaaatgaaacgtatttgttagtccagttggttgattaaatagaggattgatgaaaagcaccttgtattttgtctgattatttccacaactgaaattgttggtttctacaataattactaatatataaatgtgtaatgaagcagtaggtattaaaaagcagttgaataggcctattactactgcttatttccaattcttccctgtatcatgaaaatgaaaaggctggtcaaatgaaccatatcattaaaatattacatatttactttatattcaaatgctcccttttgtttgacaaaaatctaggtgtaactgttgaggaaaagccagacacatttgtattgtctctttctaagctgcatattatattgagccattatttaagctatttaatagtatgtatggtataacctatggtctggaaatttgttttgcaaagctatatatatattatcatttaattaatctgaaaatacacaaaagtattttccgcttttataggtgacttacatatgtaaatataaaaggagttatgctttattatataatattgattactgattatagttttgttaaaggctaacttataagtaagagttaatttgcatcatattttgactgtttacatacacattttttaaatgtttccagaaagaaaaaaaaaattcaaatgtttcaatcacattccctacaaatattttacatttgaagttttccttcattttactggtaaagcatccagctagaaaaataaaaagtaaaaaaaaaaagcaaaacaaaactttaccattcacagtgatagaattgagattagaattcaggttacctgatgccttttaagtttgcattacagtaacagaacatttttctctctttcatagtactttctatttaactaatattgtcattgctgtgtcaagttatttatccaaaggtatcctcacttcatggatatttatttagaaactgtattgatttaaaacagatactacattttatactaaaaatagcatgcacaatctttaatatctactttaattactgcattttcagatttatatttaatttgctaatgaaatagtgacaagattcatgtcaagcatgctacttatacacttgatttcctttgaaaattaaaactctgacctgaaaataagcacactgttcagggataccatcttgttagtttagttgttagttacccgctgttcttaataaatcagtctgcaaactactgatccatgttactgcatttttacctctctatttgttggaaacatgtgcctacaaaccaaacataactctatttagtttgtcaaattgaagatatcctatctacttcaggtgtaagttatgtttacagatatttaaagcaaaataaatatcagtaaatgtaatatcagaattatgattttcaaatcataattcacaatgaattcaaatatttttaatatcagcaaatagatgatagtaataggtgatacagtattattaagttttataatacaataaaattcctttaatatattaaaaggactataataaatagtaaggtctaagcaatgaattttaggaaaaccttttagtatattaataatagtcctttaataatatattaaaggactcgcctaaaattcattgcttaaactatactatttattatagttacaatgacagaaacttgcctaaaattcattgcttaaactatactatttattatagttacaatgacagaagcttattataatcagtatattttaaaatcatttcagtggttttacatgaaccatttgctttgtgtttattctcaaacattgttgagcaccttaggtagtaaccttaagaaatccttgaattcacagattaaattaaaactgtatttatgaatacaattagtaagtacccatttggccccattttgtccatttcattaaaatatatagagagagatattgtcttttctatgtttaatatataacttatttaacatgttcacagagcaagcaaatcatgaggcaataagaaaaataaataaattatgcaaaacttggggttttttaaaaggactttttaaattaattcatttatttaagatctacttcactctccaaatgtatttgacactcttaacaaaaacgaaaataatacagcaggataaaactaagctattgaggaaattagtaaaggataattaataggagaataagataaggccacccagtggtgagctatagccaacaggtagcttgagagagctgattctgttcatttctttgtaactccatgttcagtgatagcaggttagtagcttggttgatcataaaattaaacatgccacaaataacaaattacggctttttcttttcttttcttttatttattttggaagacagggcttagcagtacatcactgaagccattctgtctctgaaaatatctcctagaagatatcctgaatcaactccattatattgacaaaagattgctgaatatgacaaaaatatgtgtcacagattagcaccaagataaatttagcttgaatacttttaaagaaaaacaattgatacttttaataagtatgcatggaacaattaaattatgtggtgttctgttgtatctacaaaaatagtgaaaatatacagctatatagttgacaatattgttggtaatctggagttataaatgagctaattaggtataaatgtatatcaaatacagtgctttgggcttgcttggattgtactaacctatattattttgcaataaataagtaactgaataaattgtttgttgatttcagccttaggttgtgacaaaaaaatacaaaacaaaatattagtttagagaagacgtaccttgctattttaagttctaagtacatgaaagttataagtacatgaaaaagctgtttcagatgattaaagtccaaataagaggcaaggcatggggaataaaacagcctcatgtttttgtttgtttgtttgtttttcagacggagtctcgctctgtcgcccaggatggagtgcagtggcgcgatctcggttcactgccagctccgcctcctgggttcacgccattctcctgcctcagcctcccgagtagctgggactacaggtgcccaccaccacgcctggctaattttttttgtatttttagtagagacagggtttcaccatgttagccaagatggtctcgatctcctgacttcgtgatccgcccgcctcgtgctcccgaagtgctgggattacaggcgtgagccaccgtgcctggcaaaaacagcctcatgttttaaaaaattatctggtctttatcatatgtcattccttcagaccctccattatgatgtcagtgaaggttatgggcatcacagcattagtagctgaagttattaattaggttcacaaaacttcaagtcaatagtttttatatcacatgtagaatgtacatgatatattagtattggtatcttttaatgaaggtgtatgttctacagtatacaaatacattacagttatattttatattatttattatattgctccatattatataccatattgggtatgtaaatatgaatgctttatacagtgataaataaacaaatggcaatgcatgctctgctcaatttttttttttctgagaggtgtgcacaataaaaaagtttggaaacccttattcttgctcttgtctcaaggtcaaagacccaagaaaaagaaaaaaaaaaaaaagaaagaaaaagaaaggacaaaaaagcgagacaaattgtttggtatattgtgctatagattagtaggttaattattaatgataaaataggtctaaatttgtacagtatattgttctgaggactttagaactctaacgtagagcacaaagagaaaaagtgtttttgaatattaggtggaggcttcatctgtagtttgttatggagtatgaagaggagagggtgaggtatggaagtagaggacttcagttaaaaaaaaagaaagagaagaaaacaaatgatgagaatgattagatcgactacctctaaatgatgaataattctaaagatttgtttcaccaatcagtaagtgaaaattttagttagcataagagaattcttttcagtggcttttaatttctgccttttaaattaactgtgtcccagattccagctctcaatacatcagagaaaaatatacagtatacctcatttgggctagtattcctgctataaatctgaaaaaacaagcttctcaaatatcaatcatgcatatcataaagggggataaatcagaatctggtctcatttatgactctaatttacaaagcaaatttatagtataagaaaaagatctgttagcaaaagttctctaacatcatggactatctctagagaaagtagagctagaaaaaaaacagatatcattggttaaaattctcatataggatgggactaagaaaatattgctttgtaagtctaatatgctattccataatacattagatcaggagtagggtgggaatgatgccattttgtttatttctaaaggaagaaaacagcctaatttggattaagtaatattaagaactaaaacctgaagaatcatttttagagcctcctggtaattcaagattgatatttgctcccttttgaaatgacaagtgaagaaaaagagaattccaatattttttgtcttctttttctctgaaaatttccttgggaaaacaagggctatggaaaatggtgaaatggaaattttaaattcccttttatacttacattctactaagatccagacttcctcttttctttgtaaattgtccagtctcagttctttatagcaatgtgagaatggactaatacagtacatactacagtgcaagaatcgaagttagtgtaagcaaaaaaattactgattccattacaaacttcttagacatatgaaatgtcttcagactattcataattatcaatcctactgagagcagactagtacggaatggactgaaattgcagcatagatatttaggatccattcatgaatgcctcagtccttaagctttgtgaagttctaaaatttatatagtgtaaagcttgaaatattaggttggtgcaaaaattattacaattttgccattgaacacaatagcaaaaactgcaataacttttgtaccaacttaatatgtcaagtatgccttaattgaatgcattcttagcacaggttcagacaaattggacactaaaatatttataagttgacggaaaattttacagcagaaagtaacactcaaaaatagtgacttattttgttttttccaatatattaaaaatacttctcatatgttttttatttcttataagttcagcaccaagaaaagagtgctagcagtggttaatgcatggtgtgcttagggtatgaatgagttaatatcgctctttaacttgaagataataaatggtctgagcaactctcccatagcattatcctaaaatcaccagggcaacattctgcttcagtggtttaaatgtgccctggtggtttgaaacataattgcactgctctggacacctaattgactacaagggactgacttaggtactttgaataaaatttcattactttaattattgttcagtgaggtgttccaatgttttaaaacaaactgttcatgtgaaattttgtttctgtggaaaaatgctgtataaaaagagttctgtataaaataccaacttttgagtgaagttaataatttcatgtgcatttttagtataataatctttagtcataaagcatatttagtgaatactactgtgaattctcgatgacaaacagccaaatgtcaaaaagcaaaatatttggacaattgaaaataaggaaaataataacagctaaaacgtactgggaccataatgagcttttcatcatgtaaccttatattccaatgagatggacattaatatgctaattttagagactcctgcacaagagaaatgttgctgtgattggtcagatccagagccatttattggaacatttctctatgatgggcagagtaactatgatttaaagtctccaaaccagttttcatatctttcctatctattcttttgtggtaaacacacctagcccttaggactgtgccaacaatcatctttgtgtacctggttagaaatgtcaactggcaaccttctccacaacagcaattttacactacggaagtacaaattaagaggtcctattagatgaccagaactaagccttctgtaccagaaaagctccctattatacctaaaagcaacctggtctttctcaattgttaataaatagcataatttattttctatttgactgttgatgttcttgctattttttcttctatttgtgttgatgttcttgctatttttttcttttatttcactgttgatgttcttgctattttttcttctatttgactgttgatgctcttgctggttttatggctgggaaatgaaaaaattctagcgagacaaattcatctgcaaatcttaacagctatgatgtgagtctcactatttaattctgtataaggataaacaggtaaggaaacagttactagggagttaagcaacttaaccaaggtttcaagtgaacaaaaacaaaccaaaaaaaaaggaggattagagacgacaaacgattttctgatatatatgaacttcttacctccctgccaaaaaaaaccacacaaatgttattaagttccctaatttgcttcaaagtgggctttaattttgtactatagaataggctattttaaacttggcacacacaacgctgcctagtagattagactataaatatatgcccactccattctatagaaatccttctacagtgaaggaaacaaacacagcagaacatagcaaatttctgggttccactgtctgcaagtttggaacaacatgtcttctctttcagtgcccactaaattctggtgctatctgtctgattagtgttatagttatatagtaatatgggattataactaaaaataccctatttattttaaattccatgaatgtaaacttggatagataatttaaagtaatttaaacactttttaactgttagaattctgtttgaattcagtgaacaaaaatctgacttacagtggccctaatgaatagatatttattgatcttacatagcaagatgtccagatgtgggcagtaatgggatggtataattgctcaaagtgccttagaagaaagatttcatgagtacttcttactttccaatactccttcccttccagggcacattgaaaactgcaatttctcgccctcttgcagttaggcaggttcatgtaactagttcaagacaacagagtacgggtagaagacatgccactttcaagttaaggcagtgaaaagcccctttatgactgtcttgctgtatccacctgcttcccttagaagccatgttctgtaactgcacagacaaaatagcaacagtctaggtgcctgggtcactacttaaaaggcagttgcccaagagaggagccaacactgcaactcactttgtctaactgagaaacacacctttgtttactaagccactgagatgctggagttaatttgtttcactccattccctagaccctgactgactgatgcatgatgatggctttcattatcattcttgcagtaagataattgttacacttctagccacatttagcactttttaggcagaaaggtaggggagaaggtggaggagaaatagccaaaggaatttctaccacgtatgctttttaaaaatttatctccaagagggcaaaatcagtgacttgtacataaattccacaggccataactctttcatatggtcattgttgctgcatgggagtgtttaaaggtaaatatatttaactgaatactattccacctctaaaaaatcatttgttagtaaaaaggatgagaaaattggtggcattaagtagtacatcaatagtgtctgccataatcctggtagaatttttctcacatagtcactgcttttgtgtggggggagggggtgaaaatacttaagatctatcatcttagcaaattgtagtgaatatacagtacagtattgttagtcatcattaccatgctgaacattagatttccagaacatattcatcttgcataaatgaaactttgtactctttgaccaacaactcccaattttttccacctctgaaccccggcaaccaccattctaccctgtacttctatgagttcaactagtttagattccaaatataagtgagaccatgctgtatttgtctttctgtgtctagcttatttcacttagcataatgtactccagattcacccatgaatagtgatgcaatgaacaagggagtataggtatctctttaacatttcattttatttcctgtggatatacactcagatgtgagattgctggatcatatagtaattctacttacaattttttgaggaacctccatactatttaccataaagagcataccaatttacatttccaccaacacttacaagaatgccccttttgtccacatcctggccaatactaatcttttgtcctttatctaatagccattctaacagatgtgaggtcatatcttattgtggttttgacttgcatttccctggtgagtagtgatgtcgagtgccttttcctaaacttcttgatcattggtatgtcctcacttgggaaatatctgttcaagcgttttgcccatttaaaaaaaaatcacttatttgtttttgttttagttttgctactgagttttgaaagtttcttatatattttggatagtaaccctttgccagacatatggcttgaaatatttctcctcgttctgcagcagggagtttcattttattgattattctctttgaggtgcagaaacttcagtttggtatagtcccaattgtttatttttgcctgtgctttcagtgtcatagccaaaaaaatcattgcacatatcgaagtcaagaagctctctatgttttcttctagtagttttatggtttcaggtcttagaggtaagtctttaatacattttgagttgatatttgcatatggtgtgagataaggatccaatttcattcttcttcgtgtagatacatttttttatatcacttgttgaagagatatttctttccccattgtgtgttcttggcaaccttgtcaaagatcagttgaatgatgatttgtaaattgattttcttgtctatctattctgttccattgtctgtttttatggtagttatattattttgattactggatatttgtaatatattttgcaattagaaagcttgatgcctccagttttgttcttcttgttcaaattgctttcaaactaattctttgaagtggagtctttcagggatccatatcaattttatgaatttttttccatgtctgtaataaaatttgttagattttaatagggtttgaattgaatctttagatcactttgggtattatgggcatttaaaaaatatttgctgtttcaattcatgaactcaggagatcttttcatttatctgtgtcttctttaatgtccttcataaacataattttagtgtacaaatatttaacctccttggttaagtttattcttaaatattttattattttattgctattgtaaaggagatttttaaaaatttccttatcatatggtttgttgtttcaatataaaaatgtaactaatttttgcatgttgattttgtattctgcaactttactgaatttgttttttcattctaacagataattttggtgagaacttagggttttctatgtatataatcatatcatctaaagcattaattttacttcttcttatttagatgttttcttttttttccttatctaattgctctgtcaaggacttccagtactttgtgggacaggagtagtgctagtgggcatccttgtataagatcttagaggaaaagttcactgtgtttttttcatttcccccattgattatgatgttagctgtgggtctttcatatatggtctttattttgctgaggtaaatttcttctatatctgttttgtttagatattttaaattacgaatggatgcccactaattttctttgatctcatctactactacagcatcaattataatttccaacagttattctcagtctcgcttgaattctaaatatcttctaccaacaatttcccttttggtaatctttcagtaagtgtgtactcaaataatcattttttatatccaattccaccttttcctatactcttcatttcatttaaaatcaggaaatttcaagacatgcccagtttctccatgttctttatcctgtcttacttctagctgatgagcaaatttcaaaggcttttcagtaaatcaaatttaaatcattctgttggtctttaacctgggtacaacttaattgattcttgttcttatcatcacccacgaacactaaattttcaagcttctgtgctggcattcttgcacacattcactccatccttactcaacaataacaatgattcttacaactctaagtctgactttgttactgatctatttcaaatcattattcatacccccaaggaaaaaaaccttcagaaaaaaaaatgcattactaaatatatcaaattcattataatcaggaaatctctcccgaattttcctttttatgaaccaaagaacatgcacatttatccatatgaaatttctttgcaatactctttgagatactatttgagattcaacatactatttcatcttttagagattttacaatttattttttctattgggagacactttttcatggagctgactcgtttctgcacacctggtaagtcaatacagtgacttttttttccgactatctttttaaggattttttaaaattacaaacagttttgaaatatggagttcgtaaattctttgataaaaagagtaggtttccttatatccttggggaagagagacagtgattcagtctagaggaatgaacaagtaattcttactgctcactagaactcatggtttcctataaggcaaccccctgcacatgtaggtgtaacctggtcctcttcataacaccctgtggaaaatgggataagagaatgtaataaaaacttgaagctcatccagcttgctgtgccatgattagtaaaatcctgtgtttctgactacaatgtgtctcatgctttctcctgaatatttgaaaatgtagcagcctaacttgttagtggataagtaggatacaaaagtgacctctcacaattcttttttttttcagtaaaaatatagaaaattttaatgacaatagtttaacataatgggcatatataggacctttcacaattcttgacagcattcgccttcggaaatgttgcctaattttagtccctatgttccccagtcttgtcatcctaattaattacaggctttgctctaaaatttagctgaaatatatgtcctcttcgaagactgtcttaaatccttgaaacagtcttgtcctcctatactgatccaagtatattgcgtacatgtctctctgaatctctcatgaaatttctaatttacacttaacctttctgccaaattgtgactttattgctaaatattatccttgtttttgacagtagcttctatgtagcaagcactagatgactctttaagaaattatttgtagaatattatcttaaatgtgcagtctccaaaataagacttaaagcacacacagagacacacacacacacacacacacacgccaccttgctttctgttgatctgtcatcacatatctctttcctacatgaaccaaacttcattctcactgtttctctaaaattgtaatgcattattaattccatcttcttaagcaagttgcctgtaattataattgtctttctaaaaaagaaaatgcaacagctgcacctactctgaaaatggatccttggagaatgtaattaagttatttcaatttggaaactgaatattatcaagagctatgggatgtataaccttaagacagacctttctaccaggtttttaaatagtatgtcatttgcagaaacctagataactaggaaattagaatgtaaattttttgcatactccaatcagaggcttagtcaatggaattatgtatcatataatcttacttgctatagttagttagaatatttgctagaccacagagcaaagaaggctagagccatgtgtttactacctttgtgacactctttatagctttatttactttattttatgaccatgaagtttccctataacccacaacagatattgcacaactgtgtttcttaagtcacaaacttaatctcaaaagaaacccattatacatttgtaccctctccagtaaggttaatttcaagggcataaactgttttctacagtttatggcttcatacataaaaacagaattattttataatggaaaactatcttccaggagaataaaaaataaacattatgtcgtatccagacaattcaaaaagtatgttaaatattgcatttaaacatttagtaaaacttattaattataatttatgataattttttgtaggcttttgataaggacctacattttcatggctaaaatgatcaatatatggctaaatggttggtgctgtattatgcactgtttctaagcaaaatgtagcccaagtgaattttatttaattgacataccacttaatgttaataacacttgggtaatactgaagatattgctaataaaaatagaaatctcgtattaaaaacaaattttaataatcatatagaacaattgccattgacatcgtgaatcccatattgccaataatacaattttctctgtataagtcttttcaaagaaaggatcttattacctcagaagaaatcatttatttggggggaaagcattaatcatattaaatgtctgctaatcttagtcaaattctctcctcttataatttataactattggccttaattttttcatctattcaaacaagctaagtatgatccttcttacattacctatactttcaacatctgaaaagatctcatataaccatcctaaatgttaaacttttgatgctgaagatcactatgaaatagcttcaatatctatatatgcagtcagaattgtcaggcttaatgaggccttggctaattcatttctcatcaacatagaaacataggcttgcatatttgaaagagtcttattgaagattaagggtgatgaaatatgcctatattattcagggtaactattctgtctcaacctatttaaatgttatccaatattattagaacacttcagactgataaatgttgatattgacccttataggaaagcaaataatagatgaaaaaaaatttgtaaagtatgctactgttataaataataatatacttaaagaatgcaccagtgatatcctgcaaagataaaaatattctattggcaacataaaagctgaatatgcttgtaaattattccacttagtcaaagataatttaatagactaggtgatttaaaaaattcaatcaagcagtcacaatttctctcgtatcttcaactattgtattcctactgagtagtttcactaaaagttatctttgaaatggaatttaaggaaaacaagacacaacaaaagttattagtttatgaaatgaactgtaaattcatggaactttttatttgtgatatggaaataagagcatcggaataaaaactggtccaattagaattcaggatactctaatggatactagatagatagcaaagtatctacacagatatatagattaagaatttgcatagacacaattatccttttgaagttgatagcttgtcattacacttgttcataatacatcttttgctgccactgtcaagggcaaatttgtgaactgatcataacattggtctaatcccttataatttatattctgaatgaacttaaataataaattaaagaaagagggtaatgccataatacccagaacagcaacattaaaaagtccttcagttagaggcagtttacaatcataaaatacaaacttttatttgattaaatctatagtagtacaagaaaaatgtgattaatgtaaaacccagaaatattaaatctcttaattaagattacccagtaatttagacatagagctatcacattatacatattagaatgctttttcttcataaaaacatgacatttttaatataacctttttataaataaaagtaaagcaaattttagctcattaaagcatatcctcaggtacaagggtaaaatggattccaaatagaaggatggcaaaagaactataaaactatggttacaataatgtaggcaatattttattgtatggtaaagtcaaggtaaacaatttataactataatgtcactggaagcacaaagatactaaacttttaaaaattcaagtaataattcatcatattatttatcacaagatggtttgaaaacactgttatactattcctgaagtgacattatagagatggagaaggttgccaggtattagggagacaaaaggaagagaagtggctgtggctatagaagggtaatatgagggatcattgtgatggacttgttctgttttgagcatggtggtggttacaagtccacaagtgtgataaaattacacagaattaaatatatatacacatacacacgagtgcatataaaactggtgaaatctgaataattttgatggattctataaatttcctgactgtgatatcatactatagttattcaaaaagttactattaggaaaactgtcaggaaaggcttaccggatctctggatgatttcttccaactaaatgtaatcttaaattacctcaaaataaaagataaaatgtaaaaacactctaaaaagttactaaaagcaaaaaaaaaataaaattaaagtttaaaaacagttataaaaaaaccattatgctagcaaatttatataaaaagctctaagaatgtcagtggctcacgcctgtaatcccagcactttgggaggccgaaacgggtggatcacctgaagttaggagttccagacaagcctgatcaacatggcgaaaccccatctctactaaaaatacaaagattagccgggtgtggtggcatgcacctgtaatcccagctactagcaggggctgagacaggagaatcgcttgaacctgggaggcagaggttgcagtgagccgagatcgcatcactggactccagcctgggtgacagagcaagactcttgtctcaaaacaaaaacaaaaacaaaactctaagatacacttccaattgaaggaagctaacattcaaggtttaaaataggagcataattgatctcaaaattatatggctttttaaggaagaggattatttctaatgaaacagtatgaaaatgaaacattaattggtttatacagcatgtttaaagaaaataagtagattgctttgatcccagtcaagtgatcttatagtataggaaaattaaatcaaattaaattttagaaattaaatgtaaacaaaagcatgaaaagacatttctttacttatcaataataactcaatgagttaaaaactatctattcacatgagtatacccagggcaagggaagaacatcctggcaaaatcaggctaaacaacaaattatattcaatgctggcataagatgccatttacagtcacacaggctgtgtactgtacaacactcaggaatgtcatttatgcagactatcatattattggacactcctgaaattgtacattgtgtcacctgcacagctgtactgagtggttctggggaataggagatatgctatttatttatttattatttaattttgcttatgctactgagatcccgttaagacaaattagagatcaaacagaaagattaaatgttttcttatggcatacaaaatgatgaacacccaatgtcatgtatgccacttccattgggaaaataacttcaatttagtaaattaaacatgaaacacgttctatgctctaaaatactgttacattaaaggaaattagaagctgatcaaatgaaagctcagactacctctcaataaaatacatgaacataaaatttcaattgtatcatgactttatttggacttatcttagtcattttgctcttacataaatttggggggtttaatagggtcacatcttctggttaatttttgaacacccacatgagcttttaatgaaggtagaaatcttcagtataaagtccatttattttcctccttgaggaaaattagtttgaaaatattgccagttacctaaaggaactgcatcattttcatattctattcacagagtaatagctgcacagagtcctcctaagaatcccatctgcatgtaaatgccgcagaaagcagtcctcacaaaataccttcaaagctagacaattacatttagagaacgcagccagggctcctggagcaaagtatactgggaaggttagagtcctagttaatatgtacctgataatttatgaaacattcaagattattgaagcaacacctgtttaaaaaaaagatgtttgcttcacagacagaatatgttttctctttgagcaaagattattattataagatttaagcaaccctgacccagaaaaaatatatttgaatacattcttttgccattcaccttttaaagagtaattattatctctaattatcctaacttactcttctaaataaaatagtaaaatcgagcagatgattgagatagtataatcaatttgggatttctcagaataaatgtcattgttcaatacataatggtagaaaaatgtagatggaaaatacattcctagcaaattctaagattggcaaattaaagattcttatcttaatacaaaatctacattaatacttctaccaaagatattcttatttcccaaatgaacttgctggcaatagtgagacaatgactggaacaattttccctagtatcacactttgatttttttttcaactcagcttcattacattttatcttcctaagtaaagagaatattatatatagctgctatcaaaatttaacaaagactgcatctgaggttgcatcatgagtttcagggatttggtgaccttattagagaaaaatgaagactttttgagtgctaggactgaaacctcagtcttcttgtagaaacttagatcaggacaaatcatgtagacatgatacagataaggaaaggcacactagaagaacaaaacctaaatctttgactgttgaagttaaaattcagaaatgtttttttcgtttgatgctatatttttggagttctttgagaagtcacagaaaccagtgcttctgtgttcagttataatattctgacttcttgattacttgaaataagacattcctgtttaagtgcactgttgcaataaaatacgcaaagtcatataagcaagatgttaaagtcgttttcaacttataatacatagccttggtatttttaaatgtttgtttgtttgtttgtttttctctccacatttctccacttctaagttgagatgctctttttctgaacttgcatggcaccttctgcctcagtttttggaattttcactcatctctctcttaggggaaggacagaggattgtttgtttgtttgtttgtttttatttagccgttaacatgttctctggaacatatactgagtgatgtttgatgagtagatggttttcagcacttcttaaataaaacaaaacactttgtcaatccactcaactatacacatgggaagactgcactaaaatcccatgacaggtaagtaattaaattattttacatctctctttcttaattgagtaatgtccataaaaacaatttttatgcttttcactacttgaaagtggcattaatataaactacaccttgtggatgtaactactgaagctatgaattcaataattatttcaattcataaatattcattatgagcctaccacagacgaagcactatgctaggcacagaaaattgacatataatgaataattttatttgcctttgaggagttatctatctaacagaggagatagacaaaaatatctccctaatgcaatatgatgagtacaataatagaggtgtgtgcaaaatataatggaaacccaaataaggaagtcattcatttttcaggcacaataagattttctactactatgaatattttcattacaaaaagcacagagtcagtgaaaaattacgtttgttcatgaagtttacagaaggcttatttccctaggtgtagtttctaaccagagaaaccaaatttgactgaaataaataatgcagaccatatgaatgtatttccttcagttctacttaagtaagattcaacacaataaaaactcacgatatttttacattctcgatatcagctattttcatgtatgccattattcctgttattttgaagcaatgaaagacaaaatgagcaaaaactgctatatcttctagttctctgttagatagaattggaaatttaaattttatttctcccaaatcatcttccatatctaatatgaaaacatagtaacaacatcatattttaattttatattgttcttctttgaatacttggaaaaataatgtacaggatattaaaaagtttagctattaccttaaatgtactgtgaaaatgtaagaaattactgcaaattttattaattaggctcctaaagatgccataacaaaatatcacaaattgggtggctttaaataatagaattttattttttcatgtttccggataccataatctcaaaatcaaggtttctacagatccatgttcactgtgaagcctctgtagaataaactttcttggctcttcctagcttctggtggtagttgacaaattctcagtgttccttggcttggaggtgtgtcatttcaatctctaccagaatcatcaaatggttttcacccctgtgtctttgttgggactcccccactgctggaaaaaggtaagcagaagatcctcagcagtccacattcccacaatatacacctgcagtactagctagaggaaagccccctcagcaccccgataccctgagtatagggagttacctggagtctcttgtgactgcgttgttccagagagttcacgctgggtctctcccgccttctaggacccaagctgctacagcatggtatcattttgagagcagagccaccatcacactacatcttgccctggggcttgatactccccgcatctcaaaaatccctgggactctgcagatttctccccaaaccaatccaaatggttgcagcaacatgtcacaagcttgacccagcagtatagctgtaacctagcacctcagaccacatagtacccctatacctctaggaaattaggcagctgagcacaacagggtggctcacctccagataatatgaggcaaagcaaaaactccccagatcctgagagccacgtacccggacctgcagctgccagcaagaacatcaattcctctagcagggaagccactatgcatccatgcatgccctctggggatctgagaactggcccacctggacaatcactcccaccctgaccatcactatgtgccactcaccatcccaaggactagcctgctggggcccactgcaagcaccactgatgcccttgtgttctgccaggggcccaaggactgctctacctaggacctgttgctactgcatgccaaacccaccctcttcagcaatggggcagctgtgcctttgcctgctacccaggagtgtgaggatagacccacctggggcccatcacccccactgctggtcctgtgcatacccccgatcagcttgtccactgtccctgttcccagcaaagctgcatccagtctccacaaataaatgcattctaacctactcaggaactcacagatatcactgaaattgattacagctaagtaaatcatacaaagattatacaactgtgcccaatcagaaccaaaaccaaagcactctgtccaacagatactatagataaatctacagaaaaaaaactttgccctataaatctactccacaaaattggaagaagtgtgtacaccaggtacacagatatcaatatagggtcataagaaacatgagaaaaacaaaaaaggaaatttgacacctccaaagaaaaggaaatctataaaattcatgaaaaggaaatcaaaataataattttaaggaaactcagtgagaagcaagaaaacacagacaatttttaaaaatcaggaaaacaattcttaatctgaatgagaaattcaacagagatatcatgtaaaggaacaaaacagatatcctatagttgagaaatacaatgaataaaattaaaaaatacaattgagtgtcaacaatagattagatcaagcaggagaaaaaatttctgaacttaaagacaagtcttttgaaataacacactcagacaaaaaaaattacaagaaaatgaataaagcctacatgatatatgagacactattaagcaaacaaatattcaccttttgggagttctagaagaagatacgggagaaggcacagaaaatctatttaatgaaataatagctgaaaacgtcccatgtcttaggagagaactagacatccagatctaggaagcagatagatccccaaactgattaaagtgatagattttggcagtttgaatacaatgtgccttgaagaggaccacagaaatgaaatatttctcttcaaggcacactatattgaaactgccaaaatcaaagacaaagagagaattctaaaacagcaagagaaaaatgtcaagtcacatataagggaatgctcattagactaatagatttctcagcaggaaccttataagccgggagagaatgagatgatatattcaaagtgctgaaaataataataaaaaagctgtaagaaaactacctagcaaagctaggtagcttaagttcttaagctatgcttaagaaatgaagaagaaatatggtctttcccaagcaagcagaaactcaggaaattcatcacccctataatggtcttacaataaatgtgtaagggagtcttatatctggaagtaaggtacaatatctaccatcatgaaaacaaacaaaagtatacaactcactggtataaaagatatacaaatgagaaaaaatataaatagtaagagaggaagaaacaaataatatacaaaacaataagaaaacaacaaaataacaagagtagatctcacctatctacaactttggatgtaaacaatttaaaattttcaattgaaaggtagagggaggatcacttgagcccaggagttcaaggtcagcctgtgcaatgtggtcagactctgtctctataaaacatttaaaaattagctgggtggcatggtggaatgtgcctgtagccccagttactcagaaggctgatacaggagaatcacttgaggcaagaagttgaggtggcagtgagctatgtttgtgcctttgccctccagtctggacaacagagcaagatctttccttgaaaaaaataataataaaggaaaattttaaaaataaaatgatatagactggctaacgaataaaaaacaagacacaagtatatgtagcctagaaaactcttttctcttataaagtcacacaaagatttaaaatgaaggaattcgccaaggaaaggaaataaaaggcatccaaattacaaaagagaaagccaaattatccttgtttgcagatgtcatgatcttatatctagagaaatgtagactctaccaaatgcttttaaaactgataaaaaaattagtaaagtttcaggatacaaaaaccaacctacaaaaatcagcagtatttctattcactaatagcaaactagttaaaaataagtcaagaaagaaatcccatttgtaataggcgcaaaaaaataaaataattaggaagaaatttaaccaattaggtgaaagatctctacaataaaaactaaaatgtattgataaagaaattgaagatgacataaacaaatggaaaggtatcccatgctcatggattggaaaaattaaacatgctaaaatgaccatacaacctgaaggaatatacagattcaatggaatctctatcaaaataccaatgacattctaaatataaaaaatataaaaaaattctaaaatttgaatggaaccaaaaaaaaaaaaaaaacccatgaatatccaaagcaatactaagaaaaaagaaaaaaatccatggacatcacactacctgttttcaaaatatagtacaaaactatagtaagtaaaccagcatggcattggtatgaaagcagatacgtagatcaataaaacataatagagaacctgaaaatagatacacatatttacagccaactgatttttgacaaagatgtcaaaaacatacactggggacagaaccccctcttcaataaatagtattaagaaaattggatattcatatgcagaagaatataattagacccatatctctctctatttaaaaaaaagatcaatttaaaatggattaaagacttaaatgtgtaagaccagaaactataaaactactagaagaatgcatacgaaacacacttgaggacattggtctgtacaaatattttatgattacaaaataaacaaatgagactctattaaactaaagagctttggctagcaaaggaaacaatcaacagagtgaagagacaacctgcaaagtgggagaaaatattttaaaactatttatccacaaaggactaatattcagaatatacaaaaaattcaaacaactcagccaaaaaaaaaccacccacaaataattcagttaaaaggggggcaaagatctaaataggtgcttgagaaaaggaaagtcatacaattttggtgggaatgtaaatcactatagccattataaaaaacggtatgaagtttctcaaaaaactaaactaaaactaccatatgatccagcaatcccactattgaatagttatacaaaggaaattaaataagtatatcaaacagatatctgcatcttcatgtgtactgcagcactattcacagtaactaagatttggaatcaacctaaatgcccattgatgcatgagtggataaagaaaaggtggtatatatgcacaatggaatagtattcagccataaaaaagaatgaaatcctgtcattaatggcaacatgtatgaacctaaagaacattattttaagtgaaatgtcacccatggaaagttaaatactacattttctcacttatatgtgggagctaaaaaaaatggtgctcatagatgtagagtaattttatggttatcagaggctgagaagtgtaagaggagagtgctagagagaggttagttaatgaatatgaaattacatctacttcccagaaataaattctagtgttctagaacaatagaggatgaatatagttaacaataattcattgtgtctgttcaaaaagctagaagaaaggattttgaatgttcccaataaaaagagccaaccggctgggtgcagtggctcatgcctgtaatcccagcacttcgggaggccgaggcaggtggatcacgaggtcaggagatggaggccatactggctaacatggtgaaaccccatatctactaaaaataaacacacacacacaaaaattagccaggcgtgggtggcgggcgactgtagtcccagctactcgggaggctgaggcaggagaatggagtgtacctgggaggcggagcttgaagtgagccgagatcgcgccactgcactccagcctgggcaacaaagcgagactccgtcaaaaaaaaaaaaaaagagccaaccaaccagtacatcaaaaattcctgataacgccccatcctgtaatgttccatcaatcaatctatagaaatagagaataaattctaacactataaaccatgacgttttgtaatttatcattccaataggttataaattgaacctgtagaagtaggaagtcaccaataaatttgacttgtagaagtagaaagtgtgaaaaataacaattcttcataaacaatatgacagaggcaaaataaattcaaaatatattcaaaatatattattgggagcttttgacttgtgtaattctaatttattttgttaaatattaagaaaatatatcataaatatttgtaatatatcttgcatttcatcaggcatatctactgagtataacagtgctgagtttggctttacgtatgctaattaagaatatgagcatttgcaaaagacattgaaagaataggggtttatttttaaagtatgatattttattggtttttcttgagttatattctaatcctctttagcaaattggtactatgatctgtattttccttgaaaattgagttttcagtttaaatcagtgtcctattgaggacgttcattttctcaatcaaagatctttaataacttaaaaatttaatatatgtggctttacttctttgtgtgttttccaacaaggcaaagtgtaacctaggtgtcagctaagtcatctcttttaatatctgaatatgttttgttggaaccgcatcgcatagcaaatgaaagacacctgattctctctctctcacacttctgcaaattcctaggagtttatttttttaagagtcattttccactccaaatttctctttgactactcttgatctcactcatgtttcatttcctatggttgtttttgtctttctaaaggacccaccacaaaccacatacgtggaaagtggcatcttttttatgaatccaccaacttcttattcagaagattaacttgggtaggaagaatcaatatcgtgaaaatggccatattgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcatgctacctgacttcaaactacactacaaggctacagtaaccaaaacagcatggtactggtaacaaaacagagatatagatcaatggaacagaacagagccctcagaaataatgccgcatatctacaactatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaattttagacctaaaaccataaaaaccctagaagaaaacctaggcaataccattcaggacataggcatgtgcagggacttcatgtctaaaacaccaaaagcaatggcaacaaaagccaaaattgacaaatgggatctaattaaactaaagagcttctgcacagcaaataaaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggccaaggacatgaacagacacttctcaaaagaagacatttgtgcagccaaaaaacacatgaaaaaatgctcaccatcactggccatcagagaaatgcaaatcaaaaccacaatgagataccatctcacaccagttagaatggcaatcattaaaaagtcaggaaacaacaggttctggagaggatgtggagaaataggaacacttttacactgttggtgggactgtaaactagttcaaccattgtggaagtcagtgtggcaattcctcagggatctagaactggaaataccatttgacccagccatcccattactgggtatatacccaaaggactataaatcatgttgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaaggataagttcatgtcctttgtagggacatggatgaagctggaaatcatcattctcagtaaactatcccaaggacaaaaaacgaaacaccgcatgttctcactcataggtgggaattgaacaatgagaacacatggacacaagaaggggaacatcacactctggggactgctgtggggtggggggaggggggagggatagcattaggagatatacctaatgctaaatgactagttaatgggtgcagcacaccagtatggcacatgtatacatatgtaactaacctgcacactgtgcacatgtaccctaaaacttaaagtataataataaaaaaataaaataaataaagatgtatacaaacaattcctccagcaaactgggattaaggattacattctacaccagcaaagaatacacctgaatattgaacattaaacacatatttttcttcaaactttctgagtcatgactctgtcagagaatttctctttttttcgtgttctttcttttttttcttttggagatagggtcttgctatgtagcccaggctggagtaccatggcagtgaaccatggactaaagcaatcttcactgaaggaattccctgatgtactacttttcttttcaacttcctccactctcctctttcaatacataattttcattcaacatcactcttggttttcctcttttcttttgtattatttgcagataatgttattcctggaacaatggaagaatctcactactagccaatctgttctatgccaaagggtgtcatttttagccaatcacttaacaaaggcaattgttcttcaagaggaattctaaggtagctatttttttctattttccacaaaataatttaaatacaagtcatagtactaatttagaacataaatcatattatctaagacatagagttaacaatacattgaataatgacacgtcatcttctatatagcagaataaatatgtaattatcttgttaaatacatggaagaaaaaccctgaaattttttattgcaagagagataataaagggatattaattttttaaatacccattattttgaaatatagaagatgctgaatctcattaaaatcatctggttttatggactatagtgcaaataaggcaagtatagtgcaagtcttcacttgtcttcctttatcacttgtgtcacttgcctttctttatcatgccctttgttattggactttgcagctcctcccaagagtctgtctgctttctcgagaactgaaaattccatatcatcttataaggtctgatatcctactgttctatgcttaatctggaaaacaaacaaagcgaaaaataaaataaaataaaaaagaaagcacctgccttttgactaaccatgatgactgttggttgactaaccattatcccgttttgtagaataatatagggaggtatgttgaacagaaaatgagtgttcagaaaaaaaaagttaaagtcattgtagcagagaaagtcattgtagaagggaccagtgagtttaaaaggaagttttaatgtttcgcttttatgctttttttgtatgaaaatgatcctatatgaattggctacttatttttaaatccatgccatcaaaggattttggggctaaaatatttgcctgtaagcatttactagataagagaaattagtcaagttaggcataggctagtttcatgaaaaagatgctaatggaggggagttgcagaggtgactttcaaaagtaatgcctaaatcaagaaattatattttgatgatctgaattattaaaagtattcagaaaattgtcttattaagatgaaaaaatttgaaatatttgtttatttaaaaatgtaagctatttgcatattagaaacaaatataccagtataagataagttctcaattattaaaaccttacattctctaatattttagaaaattgtaggttctctgttacaatttgtttctttctacacaaactgacaagaataaattgtttatacagacttatgaataaaatttatggataaaattaatgtgcttagaagaggcaaactgctttggaagcccctttcttccccatccacactgtgctttgccaacatcttcaatctcctcctccattgtcctaatattccatggcccagcaatgctgttgcctgtcttgttatgcttacatataagttaacaagcctgctgtagaaaaattatgcaagcttataattgtttctcttacaaacatatgttgtgaaatctcaaccctattcaaaatactgcccagcaatcctttgattcccaccccctttttctcacattctccagagaaagtatttcaaataaatctcactctgctaaaatatcctaacctaccacctctcctcactttcaggacatgattttgcctctttcttaagaaagaaattagaaactattagaaaaaaatacatagagagagttcaatttctggtcactgcacttataaacttaaatgagatatatctatctttttatactttgctcttatcaaaatgaaaaaggtgtttcctcttggctaggactaagtaataggttaataaattacagaaaaaaaaatatgccaagcattagaaattatgattaaattaaaaataggtgaaaggagtaagcaagaggaactttggagtttagtgtcaaagttgtaggggctctgagcaatgctcatgaaagtatttattaaagtagagcaaaggtaagactggtctgatagaatgaattaggaggtattccctcctcttctatttttcagaatagtttgaatagtattagcattagttctcctttaaatgtttggtagaattctgcactgaagccattgactcccaggcttttctttactggaaaactttttattatatctttgatctcattacttgttattggtctgttcgggctttggatttctttatggctcagtcttggtaggttgtatgtgtctagtaatttaacagtttcttctagattttccaatttattggcatatagttaatcacagcagccactgatgattttttgagtttctgccgtatcaattataatgttttctttttcatctctgattttacttatgtgtatctgctctccatctctctctctctcttttactttagtctggttaaaactttgccaattttgtttaatcttttcaaaaaaacaactttttgttttactatcttttatattgttctctttatttctatttcatttatttctgctcttatctttattattgcttttctattaattttgagtttggtttgctcttgctttcatagttctttaagatgcatcatgggtgttttatttgaagtttttcttttttgatgtaggcacttgtagctataaactttcctcttagtactgctttttctgtatcacataggttttgtatacccatatatgtggtatctataccttatttgtggtatctatttttggcaataaagatcatacactctgtgatattcaatcacccattcccctgactctagtctttgataaacagtctttgtccttttattcccatatgtagagcttcgaaatcaattaagttccttacaacctctgacataaagcagtctcctaaatggcctattaatcttcactttcttcatctgtctcactttttagttattgtatttttttcctcctgcctttcacaggcagattatcaaaggaaagtttactttctactactgtatctatctgtgccagtatagacataaacataaacacacacatatttctataatatgtaaaatactagtgagtattcattatacacatttttcctacagggattgcatcaataaaaaccatgtatcagagattgctagttatcctctaacaccttttctccttttctttcctaaaaatgggattttagctgggcaataactagctagaataaggattgctttcccctgagtccctaacagccaaatagccatgtaattagattttggccaatgggatataagcagaaataggagaaaatgaaatagaaaatgtaggtcagcaactaaaactttgtttaagaggtagctgatgactgccatttgggttttccttttccttgttcttcttcctaccgtttgaagtgtaacttaatggctcaacttgaacaagatatgatcttgggaatgaaagtaacctacaagtagaacagtcaaataaatggatcctgagtgtttgatactaggtggtggtggtgcggttcccataaatgcctacctccagaaacctgcattaaaaacaaacaaacgaacaaaaacaaaacacaaacaacttgtgtcttgttttagcctcttggtttttgtttgcattttgcttatattttcttttattcatagttaaacctaatccaaactaatttatgtaacttcagtcaaatcaagtacaaccattggaaaaaacatgtaaaagcagattatcaatgatgtcaaattatatgtggaacaaaaattatttatacatttcacaaatgtatgtaaaataagtatagtgtgaaatgttcagggctaggcattctgtttattttgagatccaagttctcattaagatcctgttatttgagcaaagatatgtgtacagatagaaacaaagcaagagagaaagtaatctggaaggagaaaaatcacaaaatctttagattgttgaagtcacaggaaattatgcattccaaagtagggtgaacagaaacaaaagatgagaaaaaagctgggtagatgccatcatatacagaatggatgatggaagaaaaaagaaaagaaaaagtctgaaaggatatagtcagtgagtaatagaaaaagatacaagaaagaaaagacatcccagtgaataagaatgaaggatgttctggaaaagaggtaataatcaacaaagtcaaatgttgcagataaatcaagtgagataagtattaaattaggaactaagaagttattgctcattttgtaaaagacagttccagagaaatgatgggtaagctagtttaatagtaatcgattagggagcaaaaattgatggtataaaagagaattaagaaaattggggcatgacactcctgagtagttgagaaggaacagtgcacaaatggaggaactacctttagatgggagtcagccttcactggaaacttgtattgactaaatttgttagtttaaatctaaatgtttagtattattttaaccaactaataaaaataaataattgtgcaaaacgattttaataaaacaaaatgtattacataccttattgcattcttaatttgaataacattacatagattttctatgttatataacctgcatgccatgttttcactaatattctgatcttgataaccatattgttcccttgacttcagccagtatttcatttttaatgacttaaaaattcttattcttacttcaaactatatatcataattaagtcaaacatccaataggacatattctttttggaatagtgcttatctgcaacctacatcttaccaattgaaatcattatttatcttctgggcccaatgtattaaaatgtctttctgacctttctattattatttacatattttccataatctaatctgaagaaattactattactctctttgatattcaatcactcattccctaactttagtctttgaaaatcagcctttaaccttttatttccatatgcagaccttccaaattaatgaaatttcattcagcctctggcatagagcagccccctaaatggtcttttaatcttcactttcttcttctgcctcaccctttagttactgtaactttttcctccttcctttcacagacagattttcaaagggaagatttctttgactatctctactccttcactttgcttaaatgattctccccactctttatcattaatttttcaatgtctggtaggtgatcaccatcacagtattaactctgccaataaacaagcaaaaccacaaaataaataaaaattcttctcacgctactaatctatttatcactaggtcttatttattctatcaaatcatgtatttgtatcaattaatttactatagtttacaataatctattgtatatttcaaagtagctagaagagaataatgtagatgattctagcatacagaaaagacaaatatttaaggtgatggttatcccaaggacactgatctgattgttacaaattatataaatgtattcaattatcatatgtgggccaggtgcggtagctcatgcctgtaatcccagcactttgggaggccgaggacggtagatcacgaggtcaggagatggagaccaccctggctaacacagtgaaaccccgtctctactaaaaatacaaaaaattagccagatgtggtggcacgcccctgtaatcccagctactcgggaggctgaggcaggagaatcactcaaaccctgcaagcagaggttgcagtgagctgagattgcaccactgcactccagcctgggtgacagagtgagactccatctcagaaaaaaaaaaaatcacatataccccaaaactacgtgcatctattatgtaaaattccctgaacaatttattcataatatctgttctccaattctcccttaaaactattccaatcacactgtcacttgcaaaattattttcatcaaagttaacagtgacttccatgttgctaaatccatttattaatttaggaacgtattttataataagctccaaaaaaggagaaaaaaactcttcccttgctcctactttctttttaacctattgtcccaacactctttcttgcaaaattccctgaacaacttatttatagtaattgcctataatatctcttctccaattctttcttcaaacccctccagtcagcctatcacctacaaaattactttcatcggagttacccaatgacctctatgttattacatccagtgatcagttttggagcttattttattagcttatcattcacatttgacaactggccaattccattataattttttcttttggtttccaggaaaatttataaagtcaatcttatatgtctgtgggatctgtattagcagattcaaccaatcacagatcaaaaatatctgaaaaaaaaatccatacaacaataatacaacaaaatgatacatacagtttaaaaactatgtacaaagcatttgcattatattaggtattgtacataatctggagattatttaaagtatatggaagcatgtgtgtaggctgtatgcaaatattactacattttatataaggaacttcagcatcccaagatttttgtataatcaggggtggtcctggaaccaatttcctgaagaccctaagggataactgtactgtattgtttttcctcctatctcatttactctcactctcaatctcctttactggttcatcctaattttgctgacattttagtgttggagtgtcccacaactcaggtattagtttctttttcctttttttaaatttaataatcacttcaactggtagaaacaggaataattacttccactttgagatttccaaatttagaagttcagcccacacctttgacttgaaactaagatttgtatatccaactgtccccttgaaatcttcaactacagatttattagccatctcaaacttcacacatccaaatttaagctccacatcatccctccaaaaatgtttcatcaatagccttcccaatattagttaacttaaattgtatttgctcagttcttcaggtcaaataatctgggatctgtattagcaggttattagagatattctttagagctattcttttctttctccaacttcacatttcaagaaattctatcatttatcttgaaaacccaataatttagcctcacctccactgctattttcttatttcataattataaactctcacttacataccacaaataatgtctgttcttttagctttccctcctatagtttattctccacacggtagccacagtgactttttttttaagtaataaggtcaatcatgtcattactgtgctcaagcccctcaagtgaattcacatttcatctaaagtaaaagacagatgaatcttgagccaggctctattaattatctttctttccctcctactgcctttacccatggtcattcttttctagccacaatggcttcttaggtgtttctacaacacaataaggcccactctgctttaagtattttgctctagatgtcatttttgcctgaaggctcatccagttgactaacttccttatattcatcaggactttgctcaaatatcaactttacaattaagtaagctacacactcatcaaaacattcttgctctcttgacctctcttactcttccacatcttttctttcttatcactctctagacagagtgtaggggtaccttatttatgttgattactgcttttgttctagattcagctttggctccttgttgatggatgacaatgggtaagtcatgtcacctccctagatctcaggttctcacctataacatccaaggtttctcttaattctgatattatggcattgtcagcttagacgctatgacagaaacaaagaagtaaaacgttcactaaatacaatactttgtaaataactatttacaaagccttggatggagagttggattagatgctctttaaaattatttccaaacttaattttgatttttactagaattccatttgtttaatgtttattcaacaaatacttgttgaggtgcctgctacataacagcattgttctaagtgcttctgtgtctaaagcaccaaagaggcctgctctttcttcccttgtctgcatgaaagtatttcacaagacttccttctcttaccttttcaaatgactccttcggttttcttttctgtatcatccttctaagtccaggacttatatgttgttaagtctcagattcagtcccagtcttcctttgttttctcattttatcctctttctatatatccaattatattgttgcctattggttcacttaccatcaatattaactaaataccagtgttgtgcttctactctaaattattgaatcatataagaaatatagttgtctagtagatggctttaattgcacatcttgaagaatattccaattaaatatattcaaaacaaatctcaatatttacagggttctcattccaaacttaacctttcctcaacaatttccaactcagtgaatattactactgccttcaccatttgttcagatcagaaaactaggttttatttcaatactgccttctttatcaccccccagtccattacaaagtccttttgattatacatcatcagtatctctcaactcagtctacttccttacctcattaatatgactctaattccagctaccgtgatcttttcttggaatactgcaatcatctcttaagtgatcttcctacagcgaatcgagtccctcttcaaatcaatctcttcatttcagtaagaataatcatttggatattcaaacatcttcaagtaattgttttggataaattcccatggttcttagcaaatcttcacatggcttaaaagatcctctctagtctagtgtttacctatctctttcctttatcagtgtcatcttattcattctttcactcagttactgaatcataatctactcaatgatataattagatacaaatttttaaaatagcataaagaagcattttactttaaaaatattatgtcttaaaagcatgttctgaatactttgcaggtttcattagaccataccttgagtttctaaagaaacaaaccatattcccccagatgatggtgtttaatttttgctttcagataacaaggtatataacaagtctgcttaaacaaaggaaaattacttccaagactattcaattaatttgagagaaaccatcaagtttggactggcatgctaaaaaacacaactgtagattacaataggaataacttttatttgtttatacaagttttgaatttcatctattttttatgtaaatagctcgatcttcaaaaatatccttcagctctgacaacctcttcacataactttcctgtaagatcttttaaatatccaaacctgtaaaagtccacattcagttgttctttgttccttagtttgcttcaacaacatcaatgcaaggttaatagaagctatttacttaccatatggtaggtggctcagaaccttctatttctaagtaatcatatttctcttccatttgaaaatcagtaaatatgagtgaaattgtgtccccaggctctgctacaatggtccaagtgcaatcagcattgttatggtactcattaggaaaactagggctggatatgatgccactggatcctctcattgttcctccacaagcatcttcagctgttaaaaatgacaaaatattcagttgtaagttattgagataaatgcaattgttcagttgtaagtaaagcaagtcaatatgtttggataaaaataacagttcaaatgtgataccaagtgcataatatactaatagagattaaataaaatgagaattttatgaaaaaatgtatcagcacatatacaagtataaagtatatcttaacaattttataacaattagttgaaatagcaataaaagtaagcaaaaaatctacactctaaaattagacattaggaaaatagaatcaagattttattttcatgtttaagtgacaaagtgagttaaacaaaggaaacatgtatcttaaagtctgtgatgggaaatctttgatcactttgtttattgacggaagagctttttggtttttcaatgcaagtatgtacaacacaaagacataatttaagagacaatataatatagttcatgtcaatggtatgtttcagaagttattgaaaaacgtttgtagaaatacaactcaaataaaaatatatcacatatccaggatattttgtttacagagaaataatagggtaactaatataactttagaaatatattcatatgaaatcaaacaatgtatcttttactaaatagtcatataatgtacatagatacaacaccataaataactttttgactaaccttacatttggaactgtgattctgagtttccaaattggggccatagattctccactagtctacttttggctgatggtaggaactagcagcgtggttatatgagtagctgtgtttggtatgcaaacataagaaaaagctcctgtttcataaaggaattgaagctggggcatttgccttactataacattgtttaggccagtcaagctaataagttacaagttcacttgtgaaataaattgtcttattacttatgttattgccttggccaactcagggaattccttcaagtttttgaggaaaactctggctctataatgaccaattattatttgatgtgaccgatagctccagaacctaaacaaatggagatggacaatatctttgtattcaattccatgatgggtagaacataaaaaaaattgctttgttattagagacaactttattactgtattatatgcatcaaatagtattagcttttttctttcttgctctttatccatttacctccataatctataaatcaaaaatgtaagtatgttcgtcttaaaatatatttaacttttatcacacactaaatatattttttaaaaattttattgtgtgctctttctctcttaagtttgttagataactgaaatgaactagttgtcttgtctagaccatgtggcatactactacaaatatttttaccaatgccttcaagacctaaatcttctagtaatcctgtcctgccgtctctaccctcaaccataaatcacttctattctttcccttctcaagtaccaagaccaacattgaatactgctttgataataaattatttcactagcatatattcacagtttaactggcccacaatctatttaaaccagctcactgagctatttattttccttcctctggataaaatctgaaggagacacataacattctggatcacactcagattaaagaaaaaaatcccacagtttagagattatagttcaagtgttctcatctcaaaaataaaaagtatatgaagtaaggcatacgttaattagctcaatgtagccattccacaatgaacacatatttcaaaacgtcatttgtacatgataaatatacattacttttgtctgtttaaaaataaatgatttaacttaaaaaatcacaatccatcaattaatatatccagtcctgggtaaccaaaaagaaattaacttcattttgattaagcttctttgctccctataccttggacttgtggcagatggagcagaggtggggcagaggtgagatggagaagtcggtctccttccttgtttccctgctagtatttctgttcatcctcccctttctcactgagatctctatgagcctcctggggttacaagtaggaaggatcagaggatctgaatcctcttattttcctaacactaatttggcactggtttctaagggctttgacagacaattaaagaaagatgattctttcactcataggccctttcatgggctccacagaggtgtccccatcagttccattactgtgggtgactgtgtctctccagctggctgcttacatttctgtctcatgctatgggtatagaacagtacagtttcatcttctttccaaatgtctcctcaccttttgagattggcctcttggacagcatgtaagaccatgccaagccagaactccctcacaaaaatcctgcatttagtcaaatgaaaacacacccatttattcaccctctgtggaaatgcagtttctttcaaaatgcagtcctttgggttcacaatagacatttaaatactttatccatcattttaataataataatatattatattccgtaagctccaaggcatagaaatcaatttctctacatgatctctttgaatttcctcaacctagactcacaatgctgataaataactctacactcctgacacatggaagagagaacaacccagaaaacaactcacttcaaggaaatcttgattttacagcaaaataatttctgttcaaatgtatgactaattttcacttgaaaacaaggatagggactcagttcctccagcattcaaaccaatgttcatgtcgactcttgtactgagttctatgctcaacacttctgtttaatttgtttgttatgacagagactatcatagaatcagtatctgacaaaatggtgaaataggtaaacttttcttcagtaaatgttagattaaaaaaaattttggtttggtgtccctacttgaatgctgaattcaaggcaatattttaaaaaaaacaacaacatattttctgtaattatgaattcatagcagaacatactacctaagtcaatttaaaaagaacttatagtggatttgggacaagtaaaaggcagcattagaacaaaccatgaaactcttgaatccagtgctgtgctctttctgctaaataccatggcttggtctctgttcaaaatgagttggtacatatcctgtaaatgacaggatagagccttctattctttcatcattactctgtcacagcctccaggcttgcttgattaataaatgatgtctacagcattttctatccaacaattcacagaaagtggggggttcacagaaggttgttccatagaaccatctccttagaggctcaagatacacataggatcatattggttatttgtataaacttcttgtgaaacaaaatttattcattttgtcatctgtccaaaaagtattcattgagatcttccaagtgccaggaggaaaccatgtaatctctctgactataatgactataaaacgttttcatgatccctgttctcatggagtattctattagtgagtcaggctctaagcaaatgacaaagtgaatacataaaattacatttctgtcaggtcctatgaagaaggaacatttagtactaatgctgtatgtttgggaccttgaactagttatcgaattaaggaacaagaatttcctgaggaagtgatgctggaccagaaacacaaagcaaaatagtaagcagtaactacatgaaaagcagagggaagggtgttcctgcagcttcactgacacttttaccaaggtaatgggcctgtgtgctacagtaaaaagggcgaggggctatctggtaccaaatccaattggaagggcaactaagggtcagaccttgcaggacatttctgacaaaggtatggaatttattcatagtaatggaacattaaagtgtttttagtggggatgtgacataattggatttaggttatcaaaagatcatttagttgctctatggagggataagagaggaaggccatagctgatgaagattaagaggctgaatcaagagtccacgcaaattcttgcatgcttcattgctgcctaaagataaaacatctcgttttgactatattattttatttttatctcattatcttcaaaagattagtttggtctttctagatatgtcagaagaaataccatgatgacaaaataatcagaacatccatcttaggccaagacttaagaataatatattttcacctaaatagtaaagcaatgccattaaataccttagacttcccttgaggttaactagaagttgtgatggcttccgaatgtggttgcttaacatacagataatacagtgagtaataaaaacaatggtggattctctactcttgttctaggaaaagtataaagtttgtaagatttaaagtcatttaatttttcatatatgtatatgtatacacatttacatagcccagatgttagcaaattgcatgttaagaagtttgcaaagtcaatctgttgtaaaacatgaagaaaaccacaaattcagctaatgggatcaataaagacaatgtggaattttaagaatgaggactaaaactattaacccttttggaatttggatttattccaattttcaggagcaatattatcaattccctcgtaagttcttagtgaatttaaatctattaattaaaaactatggctgttaaaaatgttagtaaacatcattttaattgtttaaaatattataatataaatctatcatcaaataacaccatttattatactttaaaataactgaatttatgtaaacttcataaataatgcttttttatctcttacctatagagcagggagaaacataacaaaataaaataaagattagttgtattaaagtgaaaaggtttttaaaaatagttcactatgatttcacaaatgtactttttcctaaaattaaatttttatttacttttaatctctgtgacagttatttagatattgtaaatgtatgaccttgttttggctttgggtatgagaccacaccatttcattgaacataatataaattggaacttttccaaacatggctgttaataaaaaaataaacacagcttcataaaacacccaaatggttttctgtaacacatcttttccaatactgatctcatactatgctctaccttgctattagtttctgctgaaatagcttagtgttgggggtggggtgcaggaaataggcttgtttatcatcaaagagaaatgaactgtaaattgtaggagagaagtacacttggtcgattccagatgctaagcattcaattcaatttcaaattttatcatggaacattttttctacaattctcctttgctaaatctataatttccatcagcactcaagtgaaactgacatctatgtgaggctttttatttcgtcccaagacaggcatcactgttgtgtgcctaattaggcaaactatttaaatattacactgtcattaattagccatcttattacatatatggagcagtagttaattttgtgtaactgcctctacttacatttaatagttcaactctttgcattcttgtgtttaaagagaaacccctttctcatggagaagaaaattgagcaactgggtaaataactggtaaataacacttcagattgataattttgttttatgtttgtcacggtacaacaaataataccttcccagcttatgaagaaaacaaaagtgcattttcaatgattctgaaggaaattaaagattctcatatttttatttttcagtcaagctacctcagttcctttcatattaaaacagatgaaattaaaatgaaaaacatgtataacagatcaaagaaaaatattcaatattcactgagataaacacctctgagaagtaaaaagagcaaagtataatggcattttagctttgaaggtttatttttgaatgcacaaatatgcttattacaaatatcctacattaatttccatttaccttccaaagagacatgttgagaaaatgagagacagttaatgcactgaagaaagtaattaataagtatgtgtttttaaacatacagcttaaaatacttctcagaatctctaaataagacaaaaatataggcattcattcaataaaacttaaattatttaaagatttggagaaaaaaatatttaaattaaatcaagtaataaacatgaaagagcaagagggaacaaatttacattactgacttaaaaattaaaactgagaaaaatatatataataactgttttaaaacattagaccaggtctatgaagaactgtgatctaagagaggagaaaaactaagaaggagagccctattatcacttggctttctctaaggagatacattccggaccatagaataaggagagggattacaagtagagcatagtgtttctttcagctcagtacatagaattcaggaagcatgagcaatggaatgttagtcatagggcaaagttctagagaggaggaagctctgcagaagaaaaggactcaaaagatttacattagattctcttcattagtgtttgctaaatactaataaatgcatgcaattggatgaaatttcatgaagtcacataaagaggaatgtgtaagatgaatggttccaacaaagcacacagggctgagatttgttcaggtaccactagctagaatatagagtccactttgaatggagtattcagtagaaatctcaaaaggggtgcacttcagtagagagggtaaactatgcctagagttaaggccacttaaaaatgcaatacttaaagcttaaaaacaaatctcaaaagacacaaactgaaccaaaagtaattttaatacatacatactagaagaaagctcaagattccttaaagataactaaatccagacactaaatatcttaaaattcacaatgttcaatatacagttaaaaaaaaaagtactagccatgtcaataaacataaagatgtgactcataaccaagagaaaaatcattagaaacagaccaaaacatatggagatgatggaattagaaaataaggactttatagcagatataactatattcaactacttaaaacaagggttagcacactataccccagactaaatctggcttatagactttttttttgttttgcctgtgatctagtaatgatttttatatttttaaaggattgtaaaaacaaacgaaccaaaatcaaagatgaatacatgttagagaatatataaccacagcaaagcctaaaatatttactatttagcccttttcagaaaaactgaactcagtgaccacagtgaggaaagaaagggaagatatgaaaagatgaccacatgaaacgttaagagacacaaaatatattactagaaattaaaaaaaaaatactcaatgggcctcatagaagagtagacagtacaaaagaaaacacagtggacttaaacacatggcaatagaaactattcagaatgcagctaagagaaaagcaagatttctttttaaagaacagatatcccctataggaaaataccaaacagttgaatatgtgttattgaagttccaaaaaggttgtggagcaggggcaagcatggaaaactatggaaagattaatggtcaaaggatttacaaatttgatgaaaatataaaatccatagttacaaaaggcttagagttgtttgcatcttgatgtggtagagacgactagctgagatccgaaattcatgttccacttccatttatgaggtgttgctgggaggcagctgccagccaggacaaatattttagtgcttttcacatctaagtgaggccatgtagctgaattctgattaataagttgtcagtgaattgagatagaattgcaatctttgttatccacattctttattctctttctttttttttctgtttttgtaaaatagctttattgagatataactcacatgtgttcacccattgaaagtgtacaattcaatgccttttagtatattcagagttgtataaccatcaccacaatgaattttagaacattttcatcaccccaaaatgaaatctcacaccttttaatcgtcccctccaattcacctatgctcccttccccctgggccttagacaaccatgaatccaccacaggctctatagatttgcctattctgaacatctccaaacctgccaaagctatgccattaaaaggcactacagcaaagagcatcatgcaagtcgcatcacactgggggcctggcacagaagtggtggtggtggcatcaggcagggcctgatccatggggtccagggtgaccatgtgggtcatgcaaacggcattacacaatatgccatgcctggctaagttttgtgtagaaaaggggtttcaccatattgcccaggctggtcttgaactcctgttctgccttggcctccaaaagtgctgggattacaggtgcaagccatcaggcccagtcccttgaatactgttatgcaattgtcccccagtttccgccaggtattggttctaggatctattatgatactaaaatgtgagtatgctcatgtactgtagttgaccctgcagaacccatggaaatgaaaagtcagcccaccctatacacaggtttcacatcccatactgtattttccaaccatgtttcattgtggatgtggaaccctctgatagggagggctgactgtatttattgaaaaacaaaacaaaacaagggttgtgttagtagacccatgcagttcaaacccttgttgttcatgggtcaagtttctatctggatggaggctgtgttcttgggcagcttcaatggctatatgtttatgatggcagagtctcttttctacttcagtatttaaaatgtctgcctccctctcactgtaaacttcataaaggcagggcttatgtccctttttgttcatattatatctgttacttaaaactactatacctacatatatagtagggactccaagtgaatttattgaattaaacatgaaatgaacaaataaatgaatataagtatttaaattgatcatcaatttggattctgatctctgagaatctacagaatagaataaacagaatttcaaagaatacatcacagttcaaaaacataggaatagtatgttaaatggagcaaaaagtcaaaacaaagtaaaacaatggggtgagttgctaaatacattttaagaacaagatatgaggctggggatggtggctcacacctgtaatcccagcacttcgggaggccaaggcaggtggatcacgaggtcaagagattgagaccatcctggacaacatggtgaaaccccatctctactaaaaatataaaaattagcggggcgtggtggcaggtgcctgtagtcccagctactcaggaggctgatgcaggagaattgcttgaacccgggaggtggaggttgcaatgaatcgagattgcgccactgcatgccagcctagtgagaggacgagacgccatctcaaaaaaaaaaaaaaggttatgtatgttgcaggtcaaaataacataattggaaaatctctacctctgttcagcaagtggaaattgttaattaatttatattctccatccttaatttcaagaaagggcaacataactattcgcagattccagaactgtgtatgtaggacatttttttaaagtcattgataaaataccaaacttaatgagtgaatttagcagtacaactaaatagaaggaaatatacaaaaacatatcagagacaaacaattagactgacatttttaaaataccatttttaatataataaaatttcatatacctaggaatgaaggcactaagacatgaaaaagctgggtaaagctctactcaaaatattttaaagcattcttgagagaaaatacaaaagacctatgtaaacaaatgaatatgctgtctcccaaattaatctatggctttagaatagtcacaatcaaaatactggcaaatgtgcatgtgtaaattgacaagctgattttttaatttcctggaaatgcaaagagctaagtctaactcaaacaatcataaagaagaatatacagctgaaaaacaaccagatttcagacttattatacagctgccataatcaaaacaatggagaattaaaaacaagtatagaagagttaaccaatggaacataatgaagagttcagataaagactcacacatattcatgacaacagcaacgcttgatttatgacaacagcaacactgtagaacggtgaggataaaacatcttttccaattctggccctgaaaaattaatgtctttctctcattcaaaatacattcataccattccaatagctctaatagtcttagctaattctagtatcaagtcggaagtctaaagtcaagagtcctatttcgatatcatctaaatcagccatggatgagactcaaggtatcatttgtgcagaggcaaattgccctctgactgtgaacctctgaaatcaaaaatgatatctgcttctaaaatacaatggtcagacagacataggatagacattcccattccaatagggagaaacaggaaagaagaaaggggtaacaagtaagactgaaatctaacaaggcaaacaatattatgtcttatagctcaagaataatattctttggctcaatgtttaccctccagggactgagattgggttcctaaggcttcaagcagccttgctcccgtgacagttctgtgttgtggccctatcttcaaatcggctctgtgcctggagctctccaaagctgaaatcacatacccaacagtctactggtctggattctctggggtggtcctgctcccatggctccactggacactgacttagtggaaactcttcatggtggcttcacttccagggcagttttctttctgagttccacagctttctttacagggcatcctttgcaatctaaatgaaggcagccatgaccccataactttgctagacatagcccatgtcgttctaggacccaccaaagctacaccaggagtggctgagaagcacggaaacagagtgcaggcagcaagagctgagtttccataagtatccccagtcccttctttgaaattgttctcctccccaggctcttgtagcctggccttatgatgggaatggcagccccatgatctccaaattgcctttgacatcattcttccactttctcaattaatagcaccaggctgatccatattaatctctttatcaaagggtcacctgaccacacccttcctgttctctcctgtacacatcttcattttttataatatggacagttatacaattttctaaatccttaagttccacttccctttattaaaaattccatctttctatcatttctttcttttcctattttattataagcttcaagagaagcaaagtcacactttcaacaccttcaacactttgcttagaaatttctccatgcaaatatcctacatcattaaccagaacttctatctttcataaaacactaggacatgaacaatatgcagccaaggtatttgccactttataacaaggatcaccttttctctagtttctaataacatgttcctaatgtccatctgagacctcatcagaatcgcttttaccatccatatttctacatttttttaatgactaagtttttacctaagaagattgaggctttctctacatctcccctcttctctttctgaaccctcaccaagattgcccttaatgaatggatattcacagtaatgcaggctttttcagcatgtacctcaaaacccttccagcctctatttgttacctagttctgaagatgcttccacatgtttaggtattgttgcagtagcatccttacttcttggtaccagttttctgttttagtctattcaagctattatttcttacagatctggaggctgggaaatccaagatgaaggcactggcagattcagtaactggtgaggacccactttgtggttcagagatggtgccttcttgctgtgtacttatgtggtagaagggttgaatgagctcctgtgggcctattttataagggcactattcccattcatgagagttctgccctcaagacctaatcacctcccaaaaagtccaacctcctaatatcatcactatggagagaggatttcaatgtatgaattttgggggaacataaatttagaccacagcatgggacaagggaaaaagacaggattgaagtcatggtctttgtcattcccaggtcagaagttttcaaagaatttttaaattaaatattgttttaatcaacaaatcatgattatatatatatttatggggtacagcgtgatgttttataatatgtttactatgtgggataattaaatcaagccaattaacctatccatcacttctattatttatcatttttggagatgagacatttgaaatttactatgacttattttgaaatatacattgttattgcctgtagactccctgctgtgcaatagatcttaaaacttattctagtttatctgaaactttttaccttttagccagtgactattcactttccccctccgcccccacaatccaccaatcttattcacatttccccagttttgcttgtatttatttactgtgtgtttagttctatgcaagtttatcgcatgtgtcgatttgagcgtctaccattgcagtcaatatacagaacgggcccatcactacaagaattcctagcgttgctccttttatttatgtatttatttatttattttttgagagggagtctcgctttgtcgctcaggctggagtacagaggtgtgatctcagctcactgcagcctctgcttccgagttcaagtgattcccctgcctcagcttgctgagtagctgagtttacaggcgcctgccaccatgcctggctaatttttgtattttagtatagacagggtttcaccatgtttgtcaggctggtctcgaactcctgacctctaaacgatctgcccgcctcagcctcccaaagtgctgggattacaggcaggagccactgcgcctggctgtgttgctctttttaaagtacactgacttcccttcttcttcttcttactccctaatccctggcaatcatttacttatctgcctttcattttcaagattttcatttcaaaatgtcttataaaatgaaatgatacagtatataatcttttggggtttacattttttcgctcagctggagatctctccaagttattgcatatttcaatagtttataccattttattgctgagtaatattccatggtatgtatgtgattacagtttttgagaatgcatcttttaaaatgaggttggataccaagaattgactacaaattaccctaggataagagcttgccagttcaatgactttggtctgcaaccagacctctcagaatgcaatgatatacacaactgacccaataaaacatatatatatatatatatatatatatatatatatatatatatatatatatatatatatatatgtatatacacacacacacacacacgtacacacacacacacacacacacacacacttgtgagtgtcctcagcaagagttgctctttattttgtgttgcaactccagttgcaattgtcctgagttcctagaaagcccagttcttggactgagaagtagtcatgagaccgaagtcactgcagaaaattgaagcttatttcaatggctggataacagtaaaaggagagttctcatgtccaaatgtcagaacctcccaaatagtgctaatcacagttctcacttcactgaagattgaactttgttccaagagtgtttaagtgacttgcctaaggtaaaccagctgggattttttgtttagttttgttttgtttctgagccaatgctaaaaacagtcctctgaccacctcaataaatggcttagttttatattttgttttgcaagtggagtactggccttttaacatgatcaaaactgcataactaacttttgtgcacagtgcaatcccataacatgggggccttcccttaaaagaacacaaaaaggcctatttatccccgcaatgccacagctgactgtgccacctttgaaatttaactttgccttattttttggccttcttgatatctcctcccaggagttcccactgcactatgtgctccttggagccagagatgctggccacagtgcactaagtggagaaacctcagactttgaagtctgcaagtttcctagactaagaattatgaatattttgttttagttttatttatagatacagggatgcatgctatgtatatagtttttaatcataatccaatcatccatagtcatattaggagcagtaatttaaactgctgacctcagtgcaattgctgaaatttgcaaataaaattaaatacagcaatgaacatagtaatgttgcatctctttcctctgaggaaatgaataaatttctattccacatttaatgattacatctgaggcaggcacagtagaaaaaaagatagaaaatagctatgtgtcatgtaccatactaagcaacaaataatgtttttaaaggctaggtttagatgtgatttaagtcacattttcatacttcctataggacagcctttagcttcagggcaccatcttaactgtgttgctggctgggacattcagtcttgccaaggaaatagagaaataatcacatactgttgtttctgtctcacaatacttgcaatcagtcatgaaagtaaaagttctctatgtttcaataaattttcctttttacttgtcctaagtaactgcttcaagctgctagagtttctgagagtcttctctacaaatgcgaatcaataacccctcaaactaaaattcatgaaatcaattctttgaaatgaacacaatttttggaaaagataatttctacccaaactagttaagatgctttttgaatattaaatattctccacaggcagttgaatggttaagagtattgagccgactgacataaattgcagaatcatcatatacatggaggacaattgaaatcaataaagtagacatcatcttctactaaacagtatatagtatgaacagtggaaacctgggaaaccataatattaaattaattggtagagaaacaggaggcaatgaggtagatagagaagtggctagacaggtacaataataatcaaattatttcacaagaaagacaaaaaaagatatctaaagaatgagttaataacaatgtcaaatgtcatggagagactctactttaaaaatgtgaacaattatgtgtctattaggaagccactgctgaacttaggaaaagggtttcaatagaacgtgtgaaaagaagcgagaccagtcaattgagaaataaatggcagaaaaatgaatagaaatgttaaacaaagacaaattttctgaggaatttgaaaagggaagagggaaaatttactgttaggaagagataatagaataaagcaataaaaatttagtgtgtcttgctattgagaatagtatgtgttggcttcatttgtgtttggaccttggaaagatattggagagatatctatcagctgaagggatcccaggtgcagaaagaccctgacctaggcaaaagataaagaagaccacagtgtatagattagctattatgcatgggttagtacagtaattttttattcttatcatgcattagcatcacctggaggacttttaaaaagcatcctactgtagaccccattattaaccaataatatttttacaaaaagtaggaattttagggttggagatgaattataggtatttttaaatgttctctaggtgtttctgatggcagcctagtttgaaacagaggtagatagaacattggaaattttgagaaaaatcataccctaatcatcctcactttcataaatgaagtaatattaaagtttgcaaaaagcatcaagtggattgggaaatcaaggagagcgtgaaggttaaaaatgaaagtaggcacaaataaagacagagctttcataaaatataaagggctgagatgatgcctactttcgttacttaaaccatagtccttgcacccttccctgtacctacagaatcagaaactctggagatgaggtccagcaatggacgttttaacaagccttccaggtgaatctcatccttgctaacctttgagatacactgacctaggaaaattctgaatgcttaaataatggtcagattctaatcagcatctcagggaattcagaaagaggaggaatagatctgaccagtcccttgaagatctgtgagacatctcacactacattagctgactaggagaatatataattttgaggtgttctcctttttatttgataatgttttaaattaaatacaatataggtgctgaaaacttctaagtgaatagcttgatgaattttcacaaaatgagcacagctttgttgctaacacccaaatcaagaagagaacattagcctaatggtagaaatctcccaaatactccctctcagtccttgctatttccatcctgaagataaacacatttctacgttatagcataatagattatttttgcatgttttgaactttataaaatggaagctgaaagtatgtcctcttgagtctggcttctttcaatccgctattctttgtggcattcatccatatttttgcatgtaattatagtttattaattttcactgtttgacagtggtacgtgtcactaatttaactgtattatctctagtgaaactttgtgttattttgagatatggttattatgtctataatgtcttttgctacagatgtgagtaaatgtctaataatgtgctatgattaaaatgcttgtgtcccatcaaaattaatatgtttaaatcttatcttctgaggcaattgcttaggacagggggcccttttgtaggtgattaggtcctgaggacacagctctcataatgggattagtgcctagaaaatataggtccaaaggtgcttattctccccttcctctatgtgaggacacagcaagaaggcatcatctatgaatctgaaagtagtccttcaccagacactgtatctgcccacagcttgatcttggacttccctgtatccaggacagtgagaatgaaatttatgtggcttataaggtaccctgtttatggtatttcttatatcaggattaatacactaaaaaaacataatttatttctacagggaagctgatatgatttggctgtgtccccactccaatctcatcttgaattgtagttcccataatcaccacatgtcatgagaaggacctggtaggaggtaattgaatcataggggcagtttctccacgctattcttgtgatagtaagttctcacaagatcttatggttatataaggagtttatgccttcgctcgattctcattcttctcctttcttccgccatgtgaagaaggatgtgcttgcttttccttccagcatgattgtaagtatcctgaggcctcctcagcccttcttaactgtgagtaaattaaacctctttcctttgttaattactcagtctcagtatgtctttattagcagcatgagaacagacttatacagttaattggtacagggagcggggcacttactataaagatacctgaaaatgtgaaagcaactttggaactgggtaaatggcagatgctggaaccacttggagggctcagaagaagacaaaaaactgtagaaaagtttggaacttcttagagacttagagagggctcagaaaacaggaagatgttggaaagtttgaaacttcctagagagttgtgaatggctttgacaaaaatgctgatagtgatatgcacaatgaagtccaggctgaggtggtctcagatagagatggggaacttgttgggaactggagtaaaggtcactcttgctatgcaaaaagactgatggtattttgcccctgccttaaagatctgtggagatttgaacttgagagagatgatttaaggtatctggcagaagaaatttctaagtggcaaagcattcaagaggaaacacggcataaaagtttggaaaatttgcaacctgatggtgtgacagaaaagaaagacccattttctgaaaagagattcaagccagctgcagaaatctgcacaattaacaagaagccaaatgttgatcaccaaaaaatggcaaaaatgtctccatggcatgtcagatgtcttcacaacagcccttcccataacaagcctggagggctaataggaaaaaaatggttttgtgggctgggccccgggccttgctactttgtgcaagctcaagacttggtgccctgtgtcccagccatggctaaaatgggccaaggtacagcttgggccatggcttcagcaggtgtgagcaccaacccttggcagcttccatgtggtattgagcctgagggtacacagaagtcaagaattgaggtttgggaacctcagcctagatttcagagggtatatggcaacacctggatgtccaggcagaaatttgctgtggaagtggagccctcataaagaatctctgctagggcattgtggaagggaaatgttgggtttgagtcaccacacagagtactcactgtggcactgcctagtggagctgtgagaagagggctactatcctccagactccagaatggcagattcacggacagcttgcactgttcacctggaaaagccgaaggcactcaacaccagcctgtaaaggcagccaggagaggtgttgtacactacaaagccaagggtcagagctgcccaaggccatgggagcccacctcttgcatcagcatgacctagatgtgagacatgggatcaaaggagatcatcctggagctttaaaatttgactaccctgctggattttggatttccatggggcctgtaatccctttgttttggccaatttctcccacttggagcaggcgtatttgcccaatgcctatatccccattgtataatatctaggaagtaagtaacctgattttggttttgcaggctcataggtggaagggacttggttgtcacagattagaccttggaatcggactttttgggttactgctggaatgagttgtagcttcgtccccaagttcttcctatgattgattacatgatgtcattcaaatcagtaatgcttttcttgactaataaccatgtcagctaaaacaatcccccatcagtctcgattacaatatcccattatgtaatagatttttttaccgttgtctcatttgactttagaatataaatgccatcaactcttgactacattactaatacattagttacaactttatcttacatacctagaatgaggctgacttatggcatatatctaaagaatagcttatctgattaaatatgttttttgcttctcaatatgtccataaaatttattggacatttatttgagaggcagtaatgtgctgagcttaaaagtgactgctctagaatcagaaagacttggggacaaatctgacactaatagtgtgacctaaatcaatttacttaagcctattctggattggtgttatatttgtaaaattattactgactgggcatggtggctaacatctgtaatcccaaaactttgggaggctcaggcaggaagatcatttcagcccagtaggtcgaggttgcagtgatctaggattgtgccactgcactacagcttgggtaacagagccacaccctgtatctaatttttagaaatgtattattattttaatagtgcatttttattaactttaatgtttccagcagtctcagtttcaggttttctgacttctttatcagtatcctagaagttttatttttgtcagtaagaagattccagcaaggtgatggcacaattgacttgttactccctctggcaaaattgccgcagcaggggattgagaaggcactctcagtcgcatagatttcatttcgctcttgctatctctactagttaaatgacaggttcactgcttctgcttgtttctcattttctgctacaaaataagagtagtaagaagagaatagaaagtgagaacaaaaatgtagcaaacctttgtccataagaagccctgtgagaaaggcaaagtatgagagcacttttagtataatttgaagagttctacagagctgggttgcttaaaaataggctacctctcactctgctcctgaattctatattttaaataacagttggactttgaacctatttttccccaatgaaattcaggagaaagcagatttttaataaaacgttatatagactagacaatttggtaaataatggctaatatgtattgtgtaaacaaaggcactattctgagcctttaaaatagatcatcaaatttaattctaacaatagctctaagagactaagaaaacaaaatgaaacaattacttttcctattttataggagagaaaattgagtcacaaaaagttagtaatttgcccaagttcatgtagttaaaaagtggtggagacaagtttcaaaaaaagccatctaagagaatagccttaatcggtgaacacactgcagtttgagatgttaaaaacatagaaagaaagtgaagaaagttaagaatggaaaaagatgcccaaaggaggaaaagaaaccaaagacataaaaacaagcattgtcctttttactttttctagaaagtccttcctgactaggctgaagaatacatgacaacaataaacaatgttcgcagcaaatttctatctaaatttatcttctatatttgaatttgaataggaaaaatagttaaattcctaaaaataggaaaaaatagttaaatacatattgcaacatttcttactgggtaaataatgggaatgcaaaacacacattaaatttttgattggtgttcttaataaattgtaataacagaattattggtttatgcatatagaacaatcattataacatttctattgcatttttgtattattgtcctggatttttctctaaagtatggatttaaagagagtctgttcaaatttatttatttaataatccaagctcaatattcatactcattacacaaataaaaaaaattttcctaatcgtttttaaatttacaatttggaaggcatcagcctaaaaatacaatgtaaaatgtatgtatatatgttcaaacacatatatacacatactccaaaaaagtctaagaaatgaggttataatgaattcatctacaatctgcttcaagtatcaggactttttaaatgttttcaatgagattatgcaatatgacatacagaaagctcctgtgaaattttatgattgtactatagttgacaaaacttatattgaaatattttcatttcattaacaactgtaatcctcccatttgcatcaatatattcattgttttctaaagttaaatgaattaaataaatattgtccttcaatgatagatttatatgcatgttttattatttattctaagcttagtgtctgtatttttgcatacttaaatacatacataaatattttaaaattcaaagtcgtgaacaaagaaaataaaaattctaatatctttaataaatgatttatgctacaaataaaagtaagcagcgttttatgtatttagtagataatttcagcaccaatcttgtgcaaggtgttattgtaagaagatatgtgtcaggttctactacaacaaaacttactatagccaaaatgcatttatccaaaattatagctaatcagtatcccagctgtagattttgagctgtgtattcttcctctgaaatcttgccactgagtacatatctgggtcacctttgcaggatgtcagttgccatgtggttagggaatacaaactaattttatggagtccaaagccaaatgtaaatgagttctggatattcagcctttttggataatatttatcttaaatgataaataaaattttgactgtatagtaatataagaggtggacatgggtgttagacacccacatttacacgcagggcctcagaaacaacaatgcttacgtttttctaaatggttaattttagcatccatccaaatgtcagttagcctgtcagtgaagtgaagctgcactttcagtgatgtccgtgggctcttttatacagtgctaacatttgcataaaaccagcttttttgtgccttatgtttccaaatcaatttagttttgtgtgctaatattttattagagccctggagataaagaagcatgcaggtcagccatgtgtgctgctcaatccccaaaggaaacctctactaaaaaccaaaagattgacaccagacaagattaacaaaagaattagtcatgcacaatcaactgtgttaaatactggtggggggagggggaagcatcttcttctcttgtctttcagggtggcgtgctaatgcttccagtgtatattattatgtgcttctgagtgtaccattgttttctacaaaggtggatttgttagaaacaactatcaccattactttaaatgctactaatgaggtgatcacgtaaaatcttcaatcctctgtgctatttaatcctagacctacaccaagggagcttctccctaaggaataaaacagtttggtctctttctcagtctggggctgaataggcttgagctctaacctcaaaatactacataatggctgaaaatttccaaactgagcaatcaatgaacaaaaatattcaagaagtaaatcctttccctaaagggcttattatctaaaattgttggttaaaacatagaaaaaatattctatcacacagttagacagcattcacgttccacttctgaaaaaaaatggggatttgtttacagttctttatatattgtttaatgttctaaattttaagatctcaaaagaattataactaaagtatgaatactttaaaataaatatttcttcaaatacctcttataccatttaatatttaaaatctgaatctggattatttgaggggataattttgttgttactattaaaaaattaaccagagaatagaaaagaacgtgatgtataaaaaggtacccctttacgtagttttgatattttgtgttcagtacgacttttttccttcttaggtccacatcaagaaaatacatcatttcaaatgaagtacctattataccaattgtgtggtttcttcttgagacaataccttcatttctactcaaagtctacaggaacatagctaattgtcacatacattggatttagtagtttcactgattgagcatatatgctatgcaaactgttggatattttacttttattgtttatttaagtcttattcataagtctatattacatttgggaaaattagctcagagttgttaataaacgtgccccaattacactatgaaaaagtagaagcatccatgtttagataaatagtgtgaacaatgtgtgttaggcaggataatgtctctgccaacagatattttccctgggaacctatgaatatgttactttagatgacagatgataattattaacattgaagatacatttaagtttgctaatcagttgatgcaattaaaatccaattaaggctactgatgaaattatgagatcacccaggaatatttcagcaggcccaatctaatcacatgaatccttaaattgggggaagaagagggagaagaaggaatcagagagagagagatgtgctttttcaggttttcaagatagaaaaggaccaggagccaaggaattgaggcagcctccagatgctggaaaagccaaggcaatggtcagattccagaaaggaatgcagctctgataacaccttgcttttaggctagtgagacctgtggcaggcctatgacctacaaaattgtaagataagtttttgttgttttaagacactgtatttgtggtaatttgttacagcagcaatacaaaattaatacaaacatttgtaacatgatttcctactttcttaattattttgaaatattgtcaggcaggaggaagctaggaaataaggcaaaaaaaaaaaaggtctggcatgtcctttaaacgtcattggcccacccatgggcttacacaattaacttagctgaccaacattttactattagtaaataatgaagacttagtgaagtcacatgttagcttttagatttcactccaagaaatgccagttaactattgtatgattgaaaatataattccaaggtatggttagtggcctctgtaggtaataaccagtttcatatctaatccagcaaccttgtcctgtgattgcctctaaatgcctagcttctcaaatgctcttggaatggtattaacatgttactggttccctcattaattaataagccaaaatatatttgacaagtgttcattttatattggcatgatagtcatgatttcgtccttttgaaaattatgctttatcaatatcaactaaatgaggagtcagcaaactatggcttctgggccaaatctggtctattgcctattcttgcaaataaagttcctttgaactcagccaggtgaagtagatccaaatgcttcacacaggcatattctttcttaagttatttatgtaatttcacatgcattcttattagtagaaaactaagttggtcactaaaattgttaataaatttcctcagttttaggcataggatcaaaactcgtttctaactttcacttttcttgctctcctgaatatccacctgtaaaccagtggttctagtcctgagcatcaggaataaagagagagcactgtgttgctgaatcctttgcaatggaatgctctgtgtggctgaggtatccttttttgtgggtagagagtgcattattcataagcatacatttactatcttagtggatgtagatcccatctggcttatcttgaattcagatctgtctcttgagctctggatccattccaccaactatatataaaatatctgtctctgtttaaatgtgttaaggacatcttactctcaaaaaatctactaatctactactaattttaccctgcccccatcctaatttaattccatactgggcaatcacctttttgtatctaccaaagcccccaaaaactcattatccaagagaaatatttgggaactggcctacattttctcatatcctttctttgcatctgtaccaaatacgtggtggttcattctttcctccccattcatatagtagctagttgtttatattaatgtcataggaatgaaaagagcaaatggaggcaaaaagaataatagaaacagtaaagcaagagtggggtaaggataaggatggtgtacaaaatgcatactgcaaggtccttcatggtttgctaaatgaggttcacattttaagaattatctcagaggaataaacatgatcagtttacattacttatagactccataagacacataggcacaactatttttcggcatcaaaataatttttttctcacattatttaacgagacatcattgtataataataaagacattatataggaaaagtttgatgggactctttctcattatatttcttaaataaaccttgtgggaaaaaagaaaaaaaaccctatgggattcatttttatcatgaatttttatcataattcataattatctgccaagaatttcttatttctccataaaggctattttatttttggtgatatgttggataaatgaagaatgactaaggatcagaagtcacagtccttgaaaataagtgaattgcaaatatattatattaatagtcatcagtgatcagtatggctgatcacatgttgtggtagttgaaaagcttaataaggacacttgcctaaaaagagactttgttgtgtaaagaatctgtcatatttgccatcttttatctttgcacctctatactcctgcattattgctcttatctcacctatgaaaataacagaagtttctgttagatatgttttcctattcagtctattctataagtatacccagagtcatatttctaaaatgaatatttaatcataccagtctttaaaattctcaatggtttctagtccctgcaggtccacggataaatatgacacccaaagctctacaaacatactggaaggtgtctctttctaaacatagcatgctgttccatgtctgtgtcttaagttttgagtctttgttctctttctgctagataaagttctcattattcttcaggatataactcagaaatctattcctgcataaggagtaagcacataacttagtctttgaacaaggaatttttttgagagtgaaagggtgtacacaatgattacacaagggctccaagtagaagtggactgggcccactggtttgcatgatcctcctgtttatgccacatctgtgtatctatatttactatcacatgtgtcacatatgtctgtacacaatcctagctacacatttcttgagaatattcccttctacagttcaggtaaggatttggggctggagattaaaaaattgaggattatcagcatagagatggaatttaaagttatgaagctttgttacagtacatgggaaatgagtgttgatatagaagaactcaggagaggataggagggagacaagacagggagtgagagaaaaggaataaagaggagaagggatcaagaatcttagatatcataaaactgagagttcagaaagatgagaaataaatacagtagtaaagaagagtgggaaggactggccagtaaagtgaaattaaaccaggggagtaaggtgtttctgaaactaaataaagaaagtgtttaaagacaaagactgagcattggatattggatttggcaacttgaaaatcattggtggcttttagtcattgatgagttttggaggactggatagggggaagtctgatgagaaggagaggaaaaggagttatggaacaaagaaacttctttgaacactttattaaagaataacactaaagttagaaatgggagtggagtgagatagatcaaaggagattgctcagtaattattttttaaaaagacatgtaataggataggtatgcatgaaaaataatgttatgatccaatcaagaagaaaaacttaaagatgcaataaattatcattgtactgatgttacagtataattatctccattttaatactaacgcacttgagaggagaaggcataggaagtgtataactcttcgaattgactaaactttttcacacttatttcatttcatcctcaaaacaactctatgaaatctagtgatgttaaataactagcatagatgagaaacaataaagctaggctccaaacccaggcagtccagctctataatctcacactacaaggccagaatgagagaaagaaaaagaagcacagaaggaaaaactacagactttttcctgtggccttttaatgtccaaggggagacaaactggaaaaatacttgaaaattcatgggcacatacatatatcaaaaaatatatatatgtgaaaattatattgatgtatatagttgaaaatatataaaggatatctatatttaaacaaataatatagtaattgcaaataaatattataaagttgatgttaaaagaatagacaacaagtaccaatctggatgacattaataaaggcaattttgatgacattaataaatgcaattttgatgagagaatacaatttgagacagattgtccaggaaatagtatcgtagattggccaaaggataaaataggaggaaaagcagaaggaggaggaaggggaaggaaaactgggtgggctataccactccttttttatgttgtttatattgttattgactgttcaattttctacaattaatttaaaaaacagcagaggattctgtttaccctgcaagcctcggttatttccaccccttccctccacacctctccctccctgcaattaacacaggaagctctctcctaccatcagcctaagtcaatcccatcttttcccctctcctcctagataattccttcccctcttgtttttttcattaactacataacccttaacttttgcttccagcataatcttactcattcccttaagaatcattttctcactttcccacaccaggtgacaatttctacttaggtgtttacatagcaccacaacaccactttatactaatatataaatttatatattatacaaatgaactctttgagggcagagctgtgccttatcttacaattctcctttgactggcagagtgccttgctcccaagaggtgtctagttaacatttgttgaaaggagattgcgaatgaagaataattcacacactagaaattggagttccaaaatcatatattcacaatcacctgtcatgtccacttggatctgtcacaagcatttcaaacttggtatcaacaaaataaggtcataattttcttccacattcacctccttttattatgcattccttcatttaatcagccatccttgcatgtaacatttattgagtgctgactgtgtaccaggctgtatttcaagcccttgggaccaccagcaccaataactaccctgttgctccaagaaaaaccctctgtctcctactttccctcaccccattccccaatacctaagtcaccagcaagtcctactcattctatcctcaataaatcctgaatatgccaacttctccacatcaccaggtttactcctttcacctaggctttcatcatatttaattactgatcatcctaatgtgtctcctcacaaaaattctaatctcctttaatccataccctgtagagcagaaaaataaaaattctaagcatataattaaaacatgttactcccctcctataatgcttcaaaaatgttgactacatttggatcaacatcttaattatttcctgtaagtaccaagggccttcatgatgtggtcctccaatattgcctcacttattttgctagcaactgcaacccaaacactgtactcttctttcatttagtcaaacacttcaacccaggtcaaactttaagtcattgcctgtgacttttcctctacgtagaatattccttactacactcttcattgggaaagttctctattatcttttagagttcagtttaaacatcacccactaagagaggtattttcttactacctcgtctgaaataaatctacattattcttcatttcagatctttgtttctttcatgacccatacaacaatttgcaatttttgtaattatgtgttgtttttctgttctgccccatgaaggtgggaactaagcagattgagtactttggtaaatttttgttcttaacaaagtgctaaagaagcttaataacatgtttttgaatgagtgaatgaattaatgaaaagaggaaggaaaagaggtagaaaggaaggtaggaaggcaaaaaaatacacatttatagttttctgcttacctattaaaaatccataaaatttttttttatttttctatgagcaaaattttatgaccatctcattgtataccagattgtatactgaaaaaatagagatagaaaataaaatttgaatgtagaactttattatgcaatgcttatgtcaaaacaaaatttttaacatactgtattacactatgtagaatttattaaaattatacagagaaggaagacctagatgcattgatacaaatcatacatatatttaaaatatatttccaaacacaaaaaagaagttaatatgtttaaaaactgcaaaataaatagttaatatgtactcagacagaggcttccttatttaaattccaaacatatttgagtatataaaccagttccaataactgcttataatttcaggaccaatttcaaaatactgctctcattgtctgttttcttactttcaaattaatacatagctacatattgaatgcttacaagtagtgtgtggtgctaagcgaatacagtttttgaggcatcgagaaaaagtcaactaaatggcatacatttatatgtcaaattgggtagtatgatactttatcaaattgcaaaatgcatttctgctcaaatactcagtttactgaaacatttaaagaaatttgagaaagttagtgatctgttactagactctcttccatttggaagtaatcagtagaggttttatattttctcagcaatggtaaaggcacgtatgaactgttgcatacagaaacaatgttaaaatgcataatgaagattggattttcatatacacagagttcaattttacacatattttatgtttcccttttcatattgtgagcatagcttaggcaacagaaattcagtgactgcagctcaataggcttgacttatttcttcttgggggatattcccaccatttgaaggcaaaagtacttctcttagaggcactagggtgggattcagggagtataatacgtagagatgatagcttagagatttagggaaacatgctctatattccttcagagatccaatgataagatgtagagccagccaaagaatttaaggccaggccactcaggctttcctacggaacagtattagtatggaaaaggaaatttagttcaccttattaacatgggcaaccagatggaaatttgtcatgcaattctcatttactcagcaaatatttattgatagcctgttaaaaccaagcactgtgttaggctttaaggatagaaagataaatgatactctcaaaaacttcatgttcagttgaaagttataaattgcatgtaaaatcacaggacactgtgagaatcatggagagagccagctatcccaaggaggattcatagagaagtatacacacacgtgtaatattaaagcatgattataaaattagccaattcaaataagggaggggagagtggaggatgatgctgaagaggtatctcaggtgattctgaccacataatgaaacctggaatctggtaccaggccataaatttgtttttacaaagataggaagaaggatacagccagtaattttataataattttatgtttttattttacttatatatgctaattttatgatactctgaaaatctaacttatttacatatatatataatagcaataaggatataatgaataatactatcatattattatcaatttattaaaatatgatcaaaataatagcagcttacatttattaagctctttgtgataggcactgtcacactaagcacagtaatgtgcttagtacgcattataaatgtattcttaaaaaagaagtgaatttaggtaaatttgcacataatagtgacagatcagagaaaaataaagctaggaaaaagtagttaaggcttcacatgatcaataggactttgtcaaatagaaggatagagagtgatatggtttgtatttgtgtccccatccaaatgtcatgtcgaattgagggaggcacctggtgggaggtgattggatcatggggaggaatttcctccttgctgttctcatgacggtaagtgagtcatcaccagatctgatgatttaaaagtctgtggcacttacctcctctgtctcttcctcctgctctatcacagtaagacgtgcttgcttccccttcaccttctgccatgatagtgggtttcctgagccctcccagtcatgcttcctattaagcctgtggtactgtgagtcaattaaacctttttcttcataaattatccagtctcaggtagttccttagagcagtgaaaagatagactaatacagaaaatttgtacttggagtggcacactgctataaaggtacatgaaaaagtggaagtgactttggaactgggtaatgaacagacattagaacagtttggagggctcagaagaagacaggaagatgtggggaagtttggaacttcctatagacttgttaaatggctttgaccgaaatgctgatagtgatatggacaacgaagtccaggctgaggtggtctcagatggagatgttaaactttttgggaactggagcaaggccgctcttgctatgctttagcaaagagacaggcagcatattgcctctgccctagaaatctgtggaactttgaatttgagagagatgttttagggtatctggaagaagaaatttctaaggagcaaagtgttcaagaagtaacatggctgtttctaaaagtgtatgctcatacacatgatgaaagagatggtctgaaatttgaagttatatttaaaagggaagcagaacataaaaatttggaaaatttgccaactgaccatgtggtagaataaaaaaatcatttccctggggagtaagtcaagcctgcttcagaaatttgaatgaataacaaggagtcaaatgttaacagtcaacacaagggggaaaatatccccagggcatttcagagatctcccctcccatcacagaccaagaagccaaggaggaaaaaatggctgtttgagcaaggcccgggaaacccttgctctgtgcagcctcaggacatggtgtcatgtgtctgagccactccacctctagtcatggctaaaaggggccaatatgcagcttgaattgttgcttcagagggtggaagccccaagccttggcagcttccacgtggtactgggcctgcaggtgtatggaaggcaagagttgaggtttgggaacctctgcccagatttcacaggatgtatggaaacacctgtatgtccaagcagaagtctgctgcaggggcagagacctcatggagaacctccgctaggaaagtgcagaagggaaatgtggggttggagacaccacagagtccccactggggcactgcctagtggagctgtgagaaaagggacactgtcttccacaccctaaaactgtagatccaccaacagcaccgtgcacctggaaaagccagaaacactcaatgccagcccatgaaagcagtcgtgggggctgtaccctgaagagccacaggggcagaactgcccaaggatttgggagccaaccccttgcatctaggcaagttctcactattttgctcaggctggtctcaaattcctggcctcaagcaattctcccaccttgcctcagcatgccctggatatgagacatggagtcaaaggagatcattttggagccttaagatttaatgagtgccctgctgggtttcagacttgcatggggcctatagcccctttgttttggccaatttttcctttttgtagcagaggcatttacccaatgcctgtacctccattttatcttggaagtaacaaacttgcttttgattttacaagcacataagtggaaggtaattaccttgcctcagatgacactttggacttggtcttttgggttaatgctgaaatgagttaagactttggtcagggggtactgttgagaatgaataattgtattttgctatgtgaaaaagaaatgagattcgggagggaccagggttggaattatatggtttgaatttgtgtccctgcccaagtctcatgttaattgagggaggggcctggtgggagatgattggatcatgggtacaggtttcccccttgctgttgtcataataagtgagtcgtcaggagatctgatgatttaaaagtgtgtggcacttctcccttctctctcttcctcctgctccaccacgctaagatgtacctgcttcctctttgcctctgccatgattgtaagtttcctgaggcttcccagtcatgcttctttttaagcctgtggaactgttagccaattaaatctattttcttcataaattactcatccttagctagttctttatagtagtgtgaaagcgaactaatacagaagctttcccaaagaataaaaatacaagaattcacaagaatatgcaagacacattttggaaacaggaaatgcccaatgagactgtgcattgggaatagggaagggggcttacatgtaatcaggttgaaaaagcacactgagtctaaattattacgctatatgcctttgttatgaactgcaaaatgtatcctgtgacctcagggtttttacttttttaaccaagtgagtaataggatttcttacaaagaaaacatgaagatcattctgaaatttctagcttaagtcattatcaggatgatggataaagttttcacagtacattcttgaaataaaaagaaaaccaaaatcagaagcaacaaaagcaaaaatagacaaatagaaccatgtcaaaattaaaaatgtttgtgaatcaaaagggacaatcaacagagtaaaaggcaatctgaaaaaatttaaagaattctaaattatatcttacaagaaattgataacaagagtttttaaaaacttctaaaattcaacaacaaaagataagttaaacttcactaaaaatggatgaaggaattgttagatatttctccaaaggttatatacaaatagccaactaacaaatgaaaaaatgctcaacatcactaatcatcagaacaatacaaatgaaaaccacaaagagatatcacctcacaccgttaggattgctactgtaaaaacaataacaaacaacatcaaagcaaaaaataacaagtgttggcaaaaatgtggaataaatcagaaccctgtgccagtcggtgagattgtaaaatgatgcaacttatgtggaaaatagaatggaggttccttggaaaaattaaaaatagaactaccatatgatccagcaatcccacttgtgggtttatctccaaaagaattgaaagcagagtgtaaagtgatatttgcacatccatgttcataacagcactattcacactagccaagatatggaaatgactcaagtgtccatggatgaataagtggataaacaaaaagtgacatatatatatagaatggaatattattgtcttaaaaggaagaaaaccttatctcacattataaagtgaaataaatccgttatcaaaataaatattgtatgattctccttacatgaactatctgaaatagtcaaattaacagaaacagaaagtagaatggtgattaccaggggttatgcagagggggtaaagaggagttgtttaacaggtatagagtttcagatttgcactatgaaatggttctaaagatctgattcataacaatgtgaatgtacttaagagtgctgaaatgtatacttgaaaatgattaagatggtaaattttatattatatgttttgttaccacaatttgaacaaaatgtcaaggaggtcaaagtgaacaatattagcatttacagattgcaaactgtagtgattagaaggattaataaattcatatgtgatcaaataccaaaatacttttcttgctctgggttaaattgtaaaataggcaaagtctttccagcattttgtcactttcctatattacctccttctactactcctttctgtataaactcaactcttagaaggaatgcttcatgtaggcttgaggcttttattttgatttaaaaggctatgtaccttatttagtgctctatgatgacccaatgttctatatgtattagacatattttagttttaagagcatgatttcagatgagatcaatgctcatctcattgcatcacacagtattcacaatcttaaactggaaacacacagtcgaaggatttggtttagaaaagcctgtaagaacacagtcactcatttataagatatgaactatagatgacaactgtaatctttttaaaggaatcctgtgtgtttagctatgcacatacctatatttatatatgtgcatacacacatatgaaatatttataattttgtaatataacctaagtaaaccaggtaggggttttcaacagcctttatatttacatatgtatatactccaggttggatgtggtcttagtctgctttatgttactataacagaatacctgaggttaggtaattaattttaaaaaggggtttatttaactcatgattctggtagctggaaagtccaagagtaaggtggtggcatctgttcagcttccactgaaggccccgtgctgcattaagatatggcagagaagcaaaaaggtgagcaaatgtgagcaaatgaggatcaaacatgaggaggaatctcaccttgtaacaactcactccctaagaagctaatcaattacaatgagatctaatccagtctcatgagaaaaatattaagccatcttaatgatttaatcacctcttaaaggcacaacctcccaacattgctgtactaggaatgaaagtgctaacttgagtttaggtaagaacattgaaaccagagcagactgttttgaaaagcaagtgttggcattgtatacctgacacatattaggctgtagattataatttccacactaacttgttatatgtacacacaaatgaaatataaatatcatttataaattgctgataaattaggaataataaaataaataaaaattatttcagtttagatgcacacaataaaaataaatacagacaatttaaataatgtgtcagctcaattgcaaatccagtcctttgactccagttgttcctttagcctaaataattttcttgattattcatataaattaatatatattgtgctcctacatatgagttgactgcatgacaaaaatggctttttgaaactcaaaagaatatttgagtagactatagttctaaccaccatataatttacctgagtttaagaagaattagatgctaccttccagtgagagtatgtgtgtttcttatcactatatatttaaaatatgtattatttaaatattaaaaatttcccaatgcttagacaaaaataaagtcccaagagcaattcattgaaaatttatttatatatttttcagccaaatcttcgttttcttagaagaatccaattacttggatcctttcaaattaggaactcttagagaatcatttgaggagactggaccttttccccacaggtcactattggactgacctctgtggaaacaagtgttaagaaatttgaattaagccttaaaatacgggtaacttcaaaatattaaaaaatacgtattttaagtctaatttaactaaaatctccgagtttctctgattattgttgcattaattcattcatctaacagtatttttagtgtcaaaaatatatcaggcactgttagatattgagaatgcaaacaggcacaatatagaaattgagaaacttaagacatagtatgggagaaagacatttgaccatattacgtatcatataagcactgtgagaacaaattaagtatgagttcagttggaaaacaaggaatggtcaagtgtttctggtagtgggaagcagtgcttgtgacagaaaatactgagatgctaaaaagttttctgagccatcgcagacaagtaagtatttgataccaagcactttatccactatggtaaccactagccatatgtgcctattgagcatttgaactgtggctagtatgactaatgaagagaatttttagctactattaatacatacttaaatttgaacagctaactttggctaatggctaccatattaggcagtagaactatacagaactgtgagtaattttttatggttaggatatatattgtatggtttaaaggtcatggtgttagatgaagaggtagacaaaggcaaaatcttagagtgcctttcttgtcatgtttaagtcacagaaactaagtaggatgaaaacaaaaaagaacattctagatttattaaatgatcacggcgacataggcaaagctagtttgtcatggaggattagacgcagaaaccaggatttagtagattaaagaggtgaatggaaagtgaggaagggaaatcagcaagcatttactattttcaggtatgtcagcataaagagaaagagaaataaaggaagatgggtttgaggaaacaagtgtaaggagggattttaagactggggatactggagaatgttcatagatagtgggggaagtcagaaaaataggtaattttatagaatataatattaggttggattctagcagatttagtgaaaaaacaacacccataagtcaagcagacagcctataaatggaagaagaaatattctctggataaaacagagagtaaatttacacagaaataaatttgtgtatagatattgagaaagtttagtaggtttcctctgtgataaagaaaacaaatattaagatatacctaagcaagactggatgagactgagagtacaattctggagggagtaataaagattcagataaagttgccaagaataatgaaggtagaaatcagacagcaatgtttagagtccaagtgtatcaagttctcagttgtaatatcaacagatacttgtagtctcaacacaatacaacgttgttaactaagtttaagagtttaaaaaatttaaatgatggcggttttacctggtattgtctagaaatagagttagtctataattgatatattaggattacttaatatcctgttttatcacttaataaagactatgttattgaatttatatgtttataaaaagagtttattaattcagaatctacatgtattttaatttgtcttgtttagtttattcccaatgcaattgtgctagctcatttgtgctgctctatcaaaatatttgagactgagtaatttataaaaatagaaatttatttcccatagttttggagtctcagaaatccagtatctgggcaccagcacatttattttctgacaagggtctgttctctgcttccaaagatggcaccttgttactgcattctctatacaggagaaacatgtgtcttcacatgacagaaggcagaagggcacaccagaccatttccctctattaagccattttatatgataacctaattctaatcataggagcagaaccatcatgactcaattacctctcaaagaccacacctcccaatattgttcaacataaattttgaaggggacaagaacattcaaaccaaagcagtaactgacccttcatattccattcacataacactcagtttcttattggaattacatccaaaccctatagaatgacacaatgagtcccaagatagatctcaacttcttctccttagcactcttcaatgtgaataatataaatacttttccctcataacaaacttacttaacatttctgaagatatattgcaatgttctgccctatcaaatatgctcctgctctttttttccctaatgtaattccaaattgtctttttctttggcaaaatcatacttatttgattctacctaaaaccacacttttcaaaacactcaaaggacactcaatttaccgtaattattattcaaagtgttttcctaaacctgtggtatttatagactgtcttgaagtatgtcatccataattgtggacatgtatagttttagtgatgtataggctatttgagggtcagtgtcactagttgtaactaaaaaaattgaatttttaaaactactgaaaatggaacaaaataaaaatacagattaattgtccttagcttataaatgctggcaaattcacatatttattcctttgctagtaattttgctgccattttaaattgtagttctcatcaaataagtcaataggtttcagtaatatctagaggttaattccaatgctaaagataaattcattatacatcttaataatgaagatgatttgaagtaagctttcttaataaaacttcaatgcttttatatttactgcaaatacaattataagctataataataggcattggataaaagacctgaaagaatattgcaaattcataaggggttgtgttatcgtgatgggatttcagatacaggcaaaagaagacattttactgtgagagacagctatatttgaatttcagctgtgtgatcaagtagaaattatttagggtctctgaatttcaattccctgttaaagtcgttctcagaactaaacgtgttagtgtgtgtgtgtgtgtgtgtgtgtgtgtctgtatatgtcacatactacatatatctgaatatatgtatatatatatgtcacataatactaaaggaaatttaattattatataatgtttagtattgtattatgtttacaaatacttttatttacatttgaaatatcattaaacagagaaaaaggaaaagacctaagatttttgagaaatcctttaaaaatatccaatggatgggcttaacagaagagtgaacaaaagaaggaatgagtgagttggaaaacaaacaaaaaaaatcacacaatctgaacagagaaataactagactgaaatacaacataaaaaagacttgtcagcagtaaacctaccctaaatgaatggctaaggtctctaaatagcaaataataaaagtaaaataacaaaatttgaaatattagaaggaaaaaataaaagagtaagcaaaaatattaataaatataagagatttttcttcttaccttgaattttttaaattatggttgatggccagagtaaaaattgtaacactggttgtaaatatatgtacagaagaaatttatgatttactgtaaatgcaggggtataaagggatataaggagaggtaaagtttttgcaattcagctgaactgctaaaatgacggcaccattttacatgtatttatatataatatatgtttttatatatgtaaatgcacatagccgtgataaattatgtaaatataatgcaatacctagagcaaccactaataaaactgtaagaaatacactaaaaatgcagtatataaatttaaacagcattccacaaatatgctcaaataaacacatgaaaacagagaaaagaaaatgaaaaacaaaaagagaaagcagacttacgtcctaacatcaaaattacattaaatataaaagctctaaatacaccaaacaatataaagagattggcaaagttgattggaaagcaggactcaaccatttgctacctataagaatcccacttcaaatataacaatatagccatattaacagcaaaataatagaaaaagcagtatcatggaaatatttatcaatggaaaacaagagtggctatattactatcagataaaatacaggtagtctcagatttacaatggcttgacttatagtcttttgggtttattatggtgcaaatgcaatatgcaagcacaaggtttcagacttcaagcatcagtgattccttgaccaaagaccctctgagctgtatttttgacttacaagattttcaacttactacgtgttatcatagtcaaggagcatctttagatttgacagccaagaaaattaccagacgcagaaacggacattatatataatgatatagggaaaatccaccaagaaaacatagtaatcttaaatgtgtatgcaccaaaaaacaatgctgcaaatttttttgtgtgtaaagcaaaaactgattgaactggtaagaaaaatttttaaaaaacacaattatcgttgggagttttaacagtactttctcaacaactgatagagcaactagatggaaaatcaataagaatatggaacaactcagtaacactaccaattaacaggatctaacttgcattcatagaagactccagcctacaagagcagactacacattcttttcaagtaaccaggaaacatatgccaaggtagatcatattctaggcaatacaacaaaacacaactaacttaaaatatttaacattatatagaatttatctgtaactacaaaataatcaaaccggatatctataactcagagataaaagaaaaatcttcaaaaatgtggacactaaacatcacatttctaaataaactgtgaatcaaagagaaagcctcaagggatgttttaaaaacacattaaactaaatgaaaatgtaaaaacaatctaagaaaatatgttgggcaaacaaaagcactagagagaaaaacttacagtaccaaacatatgttataaaagaggaaagtctcaaatcattgattaaattcacacctcaacaacctaaagaagagcaaacaacctcaaagtaagcagaagtaagtaaataataaagaatacatgccaatgaaattaaaaacagaaaatcaataaaacagaaggatttttaaaaaatcaatagcattgaccaaaaaagacaaattattgacataaggaatggaagatgaaatatcactaaagaccctgaagatagaaaaaagtagaaaatactatgaatttacaatcataaatttgataacatagatgaaactcaccagatcctcaaaaagcacaaattaccaactgtaaaatatgaaattgtgctatagtaattaaggaaataaaaagtataattttaaaaaaagtccagaaaaagacttcttcaagtttaataagtacaaatgcttttgctgaggaattctaccaaacgcagaaaaacaacaccaattatacataatatcttccaaaaaaacagaacaggagagatttcatgactgattttattaagatagtatcttttgatatcaaactagaaaaaaactatgccaaaaaagaagaaaaaaactactaatcagtatgtcaatatccctcatgcatacagatacaaaaattctttaaaaatattagcacataaactcagtaacatatttttcaaatatgataaactaactggagcacattctaggcatacaaagctggttaaatatttgaatgtcaatcattataattcaccatatttacagactaaatgataaaaattttatacctataataatatcagttaatgcaaggaaaacacttgactaaattcaacattcatgatttaaaaaaactcagaaaaaaagaatagcagtgaactttctcaacataacaaagaacattaacaaataacctatagataaatttgtacttagtgctgaaaattttctataacatcaggaacaaggcaaaaatgcccaccctctccagtcattaaaaacagttgtagctagtacagtaatacgataaacacaaaggattaaaaataacatttgcagatgttatgtttctcttcatagaaattcctaaggaatctacaacaaaactcctagtacttcagcagggtctcagaatataaaatataaataaagaaatcaagtatatttctgtatatgagcaaaaacatgcagatatttaaatttaaaaatacactaccatttgaaatcatacaaataggttgaaatacttaggtgtgaacctaacaaaactagtacaggaactgtatcccccaaaattataaaatgctaatggaagaaatcataaataactaagtaaatggagaggctgtattcatggattggacgactcaacacaataaagatgtcaattttttctaaattgatttatatgtttactgtgatatctatagaaaatatcaacatgtttttattatagacatagacaaacttaatctaaaatttatatgaaaagacacagggactacaatagctaaaattattttgaaaaagtagaattaaatggatgaattgttctactcaatttcaagtcatgtgatatagctatagtaatcacaattgtgtggtattgtcagaggtacagacacacagatcaatagaacagagtagggaatccatcaacagacctacacaaatatgccaagtgatttttcaacaaagctataaaagcagttcaatgaaagaaagataaccatttcaacaaatggtgctagagcaactggaaatccagagtcaaaaaacaaaacaacctggaaagggcagtagcagggagaggagctggggaagtagagatggttaatgggtagacacatataattagaatgaataagatctagtatttgacaacacaacagagtaactacggtcaacaataatttactgtacattttaaagtcactaaaaaagaataattgcatcatttataacgcaaagaaagggtacatgcttgaggtgatggctacctcagttaccctgatgtgattattacccattgtatgcctgtatcaaattatcttctgaactccttaaatatatatatatatatatatatacctactatgtacatgcaaaaattaaaagtaaaaataaaacaaaagacaaaatcttaacctaaatctcacattttatttttaaaaaaatcttcaaaatgagtcactgacaaatgcaaaatataaaactataaaacaagttacaagttacagcctggggaatatttgcatactatatatccaacaaagattaatatcttgaatatataaagaactctcaaaactcaatgataaaacaaacccaaacaatccaatttgaaaatggcaaaaaaatacatgaataaacattttactgaaaaggatatacaaatggcaaataaacacacaaaaaggtgttagacatcattagccatttgggaaaagcaaattaaaaccacaatgaaataacactatatatccaccagaatggctaaaataaaaaaacagtaatgcctccaaataacagagagaatgcaaggaaactcaatcacttacatatcaccagcggaaacagaaaatggtacaggcactctagaagacagtttggcaattgctaaagaaacagaacatgcaactaacatacaacctggtaattgtgcttctgggcatttataccagggacacgaaaatttatgttcacacaaaacctcatatacccaatagccaaaactgtaaacagtgaagatatcctttaatgagtaagtagttaaataaactacagtacattcatgtcatcaaatgctaatgccagcaatgaaaaagaccgaactattgatacatgcaaaaatttgcatgcatccccagggaattatgctgagtaaaaaatgtcaatcccaaaaaattacatactttgtttccatttatacaacgttcttaaaatgacaaaattctagaactgaattgattagtgattgtaagaggttaagtagggggctggggtgggaatgagtttggctataaaagggcaatataaaatatcctatggtgatggaaaagttctgtatcttgattatgtaaatattaacatcctggatgggatattgtactatattttgcaagacattatcattggtagaaactgggtagtggatacatgaactttctctgtaatttttcttaaaactgcacgtgaatccacaattatctcaaaacaaaagtttaatttaaaaataaaatgtgataattatttagttactacttgggttaaaagggttatttatagttatttttattattatttattatataattattacttattatttataaacctgccaatattagatgttaaagttaaagcaaaataatacatttttgtatattatgagatccttaaatatgttctcagcttcagagactgcagtaactatatgtaaatttctctcagtcatcattgttcccaaaaatctggtaatggtatgtttccttttagagcttgccctttcaatttctagttagttttgataggatcaacaatcataatattcgccaaatctgtgccccacaactctgctggccatagagcagacaggcattctagttatgttaaaccaaattgttttcatttggaactagaattttgattaaagatgcacagatttataacttgtactcaataattctcgaaatatcctgtttctcatatttccggaaatagtctggctcttttcaaggcttagatgcttagatctgccgttaattatgttcattatccaatattcttcaaatacatttttttttcttatttgaactactcagatctgttttctgttgctttcttactctgtgccccctagtaagcaatagaaaatttatctggtccaatttactttaatgccttatgtccctatattaaggcgcaatatatattaatttacttaacaaatatctaaagagactatgtgtaaggccctggcctagatgctggaatcagaaaacaatcaacaaagcaaaccaagtcatacaatcctggagcttagtaggggagaagagaaataaacaaaaataaaagtatagtattatttacaaatataaagattgtgagaaacaataaaactggagattgggaaatgaaagtgatgataatactgggctttattttatagaaggtctatcaaatgctgtaatatttaatagagccctgaggggcaagggtgagtgatttgtcaaatgtctggggaaggattttccaagcagagggaatagaagtgtctgtgtgcagaactgataatatacttggcagggtggaataatcccaaaggaaagggtggggtgcttggaatggagtgggtgttggggagtggtaggaaatggaccagtgaggtaacaggatctgcagaccatgtagaaatttgaaggctattgtaaagacttggcctttttcaagtgagatgtaatgcaatcacagtgtttgagatgtagtggccttacaaaatgtattatagcaatgctgtcatgggattctttttatgataattttatcacaagtgttttgagtatctctgcaagtgtcaatctaaacacagtatcctattgttacaagggcttatgaaatcacatgggcctattttcaactgtcacaattctctcctttcttcttaatttccttacctttttatcattagtgttgccatggaaatttttactatttgtcatgtatcataattgtaaagacgtattttgcactaaaatataaattgatggagagtaatattagtattatatttatcttggtagtcaaccaaaggtataatggtatttttataccagtttacttaataatatcttattgaaatgaatgaataaagtccaaaacattgtatattacctggtttattaatttctgccttgttttgttcaatttagatttccattttctagattggtacatgacacagaggaggtacttaataaagatgtctttatggataaatgaatatcctcattttgcagatggcaaaaatgagtccctattttttccctatattgactgctgttggccacacaggcatagttagtgggagagaatccatgtgaaacagtttataatatattgtatttccactgaaataatttatctattaactctttcaataagcatttgttgagtacaaattaagtgcttaataccataacaccatgaccaaatattttatgaggagaaaagatgtttttatttctcagttaaagaacctgaaacatagcataaaatgtaaatatataatgtaaatatattaaggtttatttgaagtgaaattaaatatatattaacataactcaaaaatatattagagtatagaaaatgaagcccaaaagcaaaacagtgaatgcttattgtgtttcctcttgtcaaatatccaggaataaaaaaatgagtgtatactgtgtttgtcagcctcaatgtaaccacatgcttcatggggggtaggaagtgacactttaatatgagatcctgtctacatgtaatgtgaattgtgcccctggattttgcatttcattagcctggagaggtaataagagtatcagtgacacaacaatatgcatactctgatagatgaacacatcatttgatttacactctagctcaatatatcagagaatacacttttaaaagcctaactggaatatatgaacaatgaaaaatttaatatcaggattgggacctaatttgaataattcctaaaataaggtacattttattcaacatttggaagaaggcaaagaatatgcattaccaaagaaaaagaagaccttcaagggaaggtatgcaagccagaatgaacaaatttgagtgggtaaataataaatgtggctggaaaagaagatctggcactaaaaacatatattgcagccagctgactgatgtcattttatttatactggccatatacacgaaaacatatagtggtttttggtaatatgaaaatcttagaattataaagcattaggaatatgaaaaagattatgaagtctccagaaatactgaggtataaggaataaaaagtgttccttgctagttgataaaaataaattcatgtataataaaaatcagccagggccagaatctctgtgaatttaattaatgactaaattgggcatactttacttaaaaggtgatatgcacaactgagcacttgcactgtgtactactagaatgtttaactatgtcatggaactgaaatacaacatgcaacattatatattttatggccttagcagcctttaaatatgaattatttagtatgattaaaatcactccctaataaataaactaaggtttgcatatgctagcatttttccttacagagaaataaaaggaatattattggaaaagaagctttctatggttgttagctatttttttattttagtttatagcattttattgagttctgtaagagataatggggataaagaaatataagacatagactttgccctcaaaaactatatattgcataaaagttttcattgtctcattcttctatctggttgcaaaacttaaaacttactagttgactttgccacacttttcttctcagaacactctcttcttactttcaggatattatattctgtcggtctttctgatgtctctgcttttttatgatcttagtattttggatctctccattattgtaggtctttatgtacttcagcgcttttggatgtggttctgaactcgcttctcttcccagtccatatttcaaaagctcccctagatttcaactccagctgaaacactactgttctgttctcagctcaagatcaatataacttactctttttggtgtgagtaggtgtgtggaggggagagggttgtgtttactttgccacttggctgtcttaaaggtgtctctgtttcgcttccgtcattcctcatttcaatgaatggtccatttacccccacttgtgttctcttccttgataaggccttaccattcacacataacactcatgaataacaaatctttgttaattcccttcctaattatatctcaaactcagcacattattacctctccctctgatcactcttatccaagccactagtgtctcttgtttagaacactacatcacttcctcccagcccctagttccctgtattcttggtcatagaatctttaataatgcagttacaattcttatatataataccttacactcccactttctcaaactatttagtagttacccattgctcttaggataaatttaaaaaatctttaaaatgacttgcaatgcctgatgcatattctcatttctaaagagttttatatccatatcttccattccacagcctctcactattccaaatgtgccagatatttttaattcctcaaaaataccaaataattttcatcttatttttcatcacatctttattccatctgcttaaaatgctctctttatgaccctacctccctcctcacagccttttgccatgtcatctttatctatttactcttcaaattaaagtctgaaagtcatttccttcagttgccttccacaaccctgcggatcagttatatgctctcgtagaatactgtatcacttcctcatagctcttatgataaatgtaactgtatcttctgtgtaattattttatttatacttttatctgcttattctacacttcagtaagctccataaaggtacagaatattcctgttgtgttcacaactatatttccagagcctagtacagaaaaagtactcaacaaatagtggcttaaagaatgagcaatgaattaatacaaaaaacactaagcccaccctgatactatcaacttggcatggccctatgtggaaattttgacagagtacatatttaaacacctgtaaaacaaaacctgtaaacacctgtaaaacaaaacaaaccaagagttttgttggtttcttcatgcatgttacagtaatagattttaccttcataaaaataatccaaataattgtatatttataaaaaacagaactaaatataacactaagatctcaagtgaagcaacagtatttactttaattacagttttctaaagatttctacaggtataatcagtatatacatgtttatgcacacacatacatatatacatatatatgcacatatatacatatgtgaatatctgcaagagacaaaataagtaaacagtgtccggttaaatatgttgcaaaatcctgaaaatgtgtattttatggaatcaagatcaaaatcttctgaggagcaggtaaatatttcagtttaattgaatgacaaaatttaggaaagagaggcaaaattccaaaattttccattaaatttaaactcttaaaggggcattttatatttttattcatattatacaaacatctaggacacggaaaatgctcaccataactttgtagcctctgactgtattttgctttctcattattgccacagccaaattcctaacataggacatgtgatctggtctctgcatctgcatctttcagattcattgtcttccctcattatttttttacttactaatacagatatactatgcaatcacttattttctacttataaaattgcactgcttgtggaaaaattcaaaatctctgctcaagatattgttaatcaaattcaagaccttctttttgagatacaatgcattattttggtttccttgacatgtatgcaattccccacatttccaaagctttgagatattttttcagagaaattacttaaaaataaatctcaaagtctgactgtgcaatgtcaaccagacccaagtcttgtgattgtacatggtgtaatcccaaaatttacttttagctagtgaatgaaaaatggtatatttctctaaaatataatttaactatttataagggaggaaactcctttggtaataacttgagttttcacatatgctatccctcaaaggttcctagaatctccaaggtgtaacagctgtgaagccatctgtgagctgaatcaagttccaatagcaaatgcatgccatcaatacagaaattcagccaaaatttaggattgggtcagaattcattagtaaaacactgctactttcctaacaaataggtcaatctgcattaaatactctgaaaatcattatgtgagaaagatttttttttcaagcaacaaatattttcttaggacaattacaaaattaactagttgtgaggagattcattcattcaactaatatttagtggtggcactgtaataggcagcatatctatagtaacaaagaagacagaagtttcttcctctttagcatactctacagagatatacacttttgtataatccactccttgagtgtgagaagagcctgtgaatacaatggtatatcacttttgtgataatttttgtattttatggcaaaagggttttgtaggtgtaattatggttcctagtcaactgactttaaatttaggaaaaagattatccttggtgggcctgatctaatcaggtgaggtcttagaagtgatactatgcagcagcagatcctctactgttgaacttaaaaaagcaaactgccttgttaaggacagtgttaggtggcagaaataggtaggctaggatctgaaagcctcagtcttaagctataaggaaccgaattctgacaatcaataatcttggaagatgaaattgcagctgttgacaaaaccattcagcctggtggagaccctgagcagaggatccagctaacccatgcgcatattcctgacctacagacactatgagataatttttgcttttgtcttaagctgctatgtttgtagcattttgctatgcattaatagaaaatgaatatgggaaaggacaagattttcatgttttattcttaattgctaataaatacataacacattgtattaaatataatttattcattaccactatatgtattaatgccaataatttaagtgtcaggattgaacagatcaggccatgacaagtaaagaaggggaatagtattgtaaacaatttagaactgacatcgttctttcggttctatatctgtatttgtgacattagcttcttggatgagtataaaatctgaaataagcacagtccatagcaaaatcaaacattaaaaatgtgcagaaaatataggatttcataaaatcataatcagggaatttagcacataaaaattaaaagatatcttttgagagatcaaataatctcccattaatcaataaataaatatttaggataaaatgttagggatcttagtaaagtaagtcagttgaaaagtgaagttagtaggtgaaaaattccatatgttaataggttcaaagttatcacattgctctgtgattcactaacacaataccacattcacttttctgtttcagccaaatataatgcattagttctcatctttatgtgaaatactattatctattttctaatctttgtattgaatgttagccttcacatatattcattattactatcttaattgtattattgtgctaaaggttcatttgggaagccaatggaaactctttgagtcaatcattgcaattgttacattttaagacaaaacaccagaaatatacaaataatatgcacagcactgtattaaataataataacataatatgaaatattgagaataatataaacaataggaatgacaagaataatacaaacaaaaataatggcaagaataatataaacaataatctaaacaatattaatgacaatataaaatagcaagagacaacatatttgcttgattttaaaataacttcagcagaagtttctcttcagtagaggaatttagtcagttttataaccgacatattttgacagagtattgacaatagaatcaaacaatgttcttctacagacactttgatgtagtgagactacctacagagtcaagattatttaaaattgcagtttatttctgacattatcttatgatatgattttgagaaaaatgcctaacttctctgacacatattagaagttttgattatgcccggttttgtcaaaatataacaggaaattcaaagcattactggtggaaatataaccagatgtggccagtctgaagaacagctcagaaatagtcaaatctaaaatgcatttgtaactatgaccccacagtccttgagtacatttccagagtaacttttacatgggggtttttagagtatgaggcaatataggtgtccagcagtgggaccactatatgtgaaactacataacatggtggtacaaccgcctgaagagctttttaaaactagcttaatcctcagacactctgatccagtccacctgggaaggttttggggatactagatgtttcatccaagattgtgaaaccaagatggagcaagtagacaaaacttaaaatcacactactgagtaaacagtaagaaacagcaagagatctatagcataataccacttatgtaacttttaaaagcatataaacataaaatactctctatttcacgaagatacgtaaaaatcaaggatatggaacaaacacatttgagtggttccttatatggggagatgcatagaaatatggaatagggattcaagacaactcagtatacacatattcacacgtgaacacctgcatccgtatgtcttgtagtgctgcaaaaaaagtttggtgacaatgttccaggagtaagaaacatgattaacccaatcccttttaacctaagctttaaatagaattaacaacaatgatataaaattagtatatgggactagttaatctttaaagctcattctagtttatagcatgcatttttttctctaggtagcatttttcaaaatacactttgcctggttaaaaaaatttgacttttggctgtgtgcagtggctcatgtttgtaatcccagcactttgggaggccaattgagtggattgcttgaggccaggagtttgaaactagcctggccaacattgtgaaaccccatccctactaaaaatacaaaatttagctgggcatatgcctgtagttccagctactcaggaggctgaggcataagagtcatttgaacccaggaggcagaggttgcagtgagccgtgattgcaccactgcactccagcctggacgacagagtgagactctttcagaaaagaaaagaaaacaaaacaaaacaaaagaatacaaaaggaaaagaaaagaaaagagaaaagaaagaaaaaagaaaagaagagagaaaaaagaaaaaagaaagaaaaagaaagaaagaaagaaagaaagaaaagaaagaaagaaagaaagaaagagaaagaaggaaggaaggaaggaaggaaggaaggaaggaaggaaggaaagaaggaagggagggaaggaggaagggagggaaagagagaggtacggaaagagaaagaagaaagaaagaagagagaaagaaaggaaggaaggaaggaagggaatttgtctttgcatcactcacttccttttcagcctgaggcactttctttggttggaatctcatctattatgtgagaattcaatagataaagagtaatatgccaagatgcataattattataagaggcataattaagggaacaaacaatgattgctttggagtaggaaagacttgataatgggcagtgggactatgataaatgttttctaacatttgaaaagccttcatctgttacatgataaaaatatgacacttacattgtttggcaacaaatgattcagaggcaatctgaatcactagatggaatttaaaggaatttcagttcaacataagagagggtttctatttagagttgtccaaaaagtgaaagagttgccattaaaggttgtgaattcacagctgcataagtgttcaaaagtagtgggggtgcaacagaatttagtcaaatgttgatgctgctcatataatggttttttctcaaattgagttggatcaaagctattctcttttgactttctcctctacacacgtatttggagtccatggtaaaaaatgtatgccatttttttcttcaagattgtttatgttcataaatactgaattagatgatttacaagatttccgttaagcttgtgatggtatgagaagaaaaaaaacccatccagtgcatgagtcagttatcacactgattatattctgaaatagatatcaatttcaaaataagattaactacatcccaataaatggtaagtttggtgcacatatttaaattatatactttgatgccaattactctgtatagttcttttttatttggacctgtgttttcacgtaatttaaaaaattttatacagaacaaattttatgtacagagatgagtaagttatttactgcttttaagaggaaaattacctacaaaaccaaatacttacaaaccaaaacagtttaatagtagtgtaattattttttagtgggtgattatttatagaatgtctgaatgtgaccaacataaaaacattgcttgagaatgtcatcaatgttttggtcactgaaatttattaaagaaaaccgatggcatcaaaattggaattataagactgagatttatattcagaagacctgagtccaaatgcatcactatcacctaaaatgtgtgacctttgaaaacaatgtgttttttttaatctctgaaattcattttaactcaacaaatatttattgagtaactactatgggataagtcctgtgtacacagaatacaatcttagggagctcaaaatcttacagtagagctgcctatgtaaataaactcttgtattcagggcagtagaagaatgaatatagtgaataacagaagtaaacatattgcgcagttgctgcagaatgaaaagatgcatagtgcagagagtggataaaagaatggaatgctgaaacaacaatagctacttcagagctttggtaaaaggatgaaaagaggctaggcatgtttaaatattttgtatactgtatgtctttcccatttgatggagaaattttggaatgtgcaatatttgtcatatccttcttttctattccttctgctgccataactgttaagctcccgaacaattcacatgtgaacataagaaatataaatttgtctattttgtgtcctaatgatcaggacattttcctcagaaagttaaaataaatgtgcattttctttccttttaataaacaagctactttggggactggcagtgaagagaataacagaaaatgaaatataataaactatcttccaaatctttgcctgagaccaagcaagactgcaattaaagtaagaataaaaatttaatagttactgtaaagcaacaagtaaagagtgaaagctattactgaagtgtgaaaagaggctaccttttaaaggcagacagaaaatgattacaacctaagtgtcctgtaaaaatcgccctaatcaacaattctgttagtacttgatccaggaaccattctccagttccttaattgtaaataaggatgacttcacagggcaactgcaacaagagtccaatggactagcttccccaagtataacgcttgacatatacatagaaattcaataaaagttagctcatttcttggcctttatttttgtatttgctgaaataattattgcacatactcatggcagttttatgaaacaaagaataacataaattccaatagtaaaactattaagggtgggaagtgcaaaatatttgaagactttaagataccatcctgagggcaagaccacagggtcaagtattcaaggtaaagatcatagaacaaaagggggattgaagtagaagtacagttggaaaaacaaatctatatactgtgaatatatatttgaaattaatttcaacgaggtaatcctgagaacattataattttagatatcaaacagcttggttatgttggaaaaatgcataactaagatcatgttggttctgaaaataagttcgttcctaatatgtatggtagaaagtttaatacagatatattcagtatgtaactgatgaatactgagtgactaatagcaagatttaggcttctcagtcctccagctggcagagatatgcaggcaatataaaaactgttggaaggtggatacaggaagcctttcagctgctgtggttttctataatgattctgaaagtttctttgtttttttaattcctggaatcaagagttagagaatcaggattgtgggtggtcactcatttgctcaatttttttttcttttgttttccatcattaagtactttacagctgggagcaagacaaaaagcaacattttaagctgtgctgcctaaatatggcttagaatagaaaggtaagcaaaaatttctaggaaaggcacattactttattaaccttataagaatcagtgtgttattatctcactattcaggtgcctagtgtgccaaatagaaataggtggtaagttaaattggatacaactgcaatatctctacataagctatgatcatatggaataacttaatacttctctgacagcagacatttttaatagaaacatattttatagaatttttcctttatatcactcataatttgtaattatatgcttatttgaaaatatctgtcttctttaccagactattctcttcgtgataatatgaactatgttgttgttgctttatatatctgtatccccaatgcctagcatactaaaaaaaaattaatatattgttagaagttcttgtctactctttctctttttattactgtaatttcacaatgtctgctcctagaagtggactactctattctgaaggatgttagagagagaataggctaagcatagtggttcacgtctgcaatcccagcattttgggaggctgaggaaggtggatcacatgagccaaggagttggagaccagcttgggaaacatggcaaaatctcacctaaataaataaataaataaataaataaataaataaataaataaataaagttagccaggcctggtggcacatgcccatagtcctagatattcgggaggctgaggtgggaggatcactggaaccagggaggttgaggctgtaagtgagcctttatcgggccacttcagtccagcctgggtgacagaaagagattttgtctcaaaagagagagagagagagagagagacagagacagagagagagagatggtttgtttgtattgtatttaggtagggttaagagagtacctcaaacccattagtttactaacaaaaataaaaacaaaactgcaagtgttggtgaggatatagagaaattgcaaccctgctgaactgttggtaggaatataaaatggtgcagtcactatggaaaatggtgtgctagttcttcaaaaaattaaacatagagtattggggtttgctatgcttaggattcctcagctgtgacataaaccacacgtggtactttacgttgccttctggtactaaaagggcaacttgagcaagaagaactgctttgactataaagctcatgctgtttgctgtgctttgattaacaaagtcccttgtctctgacccaagagtctcatgtcttttgccagcttctatgacactgtggcaggctgacttctaagctgtcaagtagagcaaaatctcataacagtctcctttttcttttttctttttgatttcttcaaaggtaaatggaatacttctgtgtgctacaatatgttagtttttcatgtgatacagcttgccaaaataattaactttgaaacaacattatgtgttgttaacacttaaagttacttagatttttctttctttaaaaaatcactaaatccactggacattgatagagttgaagaaaacaatggtacattttatacgatttctatgtttgcatttcacatttcagaaatagctgctcaaaatgcagaggtagttaaattttcagaggatgagatatgtattataagcacagctctctctgaatacataacatccttatgctgaatttaaatctaattttgtgacagctgtaaaaatggctacctcgtcaagaagagcaaagaaatcaaatttatgctattttctgaaaagttacaatgctaaataaagcattgttctgaattttaaatcataacatttccgcctctagtgaggttcttgggaaaacgcgattctttaggatatacttataaatcacctttcatcatgaagaattttgaaatcatttcaaaatataagtaagtagaaaaagaagggtggaacttcacacagaaagtatttgttcaaaaatacccagaatagaaaaaaatatacattgctaccagcactaagtgtgctgaaaattctgattgaataagtcagatttgtactaaaactacattatgccaacagttccagaccaaaaaaaaaaaaaatgtaaagatgggaaaaagaaaacaaaacaagaagcagtcagcagagtccagcaggaagaaaggctgacatcactaacgctaccatgagtgtaggggcagcaaaaggagacagaaatatgaaccacatatatgataacggaaggtcctccatgcatgtatgataaggttcatgaagtacatgtatcataagggaagatcctccatgcaatatgtttggcttttgaattttacttttttcaagtgataaaatacaagataataaaataaaatagaataccatcacttgaattgactctgtcaaagttcataattttcaaattcagcttgcaagaatttctttcttggaacaaattgaaacagggagtgattattttctttcatcccttcaaaagttaaaatgcctatccctgaatataaatgcaagcctaaacttacagatctttttaactatccactttgggaacagtatgaaaatattatactatgaaaaggtacatgatcagaatacattttgtattctgattctgattttggtttatatatatttttgtatatgtgtatatatacagatatagatatagatagatgtacatgtatttataaatataaaattttaaatgtacaaacgatataaacaatacagatatttttatacatgaagtagcaatctttcttttgcaacatttagggggaaatgtgacggaaaaaataaacaagacggtgccaaatattttttgaaacctagaagggttttctaaacagtttttgttgacattactcaagcatctttgagatctcttagtgtactagtcaatattgatggttctttttaagataagaaaaggaaaggccttgttaggaattccagacaaaataatctgttccttaaagccatgtggtgagtataataaatgtttacaaatatttttgttcatcttctaggcttgtgttaggcttgtgacttctctacctttttgaagtaattacagtcgtgtgatttctgatttgtgcaataaaaatatgtataatatgtaaaaatatgtaagatatgtagaatatataattatatatatttttgtgatacatactttaagatgtttatagacatataaatatgtgtttgtgccaatattggccaataaaatatgtgtgtatactttctggcacttcctgaccaaaattcttaaaaagtagtgcctgattgccatttgtattttgttttctttttttctaaaatagcaattatgggaaaaaattcagagttgggccattacaaccctgagttctcctgtgactacagtaagtaaatctctcctgcccatctgcatttttctgaagcaattaagcaactaagtttgtcaggttattaccgtgtgacctcatatattctgataagccataattagtcaatatttacttattaaaatgaaaaagatattcaaggtttcttcatatgtacttctcaagctttattctttttcctaaagtcactttatctgaaacatctccatagaaatccattataatatctataggatttaacctgaatttaattaagaaaaatcagtgaaatagactgaatttctcattaaattattaaactactcctcaataataatttgtcctaatagttgatcagttgattaactctgtgggatataaattgattgcgttattattccaatgatgaaaaaacaatggaagtggcctctgttcactatccactctggctggcagccaagtcagaatatatatatatatatttccaccaactcccataagctaatcaaaacactggtgctcaggaaaagtaacactaaaaactcatatgtgaaagagtaaatagatgatggtaattgacacttttgtaaataacaataagtgagaaatatatcttacatttcctgaaaacacaaatttatagaaacaagagttttttaaagttatggaatcaaatgtttttgattgtttatatgtatgtatgactttgtaacaaattttaaaggagcataacttgtgaagtcataattcatattataataacaaaagaaataatcttattatttttcttctatattaacaacctagaaaagactcagcagttctttaaaattataatcaataatgatgttttaaatgcatggcttagatttagttacaagagtggaaatgatggtaatatatttttaagtgttgaattcaaaacgtctaacgtattcaaggtgttcagtcataaggcaatattttaggcatttttacactttattctactttttaaatgtttaattttatatttaactatttcctcatctatggattatatattgaagaacagcttaaactagaaagaattctaacttttgatagttggtagaatgtcattgtataaaacaaactgatttccccaggacctttgagtccacagcctataaataaaaataaaacataactcatggtattcattaatctaaaatcaaatttagttaaattttaaaagaacgcataaagataaattattcaaaaataactgaactgttccctttggggattatttgatattgcttaggaagcaaataataaatccgtcttccatgaatattctactccaacatgcctaataacattctttggtctctgaatattacctagaattcctctcattttgaaagaagtcatctgaaatatgatccaggaatcatatgtgctatattcaaggggacggatgttgaatcaaaatacaacatgccctgaaggtgctaaaatttatggggaagaaaagatagtcccagaaggaattaaatctggcctttggttacaatgtttgaggaccaactgcagcatgtttctaaattcatactagttactaaggtcaatataatagtcactacaatttttccttgataatgggaattttagtctattctctgagcatcttcacatgccaggagatgaatccggatttatctaagtcagtgatgatagattcacaccaaaggcaagtaattggtatagcattgcttcaatgaattcaaagcattttgtgtaagaagaattaccatcattggaaagttgcaaaggttctagaatatcagaaagctgttacagaaaatggttctggtttactaggttgtaatatctattccagtgtaaagtttggcaggtttttaaatctctactagctttagtctggatacaagaaaggatgaaaatcataatacctaattgataagtttttagaaatgtaaaataaggtcatttttgtgttatgcttaaaattatagtatataaacttaaatatatgacatgctattattattgttgaggtggcaaatagaaactttgctcaactgtcctccacttctaacataactttttgtggtctgccaaaatggagaacaaacctatatattgctggtgttctctctttttatgatagatacttttaccggaacagtatttgccattatgtcataagaacatatttactgtctctaaaaaaatcaaatacacttaatagtttacactagcttagaggataagttttagactcttttgtctgagtttccaaattgttcaaaatatctttgaaagatgcttgcaaccaatcttctcacttgaaattgtcacctcttttctctacatttatctttatcagccaaagtcaactcacttttagttaccccaaataaggtgttactttaccaaaattattaacacttatataactctacacgttatacatgactaaataacatttgttcctgaatcctagaaagtgatttttttttcaattttcacccattgaaacatcttgaaaggtcaagaaagtgttttatgaagagagaaaaagacaaggaaagattactattaataaatgttaaattgaattaaagtggagcagaaggacactggctcaagagtgtaggttgttataaaattaaaaatgtttgattgggtggttggtgggattttatttaaggaaaaatgttaagcctttatacaggcaaagattagagaaaaaatggaaagaggaagttgtataatcaagacaatgtgaaaagaagaataacaatagcggttaagaacttgtcactctaggccaggcgcggtagctcacgcctgtaatcccaggcgtgaggcaggtagatcacctgaggttgggagttcgagaccagcctgaccaacatggagaaaccctgtcgctactaaatacacaaaattagctgtgcatggtggcaggcacctgtaatcccagctacttgtgaggctgaggcaggagaatcccttgaacccaggaggcagaggttgcagtgagctgagatcacgccattgcactccagcctgggcaacaagagtgaaactccgtccccacatcaaaaaaaaaaaaaaaaaaaaaacttgtttactctaaccaaatttcttgaattccaatcctagatttaccttttattacttgtgtgatgttgcactttaaccttaacagtggctcagttttcccatttatataatggggatctgaataccatccactttatagcctgggtgcaaagactaaaagggttgttatacatagaatagttcaaaaatgtctctggtccacagagagtgcttattaaatgctagagataaaaagagagaggcaatacagtataaacatataagttattcttcaagtctctaacaagattaatactcttcacaccacgttaaaattttcagatgcctttgatcttccatggcattatatttgtatctttcttagaagatggagttttactccttactagtatgtaattatttatgtatgcttcccataagctataaaagctcctgaaaatcagcaatagctattgacctcttctccatcatcattcaatagatatttgttaaaataatacaaatataataaaactatgttatctctcctataatatgaaaatctgttgctataatattgatatcttattaacatttcagccatcggatgctgtgttttgaaaaaacatagagataaaacaatagaatgcccaataatttttttgaagttagtactttgtaatgtgatgatttttaaaatatgcaactgcattgtcaatgacctcatctccgttgtttagaaaaaaaaatttgatggaagatacaaggattcagcaacaaaagccattttagaaagagctgtgtgtgtgagaaatgcaatcatataacaacttcagaaaagcttgaaattaatgtctgatattatatttataactaaaaagttattagaaattagtgctaagtataaatttttttgttaactaaattaatattgaattttctatataaaatgtgaaaatatataaagaaacttattctagaaattaggcatccattaaatattaaactgtagaaaaaattaagataatattaatgcaaaaacattatgcttttgattctgttttcagatgactaacttgcagggcaaattccaaatgtatgaattaacaaagagattcaaactttgaaaatatataaaaattgggtcagaactaaatttagacagttgtgttatacatcactcatacttgaccagtgacattaggcatgtatgatttgattttactgactctgtgaatacaattctccaatgcagttctccatctacttttcaatacaaaggcattgtttatatgtcagtaaaaagaggtaatacaaacctgacctgagaagctaattttcctctcatattactaatattgtagataatgtagctccttaaattatactgtgccttctttgcgttgtttagctaaagaaatatttcattgtccagtaagtttggttttcatcagaaattattttcttttactttgtgagactataaactaatcgtgttttccagatttgtttagggtgtaagaaaaataaaagctaaatataatgctgattctaacaaagatacaagaattcagaacttgacttttgtaaattaaccttgctcttggtttcatcttactctcctgttattttcttttattatagtttgccttaattccactttatgttatttagctacatatatcatattttttgctgcatcaactgcttttttagagttagctataaattaaatattaatagataacaagtggccttaataatttagctttgaatactatagtaacttcaacaaatgtcgggagcagtaaatggaaattgccttggtcaaaatataaggaattagtgcaaaaaaaaaaagaaaaaaaaacaattcctccctgactccttaaatatttaatgtatttagacccagttttacatacataaaaattatggagtaaaaagaaaattatttattttcttttgaatcagatatgcaatggaaaaagcctaagaaaagtggttataaaaagcctttagatttcatgcacatttagaccaaaaattagagtttttgaaggcatccaagttccagaatttaaattctgttctctattattaatgatatgaaagaactttcatcactgaatggttcaaccacgtatatcttttacttaacttcctacgttagtgagtgatcaataatattacacaggaaaaaaaagagaacaagaccaaaagtgtacaaagtatccctccccagtgattgctgtaaaaatacctattactatgctttcttagcacaaaacacaaaggacttttcacatggaatgagtctactaaaatatgtgtcacatagcattaaatgtctttggtggctactattctccttcctccattggtttattctaattcattttgcttcgtctttagagtggtggctttgcaaagagcaaaagaataccagatggtcattgctgtggttcactgagtttatatcctagcaggaagttagatgattgcttttcaaggttcttatcatgcattgaacagtctatttcaccacaggggattctgaagctgtcaatatattcttggctaagcatgccccatcattttctctttaagacatgggcctatataatcatatgaatgctttgtggacgcaaagataatataacttgtctttccttctacatattgtggaatgtagatttgtgttagaaatgagtatttacttaatgtttataaaattctgttttaattttgggaacaacatcgttaaactatttgttatagcttcttcaaaaatgtaaactttccctaaacaatctggattttgcatttagaaaatttactttaaaattcttatttgtcaaaacaagtaaacaaaaaactccaagtaaacaaaagccttcccagaaacaaaagactcaaagttacacagaatttgtgtaagcaatgaagactcagttgcctcaaaaagagactgacgtttttctttgatttaaaaaatacacagctgacatttttctaggaattgcacagaaagagaatgaagttaaaatcattccatcgaagaaataaaaatctctaaatttacactatcgtaacatataatactaaaaaaatacacagatggtctctttatcgtcaaagaaaatggattagtttaaaataagaatgatagatgaaggaataaaaaacttgaacaatagagtaaaccaacaaaaatgttttagctattgcatacaagatgaggggaaaaagtaaatagttgtgtgaatgaaagaaaacacaactcacaaatgcaaaatggggaacataatgtaagtcaatgttaaatatatggctgactgttgccatggtggggtcaagggtgatggcaggataagaacaggaagctttgattttcttccttgatcataagaaacatacataaggccaacacatattgtttatataagaacaccagtggatctttttgcatgaaattagactatacacagttagacaataacccagatcacctttcaaatacaaaactcccatattcaaatacaaaactcaatagattgagtttcatgaggcctgtagctgtttcattaatcattatacttagaaatgtgacttgtgtgtagtgagtttttaaaatatatgagtttatggctgggtgcggtggctcacacctgtaatcccagcactttgggaggtcgaggcaaatggatcacttgaggtcaggagttcaaggccaggctgaccaatatagtgaaaccacatctctactaaaaatacaacaattagcttgatgtggtggtgcatacctataatcccagctacttggaaggataagccaggagaattgcttgaacccgggagatggaggttgcagtgagctgagattgcaccattgtactccagcttgggcgacaagagtgaaactctgtctcaaaaaataataatactaagtgaaaaataaagtaaaatatgtatgtgtttaattattgaatatacttcaaatgtgagaacttccagacatggataactcagaaatgctatgttaactttggaaaatatattttcaaaaacgatgtctaatacttgctgatccacacctaatttttagggtaatgtgaggcttaaagttccttttaatgctgaaaaaattaattctactgcctgtatgatcccagaacctagatacatccattctctggtacccttagtttttcagtacttcatacctcagtgttattatcatattcaaaaatataactttacaaatgactcttagtatgtttgtcctcttttggttgtgaacatgataaaaataacgtagttattactagttgttgaataccattgattaggtattttacatacattaactaatataatccttatcttaatactataagtaagacttgcccctagtatacaagtgagaaaactgaggtctaaaaaattaaatatataggttaaggttttatatcttctcagtggcagaatatgaagcaaaccaaggcttttattagtctagagtctactctttccagagttcttgactatcttagttttttaaatattctccactatttctgaacccaggcacatgtttaactgtcaatagatattttaaatacgataaatacaaacgtaacaagtgatagctattacttctataagatttttaaaataattgacttttatgtgtttggaactaattagatagttttgagcaccttctatgtgttaagcattaaataaatttttcaaaactatcatttaatctaatttctttaaccttcaccattctgaaataagtaaaaatactcagtttttgacataagaaataacacactcaggtaatacatggcagaaatataaatcaactcgtaggtcttctacccctaaagacaaatcatgttgcctttactccatcactttagatactactaaaacagtctaatcaggacatgtacgttattttataacacaaatgtacttttcaaaacaagattaaggtgcatgatagggctattgagtgttgatctgactgttgattgaatagcctgtattttccagggagtgttgaagcagcaccaagtgacctgtgacacttgtgaagttttccttgtggattgacatcactgcaattttgttagcaggctttgagctgataaaataattccattaccaaacaattcatgcttaacttgcttgttctttaaaagacatgcacaacatgttttcttcattagcatcaaatataactgctcacattaagaaactagatctctatgtgaaatgacagctaatgaaagctgaatgtgcccaaataatattgctcagatactggcaagtgtggtggtggaactcaaagtctgtgctaaaacattttctgaaataatatttaaaataatatgtttgaaaatgaactcagtcaaaccgtcaatgcttcaatcctcgaaaagaacttttaatacatggttcatgacatttttatattcaatagtgcatttgagtcctttcttctttggcgtaaaagaggttaccactgacgctactctctctgtgattcagagagttacaataacacattgtcttttctgggagtgggtttaagaaaaaaggagatgacagtttacaatggtttgtaataaaatgtttttaaaaactacagattttagactggacgtggtggctcacacctgtaatcccagcactcagggaggctaaggcgggcagatcacgaggtcaagagatcaagacctggccaacatggtcaaaccctgtctctactgaaaaaacaaaaattagctcagtgtggtggcacacgcctgttgtcccagctacttgggaggctgaggcaggagaatcgcttgaacctgggaggcagaggttgcagtaagccgggatcgtgccactgcactccagcctggtgacagagcaagactctgtctcaaaaaaaaaaaaaaaaaaaaaaaaaaaactacagattttagctacaaaaaatgctaaaaaataatctttacagtgaatagataaaactgggctttgttttgattgagtacataaaatcttaaaatatattttcattttggcgaagtacaatttattattatatttaagcactatatgggaatgaatagaaatatggcaccaaattatttttgtgtcttgtttcaatatagtacttttcagttttctttaagttagttttatcaataaccttatctattatttatttagtatcatatttctgatatcacatttcagcatttactcatatgtaattgggacttactatgcataaaataaatgacatttttgatttcctactgcctttgtgaggtaatttccagatacagagcagggaacaagcaaacataataaatatcctttcattaactaagtcactacttctttggaggaattttggtatataaaatttaaaaaattactaggctaaagcttcctacttctttcttctccaactattgtcttttattgctcagcccaattccatgttttggtattacattttgatccagaaaattgttgatcaaagttttttggcaggagaataatataatatggtgacaaatcaagctgctgttcttatttcatcagtcatttctctaacacattgtggaaaacagtcttccaagaataaaacttggaagatttatttttctttgtcaaaggcaacagtttcctcattagcccttttgcttagatgtactgtaaatatatggtttaggtcactcagcaataatttaccatacaacatctacatcactaacatccaagcttctccaaaaactatctcacctgtcagatcacagtaaactctgtcaacattttatagcatcacatccccttattgatcagtcctttccctgagccctcatatgcattccaagttctttctttttggccacaaatatactcaaatcatcaatacaatataccactcttttaaaattttctttggttaatctaaaattcacatttctaatttagccatatgtttcctatgactgccttcttaaatcttaatatgttaactcttccatcaaaagtatgtgtctcttttacatacaattctattagtttttcctggggtatgtgtattatattgccattctgaatgcaaaatataattatgaattttggaattgttaacataggaatagcataaccatttcacctcatctgccacttcatctgtgagaactgggttaagaaggattctaaagctacatcatgtgccccaggtattctcattcaagacttggcgcataggaattaggcttcactttgtacagaatgttgcttagcccagcagcaggcagttagttgacttttacaaatactaccagatggtgttgataaaattcatcctgcctgtgaacaaacacaaaacctttacaccataccctctaggttgatgtggaatacattttttcttaattaaactaccattgttaggaagcatcaaaagaactctctacaagcaaaggtttcatcaaggagagactctacgtaaactccagggaaagcaatgagtagatcattacagagtcatcagccccctgcaaagttataaatgctatcaagtggcaaagaaaagcagagggaaggcatgaactgagtagtctgccatcttttctttggaaatgaatgacaactacacacactgcatatacagtactccattctttaagttttaatgaaaaaaattggttagtgagagataaatcacaccttagaaagttagatcatgtgctctatgaagtatgacttagactctacctttagccagtgaatattagtaacacgtgagaactaattttgaggctggaaaggaaaatctgtactttctacatgaattattgtttcattcaaaatgttcttgctctatatagtttgtatttttagcaattatctgtaaaatcttctcttaaagcgttgtccctagctgaaattccttgcactcaatgggcgatattaataccttccttatcaagattcctagcttactctacagattctgctattaaagcaatcatcatacattactgcaattacttgattactgtctgccccactggaccacaggttcttaaaaacagaaaatgtgtcttaatcaatcttttgattctcagcacataacataatgctttgcagaaggaaggcccttaataaatacatacaaatcagtaaatttattcattagttttacagctgaggagaaaaaaaagtgacctgggtagactaaagttaatcaggtagcattttcaaaaatagtgggtgccaattttgatagattttaaaaaatcatagaagttagagtggtggtcaaatcttgctgggacctgggagtgaagagtagggaagtaaatactctggtagcagagtttaaccctgaaactaaaatggcaatagaaaaaaaaaaaagcaatagaagcattggttttagggttagatttgaacagaaggacatttgatattattccatttcaaatttgtctttgttgactgtatatcctttctttagggaggaaatagtaacaggtgctgaggaaaagttggatgatagagctaacataagtaataaattggtatgtaactgatgttttatgaatgctattacattaaactctaacaggtttatgattttggtatgtctgcctctctcttcatcccagtatagctaaaaaaaaaatagcttccaaaataattcaattattactctaagtccatagtcaataagtggcagaatcagtattcagaataaggcctttctgattccaaaggctattgtctgaattgagatgaaggaacctaacaacagagattcattttcaggcagtgttgagaatgctccattgaaatctcttcaaagtacttcttagttttaagtgtcttactacttggtttttaagaatgttaatatgtctctgatttagggagttttatggttttttttttaaagactgcatttctgctgatttccatataatattccatataatatccaattcctccaattataaagaaaagttcttaaacagagacacaaattattttggtgatgtatcaaaaaggtaacaagctcaggctttggaacctgagagaatatttcagaccttgcttctttaccacagcccatttgcttttgggagacatttctccattgaatgctcatgtttctgcatatcttgtgagcacaggtaccagttatcctgcttttttgtacctggttatccttctgtacagaaaatagccaaggagaatatagtgttttccaccagagcaaaggataactctgcttacagccttgagagacggagatagtgctccctccagaggaaagaatgggagggcctactgcccattataaaagagtcaggtttctaagctcatggttcatctcttataataccatttagtatgttgtgcaggtttctcacactcttcatgccattctatgagaattagggcttgggaaactggcacaaatcctgctattcttgctcctagtgctgctgtgagtaataaactatcctttatttctgactcaacagtcttgtgtttttcatcaacatccataaaactgtggcaaagagttttaacttgaaagtagagtaaaatgtcagaactcttcatagttcttgatgtttaccagctgagtaatctagagcaattatttttaaatatctgagcttcagtttcctattatagtgaaatttaagtgataatgcttataaatttcatagtatatttatagtgcttaaataaatgacagctaatagcagttattcaatattagtagcaacaccagcagtagcagtaatgatagcggtaattgtggtagccgtagtagttgaagcatacgcagcaacggaatctaacattgaaagaatgccaacatatagcagacatttttactaagcagccagtgtagcttatcttatttaatcctcacaagaaatggaacaggtgttttgtgttttgttttgttttcattagttaaatgaggtaaatgagactcaaattgttgaactgattttcctgaggtaactcacatggcaattgacaaagctgggataagaagcttgttgtgtctaattaccaggaggttgtggtgcatgtatttgcagtgacatgtttgggaggaagctacaaagtaatttagatgggcagttggacattcccacatcccagtcatggaggaattacagaagcatatgcttactaaggaaaaaaagaagcccagaggaaacacaatgttggcctccagaatttttgtaagaaaaatccatccatgtgcttagctaatgttgaacacgttctgtttcccaagctctgtattttgaacctttgtccacattattatattattgtgttttccccatgatacaaataatcttaatagtattgatagtaaacaaatgcagcataattaatttcgaaaatttccatgctgtcgtctatcagaaagatttagactcagtcaatatttcttaaagcaaaacaattttgacagcctaattaaatttctaatcataaactccatgttttaaatataaatatgaaagcatataaatacacaatgcatgcataactatgcatatagagatatataatttactacctaatttcacaagcaatgtgaaagagatactagtcaatactagaatttagtatttttctctccttttcatgtagtatatgagactatttatcctttaggtttttgttttgttttgttttttgagacagagtcttgctctgttgcctaggctggggtgcagtggcgcgatctcagctcactgcagcctccaccttctgggttcaagcaacactcctgcctcagcctcctgagtagctgggactacaggcgtccactaccacacatggccaatttttgtatttttagtaaagatggggcttcactatattggccaggctggtctcaaactcctgacctcaagtgatccactcacctcagcctcccaaagtgctgggattacaggcgtgagtcaccatgcctggcctctctatcctttagattccgtagaagaaacaggcaccaaacacatttttcaaatacactggctgataacaactctcatttttaaagtgttttcattttacctctacagataggaacaggaaaatcccacgaagctgtattaactgaattggctatgcaggtgagctgagggtggccatcaaggatgtatccagttacacagctgtagcggatcttgtccccgacgtcgaatcttgtgccatataatacacctttgggtggaacaccaggatttccacaagagctactctgcaattctattaaaaaggaggaaaaggagagtttacagttatttcaataagcagtttattgttttagatgtataaaattatatatgtagatatggatattcttatttctttggagaagagtcactgaaaggaactgtcttctattccaatacatgtgacagtgaatatgggaagaaaactaaaccttatcacagaggtattattggtcattctttatgctagaaagttttagatattatattacttagtcttcagagcattactcatatattaatatttactcagataagtaaaactgaggataatatcattcacatggctttttcaaagttacattctaataacatagtaataagcaaattcatttccttaatattatcttcagtccttcagtgcttaatcttaaaccatgaacctagataaaatacacatttttcatggaaacctttatttcatttaaatgagaaaaatacagtggagtagtaaatggacaatttttaaagttagggacggtgagctagaattccaactctattatttgttattaaccttgagtgtatactacgaatgataataataagtgcaaacagttgtaacattttaattagatcaataggcaaaatatatggaaaatgatatatcagaatgttttacctatcaccttcttattctattagttgatgctgaaaactaaacaagtatacaaacataagagttttttaaataatattcaattcagaaaaaatccaactttagattaaatgaaaaaatttttttgaaaatagcagaacttcaggattaaaaatattagaggttatttgttctcatattgttttctaaatttttattttattactgttatattacctttatactacaaataataataaaaacacaaacagtaattaatgaactaaaagatattccaatttgagtaaagtcagtagttaatagtattgtgcaaacattaatttcttagttttggccattttactgcagttccataagtagttatatcaagggaaactaattaagactatatgggaactactgttcttgcaaaataataagctgaaagtcatgttgcaataaaaagtaaaatattttcccattttgctttgatatttatttcatttgtgcagttactaaattctatataatattacaatgttaattcaaataattacaaaccattgtaataattaaaatatcgatgtcaatattaagcaaaaatattaaaatacaaaatggttcacaatatatagcttaattttgagagtgttttttaaactttcattaattttttgcctaaacttttcaaagcaagtaaaagaaaaatcacagattaatttccagtatgaggtcaatttaatcaagaaaaatgtattgagcacaggacatccatatattttagagaaaaaatatttactttgagttttaaaaatgtagttttaggtttcttaaaactagaaaagtgaagaaattggctaatatttactaaacataaatggtttcaatagacaattttcttaataatacattctaaacttaaatttgtaaaatatttagtgtcagtaatgaaagttatttctaattttttattttgttatttctccaagacattagctatatgtgaattttcagtaaaacaatacaactttattgtctgtgaattttgagcaacttttaaagaaacactttgaacagtagtttattttgaaatacttaattttttggaaaattatttgattaatagatgagatgtttgttccaagagacagtgaggttaataagttttgacaaaatgaataagaattcaatcctctgaatatagtaataacaaaggagatacttttaatgaaactaccacttttggccttagaattaatccactcctcttccttccaccctctaaaaaataattaaggtcaggacttcaattatcataaagttatatgtctaggagaaaagtggtttccaaattatgtcacaggaagcaactaggtgggggaataaaatgaaagagaagaaagctctgaatagtttttggactccaaattaactttgatttaaatgaacaaataaatgtatccagaataaagtacctaaagcaaaatggaaatcatgtcaggtgaagtagtgaatgaatagtaacattgaatggaatcttaatagattacctaatctcctgccttatcgcttaattacttctaaaactgataaaaatttaggttatttcaaaatgaaactcaaagaagacaattttaaagcatatctggacttcactttcaggaaagtcctgctgttgtttgtgcctgtttatcatcttcatatagagaaatatctacccatcatcctctgttaactgagtaattcataaagacagttaagatgttttacattcaggtttaatcaatcctgattctataaccactgctcatggattatatttttgtcttcttccaaccctttaattcaggacttctctctatgctgtctatgtgcattttcaaaggcaaagcaagtatgatgtgtcactaactgaagtacaaaacccaccatcaaaaaagattatgttctgattgaacattctcttcttactcttaatgttttaaaactaagtagtgctgcatatttaaacttttgaattaaatttacttttaagtaataaaaagttttagaaattgctaagatagactagattttagataatgtttctgccagccatccagagtttgaatttcagaacagaaaaccaaacaccacatattctcaattataagtgggagctgaaaaatgagaacacatggacacagggaggggaacaacaacactgggagggcgggggtggatagagtattagggaaaagagctaatgcatgctgggctcaatatctaggtgatgggttgttatgtgcagcaaaccatcatggcacacttttacctatgtaacaaacctgcacatcctggacatatacccaaacttaaaaaaaaaaataaagtatgtttaaaaaagaaaagaaaatgaattactcaaccatgttcaatatatcaaaatataaaataattattaaatatatgttgtaagtatttacagtaagtgatgatattgcttaaaatacataaaattacagattttatatatttaaatatatacagatttataagtgaagtgaagtgaaaaatacagatttataagtgaagaacttttttgtaattcatcagatgtacatgcaagctagacacattatacttgttatctcaatgtgttttgaagcaaataattatacctaaaagcagagttgcaaaatataaaataattattaaatgtatgttgtatttacagtaagtgatgatgttgcttaaaatatataaattaaggaaaacagatttataagtataatgaagaatttttttgtaattcatcagatgtacatgcaagctagacacattatacttgttatctcaatgtgtttttgaagcaaattattatacctgaaagcagagttgctgaaaagacttcagttatcttcttttaccagcagatgacagtaatatattgattaagaggtttaggtgactaacacaaaataattatagaatctgaaaaattgtcttctaacgtcccataatacaatgattaaaatgggattgcagtaggggaggcagtactttaaaaccaattacacaatattcttggttgagcacttagagcgggcaggttgatgaactgagatcactggaaaataaacctgaagaatttgtactcaaaatatgtctctgaaaatgtcagagactctttatgttaagtttactgctctaggcataacaaattatttagtctaattaaaatccatctggttttggctggaaatatgtatattttatttatcttctcttctcacagtattgagattatcagcaaatatgaagatattttgacaacatagactattctaaagtgtagaagatttttgatattgcaaaataattccttggaaaatatacaagataaacttttaaaattccagttgtgtttaaaggggtagagttcagtgacactcttctctattagttgaaagaaaagatcaattacttggtaagtgacactgacactattttattcatcagaagcttttaagagttaccactaacattgctctatgatatgtactagttaatactacagcatgtcccttgccttctgagttaacagtttgagaaagtcaaacttcattgttgagtatcagctttgataggcatttgggcattcttccacttaaatctcacaaaacactagacattatgggtataattctccccattgtgtagaaaggaaaactgagactcagaaagattaagtaactttccaaaggccacccactaataaatagcagacttgtggttcaaacctaggtttcctaactcaaaagccttagatcatttcacaattacatattgctatctacaaaaggcagatattcattccacaagtatttattaaacatctatcatcagcaatgctctggggatatagtctagcaaaaggtagacatggagtttatgatttggtggctaccaaaagtaataaatgagtaatttacagaatactaattgtattgcgacatgtggcagaaacgaaacatgtaagttatactaaaggcatataatggagaaatctgaattagtattgattaagaggagatctggaaaggatttcctgataaagaaaggctttaattgtgatctgaaaaggataaaaagttagtttttgtttgtttgtttccaagggcagtgaacaagtatatttgaaatagaaaagtataagaatcaaagtactgtaatagttattaggtttggcaatacaatgaagacaggtttcatggaaatggtagggtagtgtagaaactagattgcgaaaaaatatttcgaaaggcttgatcatagatggcttcacgcagtgatgtatatccttttcataggctcataaatatgaaggagaactatttcctcattaaatatttggtcgtggggtgctatctgctttttaaaagagtaattgagagtaaataattaaaatacattctataaatgtacaagtgagcagagattttcataagcatgcatgatataaagtgtgtaagtttactaatttaatactaattcaatgttgagtgggaaaattgtgataaaacggattatcaaaattaattttaaaaaaattagtagccaaaatgatgtatgcatattattttaatatgagaataccaattttataagactgttgatattattacataaaacagtatatgttagtcatgtatatttttagcaagcactcaatatgagacaaatattattaactcaataaattgcagttttattattattataaattgtgtatttgagacatcaaaattagatgtgattatattatgatcttctagaggttgtgtcataagtatcaaattttcattaaatgtaatgaagtatgttagatcattcttggtcttaaaaattaatttaaaaatagtaatttagtcaagggtaaaattcaattgctcctctccgaatcataaaggaaatccaaggtccaatcttaactttcagcagaaaatttgtataaacaaattcacagaaagtcccctataggtgtcattgatttcttcattcttttgtctattatttggtatcatatattaagcaccattccaagcacagtagttaccaaaagatatattcaatgaattgcaggctaaaaaatccagataattttcaaaaggaaaataagtaagtttaaaatgcaatttaaatcttgaaagagagcatatataaaggactataggagaacaaaatttttgttatggtttccttggataaatgaaataaaactctaccaagaaatttttaaaaaaaagtgtgtgattaatactaataaacatgttacaacagtctcattctttaaaaaaaatacccaatttgttgggagcacatgtatagttgcgaaaggcaaaatgttttacaaattatcaggaagaaaaccttaccttgaaaatgggaatgaaaaatttaaaaaagggataacagacatcttgactacagaattgcataattattcagtcaaatagatgaagcatgatcctgctgagatcaattaacaatgctttaaaacaatgcaaaattatatctactaagggaagtaaaatcaagttgtttgtacttcttagagaaaattaatctcagggtttatttcccagatgattaaaaataatttaggagagcataacatcaagctgaaacaaaacgttttgcacctagtacctctcatcctgagacttccaaacacttaacaaacaaatccattttccaaattttttagtgatacaaaatgttctttattacaaatattgaaccatttcattcacacaggacataaatggtatagtttggaatttacctggggacttcagtttgagcaaacattttatgagtgttttgaatcacctattgcatctataacgtcctcatggtcttttctttcagtacataaaactgaatgaaatttatttctatatacatttacttcctcaccagattttgagcatcttgagaagagggactctaattcatctttgtataccaagaatttagcacactgtgttgtccccaagcaaaaaagaattaaactaattgcattacctccttgagtagaaaaatttaaaagttaattatcacacagatctcatagaattaaatgtttaaatacaaaataatagagtggaatctgtagtatagaagagagttgcaggaatagcatgatttaaacttgttttaataagcactggatcacattgccaccatgtgattttgtatgagtcaaattacatagttatgtgattcaattctgtttctatgtgaaaatccattcacttctgtaagccatttcctttccataagcataatttctaagctggagtcatgtcacagacctcactgggatgctggagatgttgcaaacatgaggccgcatttgccgttttggaagtcatcctgaaacttcaaaaaggttcagagttgctaatcaaaaggacaactattatatgttatttgttattattattattatcattatttgttattattttaacttattgaaagggaacccaaataaattactggttgctagaaaagaaataagagcaagacagtactgtcttagctgggctgcctaagaggaaaatagattattggattgattttagggaggaatgaacactgattaaaatgtattataagcagtaggagaaaagtctattgtcattttaaaaaaatatttagataagtctcagggtaagatgcatatatttccaaggaaagaaagtatgaagcattggaaaagttagtgtaaaaccaaacacatacacatttatgctatgttggtaatgtcattctgttttcatattgtggatacagataaggtccactggcactacagaaaaatatttcagcatcagatgtagatttatggttaaatacaaggtagaaaatactttgcaccatatacaaggacaagtcattagttatgttgacccatgaataagaggtaatgcccattcaattggaaatatctgtgcccttttattggctaaataaattttatcacccaaaatgaatttacaaaaacgatattatatttttgttttgtaaactctataaccaccattgtgttaacatagttgggtgaaaggatcatgaaatataaaaagttatgattattcgaagctaactctgttgtacataactaccagaatattaccaaaaccaaagaaatacaaatacaaaaaggaggcatattagcagccatactcacattaaagtttctgaacatggaataatgttgcatttagcacagagtagcatttgatagattaattcagaataatagaaaaatatgaataggctctcctctgacagaattgggacaagtatctgtattaagacttttggataaaggtaatttaattctttaaaaagatgtgttaagccgatcatggataatttactggaattatatattcaacaaatatgaagactgagaaatgccactgtattttagcagttaatccatcaccaaataattattgaagcccgaggcacaaatgtcaaatgagtataaaatatggcatgacaccatttctatcttgttgaaacataactcaagttggaaaaataagacatacatggtaatgacctggaaattaaaaaataaaactgattccataagctgatttttaaaaaacaattttaactattatatacatatgctaaaggaagactattttatgaaatgagataagtaagtttttagttggagaggattcagaagagtcaaataaatcatatgactaagacccatagagaggaatgtccaagatgtagtcaagagcagtatatgcagaataagttgcttttaatacgttggtctgaataggttgatacatataaggaaacacagaatgtaacttcagaaaataatcttagggttgcactttggaaagacttgaaattagctgttttagggtcaatgctaagctgctgctgatgctgccaaaaaaaaaaacaaaacaacaaaaacaaaaaaacaacaaaaacaaaaacaaaaaaaactcacaacgaattgcttaaataagataccagttatttcccttcatgtgactctctcattgctctaggctaggagagactggactgtgccctcaggccatcagggactcagtttgttttccaacttgctactcaatcctcccctagggcattgcctttgtcctttgtctataaggagaagctgggttgctgcaaatattgaattagaggctactgagttgaatgagaagatgttaagggaaagaaacaacaacagcaacaaacttctctgggagatgcacagcagttttgttgttgctgttgttgttgttgttgttgttgttatcgtttttctatcaaggcccactatagttcctcatggaacagagacctggtggagcagaaaacagatggttacaatacataaccccatgtgggtaggcaaataaagaggaatattccacagttaaagagcatggccatgcatagatcctgccggacagagattctgaagcacttactgccctggcagaccctggtcctgttctctaggaggtgctcctttctcctgcatcctgtagtcccctggcattttcttctgaatagttctttcttgtccacattctctgtggtaaaatttgaagtgggtgttgaagagtaaactatctttaggagtgctttgagcttataccctacctctgctaatgcaggtttggtgcttgaaaattgacttggggattgacaaccagagttttgcagatgactcatataatttatttggctaaaaccacccctgaaaacttactaggaattaatttatttgattccaggttttttttggtgccaaggaacactcttcccaacccccaacttgttcaaaccatggcttacactgccttttcattggagctaccttgaggtgatctgaaacaataagcttggacggaaatgcaacattccttacctgatctttggccccaaggctgccttccatccttagactaagaaacttatatgagattctgataaaccttcttatcccctgctatacagaagcagttggtttctccaacccgtaagtccccagaatttagactctattcactctcttcttgaaaatggccaatttatgcctgagctcttctctgttttatatataatgtcttacttgtttacattttgggggtacatgtgatattttgatactatatacatgcagtgtgtaatgatcaaatcagggtaatgggttcttgtgtgtgtaaaagccaaatcaaactgtgtttttcctctactccgacactaaaacaatgggcacagaaaacttctctgaccacgaagcaagcaatcaatttttgcagtggacaacaattgggtgtcctccaattcaattctgacattgtctacctggcaatagtatcagatctcataggttgagggcttaatccccaagactgaccccccaggcaccaggcaaaagtctgggcctctggaacctttgcctgacaatcttccagtggagttttcactagggagactcacagaacttaaggattcacttgcttacgtttaccagtttattacagaagatattacacaggatacagatgaagagatgcataaggtgaggtatggaaagggttacagagctttcattccctccctggaagtgccacccttcaggaagctccagatgtttagctatctggaagcacttcatgccccattcttttgaggtgtttatggaggctttattaaagaggcatgactgatgaaaccaatagtcattggtaatcaacttaacctttagaccctctcccctccttgaaggccgaaaatctcaatcctctactcctgtcttggtcttttgggtggccagcctcaaccttgaagctttctagaacctgccaaccatcaatcaatttattagcatcactttggagtttctaaggattttaggagttgtatgccaaaaaaatgaggccaaagataaaatatatatttcacaatattggagtccaccccagtctttgaactcagatcccttacatcaaaaagacatacaactcaaaacgtatggccaaatcactagaactccagttcatcattaataaatagcttagtctatcatattgtatgaatgtctgctagactgaggccactcaggtgcaggctttcgttcaatcttatcagcttccgaaagcagatgtggtctccacaaacctatagcttcaccctgtcagacatctggcataattcagctaagaaacaatgtcttctctagctctgaatctccttcaaggtgttaactaatattaggtttttctcaatttacaacccattcatttattccataaccttccagttactctttctccttttttccatcaatgtccaaacttttttcacctttggaagggacgttagaatcatcactgtgctggtctagattgcaggcagcaacactagtgggtagcacgtgcttccccagcagttcattccaacacttacttagggtatggttacataggtcagaactatagggccatttttaacaccaggcaatataggctgcattcactgttaactcaaattttgccagattgtaaaggcacaacccacccccatcaggcacttaagaattatggcagaaggttcttttttgtgtgtttgttttttcttttagaaatcattcttgtttcgatcacttgtagttgcagtcctggtcctaggaccacttaccaagtaaggaaaggagaaaaaaaagttgaggtgatgtgggaagaaagaaaaggaaagaagcataatcgtataatcattatactggcttactcctcctttggcaataatcacatagtcataccagtatccttccccatccctctttcccagatcaaccagaaaaactgaggaaaatctagtgaggacactcctttagtcccactcatgttgagtattagcacacgtccatgaaggtgtgtaagccagcccttcatgctttcatctccccctgttttagacaaccaatgttttaatgtccattccacttttctattaaactttctctgaggaggatatatctttgcccattgttgaaaatgatgggctgtagagtatgtttcttggtctgaagaaatgaaagtcagatgtccaaatctgtatattttggtgtgtgtgtgtgcatgcatgtgtgcatgcgtgtgtgtgtgcatgtgcacgcgtgcgtgtatatgtgtgttgtaacagcactcggggcatttgtatctttcacaggacaagcaaaacccagtccataatcagtgtctattcctacaaagacccattcgtatcttcccagggattccagcatctgtctcacttgcaagctatgttcaggacttcccaccagggaatctgccccgtatctgtcagcaccctctgtctctcctgctggcacacaaaaccattcttattgacattatgtgcctgagaaggtataaaaggagcctgatcagattcagcactcctgtatccactcatttcatggaccaaattagccctcaggagagcactccgggatatttgcttgtcaattccagtcaccttccatgcatggaaaagggttctgcatggccatcaacatgttctacttaatgtgagctcaaatttccatagggctgtgccctatgtgggcatccttttaataagataggtttctattgccctcctccctgaccatatggccaggtcattggccactacccacaagtcagtaaaaactcacagagaaggttctaccaccattcaatttttccatcactgatggaaaaacaacatgtaattcagcccaccaagctgatttacttttaccttgtttagtcaaagtagcagcctttcaaacaggatgttgtacatttacctttgaaccaccgtctataaaccaagcaaccctttgttggtcaattgagagccgtttataggacgctttcccattgtcaatagaacccagcagctcctcacacagttccaggatcagctcttgtggaaaagaggctccctgctagtgattgtcccctccttgccttctccaggtagaacgaccctgtataaaccatttccattttattatggaactcttcggggcactgctacacaattagagtgttccctgacattacttagcacagtatttcaggtgtcaagatcattttacaccctgtggtcacatggatagctttatttaacgttccacagcaaggcaggaaatgcccctcaggtgaaaaatttctagtcccaagtcctcgtagttgttgctgggagaagttcatgagcttttgccatgagtccgagtaaacactctacagagggctagaaaatgaagaatttgtccctaccagcactccagcttctactctacaccatgcatgcttggacaatataactggttcccattggggattttcaattaatattggtggaagggtggatttacataccttctgtttagggggatatcagttatatacaatatttattctcatgaatatgagattctgtctgtgaggtgggcggggggctgttagcaggaacccctttcactttgctgggagtttttttttttcttcttcttcttcttcttcttttcctttttcacccagtaaattccattcccctcacctttcaatgtgtctgcattcctaatccttcttggtcatgtgatgcgaatccagttttagctgaactaaggagcaaatttctacatcaaggggactgctaccctgagatcaccactggagtaaagtttacatagagtcactgtcacctcatcaccaacctcagaacagtgaaaagagactggaaaaaaaatcacctaaaattgtaattcaaggatcaaggagttgtaacaagaggtgacaaatatgaccactctgttttattcacttaaagctggaaaatactggaaacttctgtagttaaattacaaccctgataatgaaaccaacaggcagagtcttcaggaaaattgtgtgcataaatttcgtgtttcatttttatatgagtgtacatgtttgattcacattgacaagagagtctcagaaatgtggttgagttttgccttttgtttttctctaacattttaaaaaagagaaagagagtgaaatggagattagtagaatttattcaatcaccccacctaatatgtaggtaactccccttcatcctatttcagtttaaaggttaactaccctttaaactgtcctacacaattcttctgtgtccataaaaggaagtccaatttctcacctgatgatcatgatcctacacaatcctacccctttatacttctccaaaattgccttacgcttgcctagccacatgctctatttctgtcaaatattcactgcttatcaatatgtttcatgtattcttgcttcacaggtttgcttacactatttgaaatatctccacattttttctttgcctatccagatatttccattcttcaagatctaaaccaattcccaccttctccataaagcctttccaaactcttcagtccacggtgattaccttcacacaggaagcaatagtttttattttctattatatttattgaccacttgctcaaaagtctttaaacatattattttgccttttattgtttctttgaattctacatgtttctttaatttgtaaatgctctgtctattcaattgacttgtgaccataatcaagtcagatattatacttttaatgcgcatctttaaaatggtcactcttcaactcagatatactaagctccagatatttatttggttaaagaattgttttaattcaaagaaaaattggggagataggaaaatatgagaaatctcaaattatttcaaatctctttggaaactcaatccccttgggggaataattgaattctggattgaagccaagtacaataatccttatacaagcagtaatagtgtgcaattgggaaccacggccataagagtttcttggatgacaaggagtacaataaatcttgattattttgcccttctagagtaatgctcaacctttcctccctacagggataattctaaaagtatgggagaaaattaaaaacaagtagaagggcttgttccagttggtttgccttgttgcagctgaccttaacattagacaatgaaatatagtgataaagcttccattaataaaatcaaataaacctgccttcgaatcctatctctgccatttaccataagcatgtggaagtgagactattgatacttcaatttctttttgagtaccatcatcattactgagatttatttgggttacttaaacaaattaataggaactcactgattttaactatgttgtgagtttcttaatatcatcacattctaatctttatttaatggtcactggttcatactgaaaaggtgatcatttgggcacagactcattttcctcagaaaatatgtatttatgaaccttgagtttattgaatatgtctgatttcattccattcaaaccacattacatttaacaatggcaaaggtttcccaacgaagcagttacattgttattcagttcatttatctttactgagatcttaacatttagaatgtattttacctttttaagcattatacctactaatcatgctaactagttttgttactggttgtagttcatgatacaatacaatgagaattgcttcaccaaagctataaaaacctaattgaaaccaattatgacaattatctctctgtttgattgcttgcattagactctttcctcattctatactgtcagactgcagacaatttttcctgatgtgacctatccaactgtatttcaggctttattcagtgagcaagcatacttctgattaaaattaataggaattttgcatggattgagtgagaactggagttattaggattgtaatatgaatttaagtgagaattaagtattactggactttcttatttcaattaagtatgaaaacactcttaatcaagcatataattaaatttaagaggaaatgtattgtgtgctaattgccattgattattaataatatgcttatttatgcatgcaaagtctataatggtatatatctccaaactgtttctgaatgacaataactgagttctgcataataaaactattaatgaaatggaatcttgcaagaaatgtcagaaaggaaaaatagctcatacttcagaactcttcttctctaacttttcctgttgaaaaatcagagcaagtcacatgaactcacacaggagaacatcaataattatagactgcttcctttttgcaatcatgttttgttttctgggataatatagtttggaaatattttattgaaatgtaaagaattcatgtgctttaaaaacataattaaatctttattttagcctttaaaataatatgtattcttttattttgccattataagcttttagaaatgactcttcatgtgttataaatttataatttttttttattcatttatttacttattaggttggtgcaaaagtaattgtactttctgacattgaaagtaatagcaaaaaacacaattacttttgcaccaaccaaataatactatctaatgttcacttatttattaaacacctactgaacgctaaaaattggtcttcaaagatacaacattgaacaatatatactccttttctcacagagcctgtgaggtaaacttgtgagcaggtggtggagaggaaacccagataataaatacaataatgcatgtaatatttaccactgtattattagataataataaatgttaaagagaaatataaagtaaggaagggtagtggaaagtctgagaaaacatttcaggaaacgagaactgcaaatgcaatgaccttgaagcacagaatgcatggagagttgatggaatggcaagagtccatttgggaatggaataactgagggaaagactgagatgaaatgaaaacagaatgccaaaacaaagccagagggttagactttgaagccattgtaagtatcttttcaacccttttaactgatctctacctctgcctcttaaaacatatgtctatgacgatgtttttagcattataaattatttccttatggtggaaaagaaagatttactctggttttttttttttatcatcccaaactttgatcccctgcgacttactcttcctatgatttttgttgaaacagtgaatgttaacatcacaactttgcgaatgctgttcttagcaaaggtattcattgttaggaatacttttgtttcctaaatgtttgttttccatgacattaacaatttcctgtcttttatttttcatttatttcatattgagtgtaaccacaactttaaactctgccaattgtttaaatctctttctaatacatttaaatgttttaggcatttaacttcaattccttaaagaaaaattttcagagcactttaatcttctccatctggacatttgtttctattactagaaagtgttcttgatattagattcaactttcttcttagttggatattttcttttctgtatctttcaatgttctctttctttgttacagagaaacaccaggaacttccagagaatggatgtttaagagataaataatgcacgtgggcatacatgttcataccattctcaaattccatgatagtttctatgggtatagaaatgtttttcaacttttatgctggattcagagggtaaatgtgcaggtttgttacacgggcatattgtgtgatactgctgtttgaggtacaacgattctatcacccaggtactgacacaatacccaataggcagtttttcggcccacatcttccctctttccttcccaggtccagaagtcccccgtgtctattatttccatctttatatccacgtctattcagtgtttggctcccaattataagtgagaacatgtgatgtttggttttctgttcccatgttaatttgcttaggataatggcctccagcttcatctccatgttgttgccaaaaaaaaaacaaaacaaaacatgatttcattaattttatgactgcatagtagtccttggtgtctatgtatcacattttctttatccggtctggtgttgatgggcacctaggctgattccatgtctttcctattgtgaatagtgctgcaatgaacatgtgagtgcatgtgttttttggtatactgatttattttcctttgggtatatacccagtaataagattgctgggtcaaatggtagttctaagttctttgagaactctccaaaatactttccacagtggctgagctagtttgcattccctccaatgcatgtgttccctttttctccacagccttgccagcatctgttatttcttgactttttaataattgtcattctgactggtgtaagatggtatctcattgtggttttgatttgcatttctttgatgattagtgataatgagcattttttcatgtttgtttgccacttctctatcttcttttgagaagtgtctgtgtcttttgcctattttaattggattgtttttttgcttgttgatgtgtttaacttcctgagagatttggatattcaatttttttcagattcatagtttggaaaccatgtacattaggatttggaaggcaaggccctgtgctaatgttgatgttttgaaaaccaaagccattctgaattctggcactttgaatttgagctacttatttctgttgctaaaaatctatgtatcttcttacagttcacagttgttgttttttttatatttgacaatgaaggcattattttcctaaattgttctagatgcttgctgggtctagcaccctttcaattttctttcgatatggaatttcctttcagtatggaaattcttgtcctctgctttataaaaaagctatttgtttagctaatttctccccttaatgttactaatttacctttcaaaaatgcctattatttgaacacttttctggacttaaatgactactgctgctgctaccactttttctcttatttctatttcctatatctctgacttttttctctcccttatggaagttttctttaatgttacatttaaaccctatcgagtatttcatatacatatattttttatagccaagagctttcttttgttcttatttctatagaaaatcatgttcaagttttatatattttagagaacagttacattaggtttgtttgttcattttagaagttttcttctgttcttatagtcctcctttttctttcaaatttttcgattctgtttgttttggactttagcttctatgctagagaacttcttcagaaatcagatgatttttgtttgctatttctaagtagttaagtaaaacgctgaataaatgttctgagtacaagtgtggcatttgatacatttgtactttactgtgtagtgattgtcttgattgctttgttaagagacccattataacagcatttctttcctattgaactgcttatactcaaagtaaaagaattctccatcacctgcttagggaatacagacctagctgcagctttctgagttaagtagtgaaaaatgtgtgtggagcatgtgtcaatattttgcatggaaacactcacttattccatctcgtattcgtattgtgcctctcttttcaattgtatctgagacctactattcagagactgttttaccacattcagagacaagacctccaatatttagctgaggtagaaaatgggaagatgcctagttgcatgtttttggtcctcttattgcttcttaattgaattttcaagcaatcttcctgctttaagcatgactttcactgcctcttttagaggttcttaatgccaccaattcattagacttccaggaattctgagatataaactagattgcttcttagcttttcctactagtgacttaagattcaaccttctaatgacttctctctgttactactgcttcatctgattaccagcttccaaagtactgtttgattttaattatctcccattatctatattcttatgcattcataccatttaaaaacaatttaatgtttgagatgggtttcaggagagagtaatagaccacgtgtttcctcttttatctaaacacaaaattccacatctatgacttacacattcattggaaattgcataaataaactatgatgtggacatcacattaagtatactgtgcagtaggttaccgactttaaaacctctatgtaatcttaaatctaaaagaattatttcttgtgacatatgcaatcttgtttatgaataagtatgaaatatttataaatgtgtacatagacaatattttagaagatttggagttattatttagcaaatgtattgaatatgcctgcaaataagactcatttttatttaaatttacttcagtgtacacactatgtgtctaaacaataaaaagcaacatgaatattgtagaattgaaggacttaatttccataaatggaaaaaatataaaactttgttgaatcaggaaccaattttctttgggggaaaaaaacctataccaaaatataacattattttaaacatgttcacatctgcaggtgtttaacgtgataaaacagtaggggacactgccatgctgcctttaagttattatactaaaaacttaattactctgtaattatagacaaaactacatagtgaaatatacaagatgcattgctataatatgtaactaaatgtagttgtcagtaataccatgtatttctgaaatgattgatcaattgatttgtttcaattgttaatataacacacagagtgtactcaacaaacaaataagtgaagttaaaaaagagaggagaaaggaatgaatagctagagcacagaggatttttagaccagtaaaacctattttataggaaactatgatggtagatatatattgtacatttgtcaaaagctggagaatgtatgacaccaagagtaaactctaaggtaatctataggctttgaatgataatgatttgtcaatataaatttattgatagtaacaaatgtatcattctgatacagaatgctaatcctgggggaacacgtgagtgtgtaggcgaaggagatgaaaactttctgtattttctgctcaattttgctatgaaacaaaaattgacctaaaaagtaaagttttttaaatttttcgaaaaaacccctcaaacataatagttaatattgatgcagtaaattttaataggcctccataatcttaatcctgctataatctttcacagtggcctatacctagcttacaaacaagtagctttcacattgtttaactgagccaagaaagatatttactatgtatttcgttaaagtcttggcaacttactacatatttcattaaagtgttggcataggttacagaaccttcctccatcttcaattgcccctgatctcttccatctacttctcttacactgttctagtccccacactcaattacaggtcattcattgtgcctctacttcactgacatcaagagatcaaagacatttaatggttgtccttatattgtcttttatattatatctgcaaaagcaagtgattgagctatttttttcctttctttcttacaaaaaacactcactactgaaaacgatttcccatgacactgcccattaccctattccaagctttttttttttttttcaagcttcaggtgcttgttaacgacctttgtatttcaggaaatacatgtgatgttgaagtctctggaacagaagcagactattgaaagagctgagatctagaacccttggtattacaagtcagaaaaaaggtgttttgaaactgagccttcaaatggaattggtaggctaggaaaaataatcatctctgtgatgattatgattttctttattgagtaggaatgccagagaaaatacaagtccagttaaacatgaatttcagataagtaaatatttaatataagtatatctcaagtattgcaggaatgctctgtatttttatttgctaaatctgttaactctaattttggggattctggataaatgaaagaggaggattctctaatgtacaacagactgcatttcccaccatcatgatgagaaagaacctaatggtgcgtaaaagttacataaatatatagataggtatttactattcatatctataactatatctctatctatttaacttttacttggatacatatatataatattcatatcctatattttatatatatatatatatatatatacacacacacacacacacacacacacccccacacacacatgcatatatagtgctcagtgttaagggtttgggaacaaatccatatccacctttttgccttcacttcctctcagaggataagttgtacatccttctcatacagatattagaggacaacttatggtatgaggaaaggtgtcatccttgccaaatgccttcagttaatttattaggaaatgtcattctctaataaatattgggcggaaacttcagtccctttctcactccacgagatacttatctaatttttctcttgcatgatagcttctttttgtcttttctctcttaagctattagctatttgtctgcaaatgttttttgtactcctcttatttttttctttttatagagtcatggggccacaagaaaaagaaaaaaagtcattctactggaaaactgaaaaaatatatttgatttggctcttcaattatgcataaaaactcactgggtaaagatggaatgaaagactattcagaagaagggacattttgcaaagccagaggtatgaatacacatgacttatttgggaaaggtgggcagattggggtgaatagactttagaagatactgttatatagacaaatggacacaaagctttaaagacattttggggccagattgtaaagaaccttgtaaacattgttgattaccttagattttagcccacagtcagaacagcacatgaaacactttcacaaaagttaaagagcatgacgaggattttattttttaaatgtaattatgaaaagagaatcaaggctgaattggaacagagagcaggagaagactagagacgacagaaggagacttcttcaactagagaaaaaaaagtcttgaacaagtggtaaactaattatttcctatcagtcaattaaagtacctttcacacttagaaatttatcatggcgttttatttcccattgcagaaagactgaaatcttcctggcattaatgacacctatgatttaaattcacttttctcatataattatttcttactctactggtttgtctaagcgtgttcttaaaacttgtagtaaagtgattttaaaagtatctcaagccctgacattctgtttgtgcaatctcaggtaagtacttaacccctctgtggaacaattttcttacttgttttattaaggcatggtctatgtctactttgtccatttttgtattttagcccagagtacaggacataaaaagtgttcaataaacattcactgattaaatagagtgataataatatctacctcatatacaggctgagcattactaatccaaaaacctgaaattcaaaattcttcaaaacccaggatattgtgagtgtagacaagatgctacaagtgggacattctatgtctgacttcatgtgatatgtcacagtcaaaactttgtttcatgtacaaaattattgaaaatactgtatagaattgccttcagcctatatatatatataacacacatataaaaacataaatttcatgtttagacttgggccacatcaccaagacatttcattatgttatgcaaatactccaaaaaaaaatccaaaacagttctgtactagacagtggtcccatggggatccaatcaacaaatgcaggggataaacatttgtgaagagttaagccatgttaaaaagttagtttggttattatttggtgccaaatcttatatgtatatattattattactgtaatgatgttgagtccacttataaaagtaatgtatatttactgtagaaaaactttataataaattatgaacaagtgaacattattatgccatgcagagataattagcaggatgtgcttatctccaagcttttctatagaaaatacacattttaaaacgatcttatagtacagaatattttatacatcatttttctgtcaataataattgtaaacatcatataatcattttatgacaatcttaatagttcaatataatttattttatatattcaacaatgtctttaattatctgtttattagatagcacaacattgttctaggtggacagaactaaatggagagaatgttttatataaaatgcttaccataagaggattcagcactggtgtcatgtaactaactatatttgagaagcatatacaatctttataaatgtagttgttcctattgtataaaaatagtaaaaataaaccaattaatgttgggataatcatacatgaatacctatttatttctgtaatacatctaaaaagattaatgcaaacttcaagttattgtgcagtggttacccatgtggaattcaagttggtaccaaaattgatttctattctagctttgctttttattagcttggctgaccttcagcaagatccttcatgttcatcagctccaacttttgtatatgtaaactggagataataacttccacacgtggattacttcatatcataatcactgcacatatgccatcatcctgttaaatttagtatgtgtatgttgtatatacatactatatatgtgatgtattatccatgtggaattggagttgagaccaaaattgattcatattccagctttgctatttattagctgggtgaccttcagcaagatttttaatgtttatcagctccaatttttggagctgataaacatacacatactaaattgacaaagaaagtgactaaccaccattttaaaatatcctttcttttccttccacttcatacactaactcagaagggttgtgtttgtttttgtttttgtttttttttaaaaagaagtccataattacattttaacttagtattaaaattttttttggacagactaaatgattatttattttgcaatgttagatattaatatgacttaatcattactcccttaaagaagtagaggaagtgttaatagtaaccttactgaagctctctactgaccattttggaaactgcagcccatttttctattctccatttaatataattaataccttgttttcatttggaaaatgtgcgggattatcaaaatccccaaaagaattaaacagagccaacgttagagatattgtaatctgaaattacttaaaaaagcaatcaaatatttaatttcctgcttgaaataaattatttctttctaatttcaatttccaatagatgttgagtattaattatgactctcattatgctaattggaaacaaatgtactttcatgatggtattagcttaaattatatatatttaaaattaaacatatatttaactatatataatttcaaatatatatagtatatatttgcaactgaaaacaacagcacattgaagacggttcatttatattttctttatctgaatagcttcttaacaaaatgtcaatgactaaaagacaggaacttataaataagttatattttagacaattctcaaggtcaacaattgtgtacaagcctgtgtaaaatttagatttcaatttcttaagcaaaaattattatcagagtgatatggttaacagacaaaacattgaaacagcctttattcatcattgagaataactggtaccaagtagattactgttgatctgtctgcatttttggattggcatgactatttttaaataagatggtttctagtatacaatatgatctgggtgggataatattataagctctatttaataacaccttaaatttaaaaactgccttattatttttttaactaatacattttatgctggatttttccaacacaaaatgtgcacacatctactctataggttgaaagggcatttttagctgcccattttcatggaggatgggaaaatagaggcccaaagacattgagcagcctgctgaaagccacaacattaataaataatggatgtatatttttatgtgaggtgaatgattttttcccattacactatgctgcatttcatcactatggaaattataatttccatagctatccaaagttcttgggaaatggaatacattaaaaaaatgacttattaaaggttaggaaaaaggacagaagtatctggagctgaagatgctgcttcccattgctggagctgctcttccaggtgcagggccttgattattaacatgagtaatgagaatagtgtttgattttatgctgataactctcacaattatctccagtccaaatctcctctgtgcttcagatttatatacccaaatgcctgttgaacatctccatttagatgcctcatgggaatctcaaatttcacgtatccaaaatgggcttcatgcttttcttcccagtttttgccatcttaataaccggcagcattttaccaattgttgaaaggagaaagttgggaattgtccttatttctgtgactcctcttattctttttttttcctgattcatctgtggattataccatatctacccccaaactatactgcacatttgcgcccttctttcaatctccattgctaccaccttatttcaaaccaaccaagtctctcactaggatgctgcaatatgcccctacttggaatacctatttccatttttgcctccttgtaatccattagtctacatagcaagagtgataatcttaaaaggtaaatcataacatgtcactcccagtttaaatgtttcaactgactctcattttgtttataatatcatccatgtcctaaaatgtctaggtgtcctggcttagtgcacactatactacagctaaagaggcttcttttcagttccttgaaacaaagcaaatctatttcttttatttatttattatttttattatactttaagttctgggttacacgtgcagaacgagctagaagaagggagtaagtgtagaaatagatttgcttcataacgaaatgaagatgaagcaaatctatttctacacttgctcccttcttccagtcttacgttaaatgtcacagcctcaaacagccttttattttttaatctccagtttttaatagcgtttatgcaaaataattactgaacaggatatttgcttctttattatttatgaagaacaaaaatttcttctgtatagaggttataactatttgttcattaatggttcctagtgtattgtgcaatctgtagcatctagaaagtgctgagtaagtgctagttgaattaattaattaggttgaagtagaaaactcaccaggaagcaagatccaattgaaagggcctctccagactatttgcatctctctcagaaccctttgtagagacaacttcatgtgaaagatctccttgtattattttaaactagatctcattgcataggtttacccatggattaaaatcttttcctatggtcatagctctgctaaaaggattctaaaatgctaaaaacaattcctcatttcaaagctgggttttgcagatatttattgtctgaaccactgctagcatcatttcaacacagcaatgaaattcattgagagtgtggttccctgtattttataatatatgtcctcatatattataaaagttcaaaatcctcatgggcttacagtcaaaggttaattgaaattagtcataacaaatttcaaaattatgattggagctctactccaccagtctcttccactccttatgtgagtcagaatgacacaaatcaacattaaaacttgagttaaagaataaattgacagctgtttattagatttttgtttttgataaggatactatatattatcagggaatccatcataaaatacaaaacttgtgcattcttcacttaatctaaaaacaatgaaacttgaatttttaatgaattacatgatatgataatgttttaaaggtagccctgcttttcaactttggctattactacaaccagagcattgtgcagagacagcatgtgacttttgaaataaaaatcgtatgctgatttttaaaaaaacctttagagcaggaagtttatttctaatttatcccatgtaaatcagagtattgcatgattcgttcaatttatgaatgcatttaatagttgtataatatttatggaaaatcaaatatgcaatttttcatttatttttctctccagttgagtaggattgcttttattttataaaagaaatttcaacatagatgttttggtattacacaccctatagctataacccaaactgccacagctagtatgccacatgttctgttactaaaacagagccacaaagctggagaaaagtaaagtaaagcaaaaacaatactctattgatggcgctttcacaaaattgtaaatttactggaagcatgccaaatcgtaacacttgacttcatattcattctattgctataaaccagggctagcataaagcaactttcactgcacaatggctgcagtttttgcttaaaattaattgcacatgtgtttaattatatagcagctcttggaagtgattatataaaatgttatttcttcttagtcttgcttggatctctcaaattatagttctctaactctgaaagcaacaatgaattttaataaagggcagggcttgcaaattactgttgcctggctgctgctgccagtgactgaagagcctcttttaaaaactgaatgaggttctattgtctttgtttacttgcaagtgagaaggaactacaattacttgattaggcctccagggggcactctgaaaaagactagatgatactcctttgaagtatttctggagatgccaccatcttggaaatgccattgacatatgattgttcaaaggctttctttgatatttccttttattctgaaaaatttccaaaaagcaatattatctgcattctcaaagaacttggtaagcacttatgtcaaggttgcctagtttttccatcattcttagaaccttatgtagttcaggcacactgaaatagatgaattatctttggttcaaactgccaaatctagctgtattcaatttggacgcaatgtaaaatagcaacttatctgtaggtatagactttatactaacatatagtataggtttgaatatatagctctacaatgaagctgaaaggagaacgtacacttgaatcaatttcaaaatcaatacatttttcacctgagcaattgtccaagtatttggcactttgttagaacaaacctagtatttggcaatttatggaattacagaagaataagatttcgctggtgactcagtttacagagaaacccatattttttcaactgaattgaaaaataagttctagagttctgtactactgtaagatgactgtacttaacaataatacagtatagtttctagtaaatagccagaaggaggatactgaacattctcatcccccgaaaatgataaatgtttgaaatgatatatatgctaatgacctgacctgatcactatgaattatatgtattgaaacatcactatgtagcccatgaatatgtacaaatatttgtcaattttttaaatttttaaaatgtgtttttataattatctattttatttatttacttatttcctgagacagagtctctgctctgttgcctgggctggagttcaatggtacaatcatggctcactgcagcctccaccatggacctcttgggctcaaatgaccctcttgcctgagccaccatgaccatctaatttttttttttagagatggagcctcactttgttgtctaggctggtctcaaattcctgggctcaagtgatctttctgcctctgccttccaaagtgtgtgagtcactgcacctggtcaaatgctctctatatatgttaatttttatccaatataattaaatatataattaaaatatcatataccactgaagcgtttatagtgaaaatttagttcttaaattcaaacctttctacttcctcagtccagctccatcaagacaaaatcttttaacattttttgacttttttattccaatggtagttaaactaaacatttgtagataacatgtacagacttctcttccttgttttatctacttttaaacatgtactattaaatttttcttatataggtgagagtttcactctttaacaatgtactatctcctcctcctgtcctcttttcataagtatgcatctatttttagttaaatcaatgatgggtgtttatgaattggctccttcactggagattcaacttgtcaacaaatatatatatttcctctgtggagtaaacctctatttcccccctatactcacacttattaatcacctcttttttcacttgcataattttctgtcgtaatattttttcccaaatgctctgccaatttcatcatgaagaggtaggtatcttagatttatgtttttccctggaaatctcctttccaaaatttttaactctgccccaagcttttccagtttatcttaaattgtcctattttattagaggaaattagtgccctagataaaaagacttcactgacacatttcacaggctaaggaagagccagagagcttcatggtatttccctatatcacagaactcacatatcacaaatgtaatcttgggtttttggctcttaccccaggtactgttcattttttaacaaaataaggtacatatgttttctatttgaaatcatagaaacattctttatcacaaaacaaaaagctttacaaattaagcttataaagtaaaaaagttatactaaaataatattaatttattattgaagtaagaacaatttttaaataaatttagtatgcctaaatgtactggattttaaagttctcagtagtgtacactaatggactaggttttcacattcactcagactcattcagtgactcagccagaggaactttcagtcctacaagctccattcatggtaagtgccctctacaggtgtcctattttaaaaaatatttcatatggtatttttactatacattttctatgtttagatgtacatgtacttaccattctgttaccatcatctgcagtattcagtatggtaacatgctgtattagtccattttcacactgctaataaagatatacccgagactgggcactttacaaaagaaagacgtttaattggacttacacagttccacatggctagagaagcctcacattcatggcagaaggcaaggaggaggaagtcatgtcttacatgaatggcagcaggcaaaaagagagagagcttgtgcaggggaactccttttttttttttggagacaaagtctcactctctggctcaggctggagtgcagtggcgtgatttcggctcactgcaacctccacctctcgggttcaagagattctcatgcctcagcctcccaagtagctaggattacatacacccgtcaccctgcccggctaatttttgtattttagtagagacggggtttcaccatgttggccaggctggtctctaactcctgacctcaggtgatccacgtgcctgggccatccaaagtgttgggattacaggcatgagccaccgtggccggcagggaactcctccttttaataccatcagatctcatgagagttattatcatgagaacaacacaagaaaagcttatccccatgatgcagttacctcccactgggtccctcctacaacacgtgggaattcaagatgagatgtgggtggggaccagccaaaccatatcacatgctatacagatttgtagactaggagcaataggctatatcatacagcctaggtgtgtagtaggcgataccatctaggtttgtgtatgtacactctatgatgttctcatagcaatgaaatagcctaatggtgaatttcttgggacatattcccatcattaagcaatgcatgacttaacagaatgtgcagacagaagcagcaaaagaataaaacaaccttttctctctagtgactataattgtaatcaaaatagacagaaaaaaatgtcatttttattctataacctccctcctgtaaggaaacacagatgaaacaactacatacattaatttaggaaagtagtgatatactaaaacataaaacataagtaatgatatactattttgcattagaattgcagtttacaagtagactttactctcacttgctttcatcacgtttgttcaggttagatgtggacagttataatcatcttttttttttgtcagtgtagaatagaagctgaaaatattgctctcccaccaaatatggcctgatgccctttgtatttaaaattgcattggaccacagctaagctcctttgtttatatgttatcaacagctgtttttgcactacaagggtagagctggtaagttgtaatggatggaaactatgtgccctccaaagcataataaatgttctgtctggctctttgttgaaaatgtttgctgacccccaagaacgagactacaaaattgcacatgtccccctatattttgatttctttatagttatgcagcaaatttcacaatgatacacaaatatatatgtatgtgctttggatgacagtcatttcacttacaagtggctttactaccattgccatccatcaaaattctatactctttttccatttaattttcaatgtttcattattttgcaatcaatgatgaagtaaccaataatcctaagagtgaaacaatgttaccttatcacatcctgttcctgtccatgtgcatattctattttttctatttgtaataggcagaaatttatattcttcatttttctgtctcgatgattccttaattggatgtagtttttaatttttttctgtatattcttctctattctccagtaccccgaaacccctcaatccatgttaattgcctagtttttacacccttcaaccttttcctcagccttgtacaattacatagattcaaatgcacatgtatagaagttcttatcattttctcatgtaactgtacaccttgggagtctaactagattagtttataaatatctggtcaaatttttaatgattgccttatatacatgaatggaaaaaaatgtattcaattatttctctattgatggctattcagggcattatcaattccacaccttttcttttcactaaacattacatttagtacaattcttgtacaaatattcttacatactatcaagtttgtttctacacaatagtttctgctgatgttaatattttccttatctttaaaccagtgtttctcaagtatgaaatttcggcatctagttgggcacggtaaaaatgcaggctactgtgttctccaaacagatatactaacttactaggcatgggatgggatgtggtccatgtatctgcatgttggtaagttccctatgtgatgataatgtacactaaaccactaattcattgctctaactttatctaaaagaattcttcttatctttcttcattgaaaactttcatctggatgtaagattttcctccttggaatgaacatggtggtggctaccttgggacctttatttttcttattcatatttttattttaatcaagccaaagctgtctattacaatttattaaaaaattattttcaacaagaattttttcccaaacttctgatctttttttctcccgaaatataataaacatcaattatttttctttttttttttttttagatggatcctcgctctgtcacccaggctggagtgcagcagcgcgatctcggctcactgcaaaactcagcctcccaggttcaagtgattctgctgcctcagcctcccaagtagctgggattacaggcatgcaccaccacatcaggctaatttttgtatttttagtagagatgggatttcaccatattggccaggctggtctcaaactcctgacctcagatgatttgcctgcctcggtctcccaaagtgctgggattacaggtgtgagccaccctgcctagcgaatattaaatttttttaagaagatattgacagtgtcaactaggatctggtgttttgaagtaaaaagaaagatatatacttgatatttactgaacttaagagtatagggaggatccaggcaaagataaacaacaaaagaaaacaagtatggaagtaattaaaagataatataacgatttttaaatcattaggacacctgctacttaacaatatacctcacaacgtgacatcatttccctgtctgatttcagaatggggtttggcatacggccaatgattagctctctgcatatatttctgcacaatactgatgaaattttagaggccgatggtagaatgctttatcaagtctgcagaattaggttcagtgatacccaacagcaataactgcattttaacagttttaaaacttctttttctttggaaacgttattttaaccaaaataatataattgaatgaatgaatgaaaccttacaggaaaattctgtgcatttcttacagcatattaagtccccattaatgttgaagattcctgaatctttattacatggtgtagtgtatttagcaatgtgggatggatggtggtcagaaaccgggaccagagaatcagactttctggaattgggttcaggctggaccagttacaggcaatgtgacccaaggcaagtttcttctcactgcatttcagtatcctcttccatacaatatggacaaaaagcacctactctgtagattggatgtacagagtaagtgagataaattatagaaaagtattttgagaactatctggtacataataaccaattaataaatgttagaattatctccataataataatgtattcccacaatgtttcttttctgtccacaatataatatcatatataaaagatatctttattttgatcatttcgcacagataactttgaaatgttatcttgaagtttgtcattacaaactatggagtgcatatcacataaataaagatgaaaaaaggtaattaacataagtacatgaagaaaaatttcattaatcttttttaatgcagcaacattaatttataagtgtatatatattttgtcaaataccttatatatacagacatatatgaagtatgtaagggtacatgtagtgaatatgtgtgtatatgtatatttctgtgtttatacacttaagttgatttccctctctttaaataaatgtagatattgaaaatatcaatgagagcaaaatattttttcattttctaaattaaaacacccatttgaaatgtctttctagagaaatgtgaattttaatctatgttcttttacaaaatgttataaaagatcatgaataagcatctaccataaaagcttgtgtaggttctttgaaagaaaaataacattgtttctcagagttgacacattataatggttgatgttattaaaagtttagtaatatttcaaaggaacaaagataggaaaggatctgcagaaattcattatgtgtgacactgttttatgtactcttttcataaaaatgtgtcacctacactgaagcaggcaatgtgctttttactcatgatacagtgggaacagataactttggtctttggcctctaaaaggttgtaatctaatgaagggcatttataaataatttagtaattatactatggtacatgacttattttaaaggtatgagtcattccattatatctaaggcacaagatatttcaagaattcatctattgtaagttccataagagtgtaacaagtgttgctagtgccgtgctaaagaaaaacacctcgcctagtcttagggattcaaggaagtcttacggtgttaatgtgaaatctatattaaaagtatgaattggtctaaaaaataaatgtaacataattcttactaaagtaactctaaattaatctgagctatgagtaaaggattagctggagtggggagaaaacgaaatacgtgagatttccggtatttcataattatgtcttccttattgatgaagcagaaaacacaaaggatataaatgcttgacaaaatttaattttctctaattttattcagttatttaaaaaattaataaggagtcaagcaaaggtaattaatatttaagaaaatgcaatttttatccaaaatgagtttgtgtacagaatattaagtttagctaatcatggttacattcatttattatgttatttttgtttctatacttgcttttaaaaaacccaaactttaaaaatgcctgtattttctctcttttctttacccttttaaaacaattgactctgtttatgaaactaacccgttttacttctcctaaaaggtgtgtgtgtgtgtgtgtgtgtgtgtgtgtgtgtgtgtgtgtgatacacagtgttttctaattttaaactacatccttattttatgctcttggattttgaaaggttaggttcagctactggaagtatcatattttgcttttcaccaataatcaacatttcaaaaaaatcctctctctgacttttgtaaatatccatttcattttacacctgatttcctaaactagaaatttcagcgtgatcctgaagccttcgatgaaattacacagattcatggagtatgagcactggaatatcataatttgtgccacacaattttaggctgcttcaatcagaagatttaggtcacagaattgattcttaatttattaaaataataattctcttcacaaactaaatttagaatacatatagaatctatttctcattcctcaaacaacattaaatacgaaaaatatcaataataataatagcaactttcacaagtaaaaatgtacatattttatatattcgaatcaaattatcattagattcatccaaaataaaaatttctacttttactctatataggagaaaattgaatcttagaaaggctgtggggcgcagtggcttagacctgtaatcacagcactttgggaggctgaggtgggccggtcacctgaggtcaggagttcgagaccagcctggccaacatggtgaaaccccgtccctactgaaaatacaaaattagctgggcatggtagcagggacctgtaatcccagttacttgggaggctgaggcaggagaatcacttggacccaggagacagcagaggctgcagtaagccaagagcaccgctgcactctagccaggggcaacagagcaagactcattctcaaaaaaaaaaaagaatcttagaaaggttgaataacttgaccaagactacacatgcagtcaagggcaaaccctggatttgagtccacatttcactgcctcccatgtccatgttctctttgttccaccaccttccagtctagctatcataatgctcagataccctgatgatgtgctatgttaaattatacgtatttttctacatcttaaacttcttctagaagtccctcgcaatgactggaaattgactcaggcgtcatgacaaatatactcaaatataaaaagacacaaaattatatgtaaatttttattgagaaatttatttaaatacataatagagaataattttctccttttaataattttagtgtgtgtagtagaggttcctttctttcctcagtttctaactatacaatggctagttcaatttccatttaaatattttaagtatcagagatacaaatctggcctttggaaaatcactgaaggtcactaaataatttgtttgtaaaacaaggaccgtaatacctaattcacagggtcttagtgagatgtaaatgaacaagctatataaagcacccaacaaaatggatcacttgaggtcaagagtttgagaccagcctggccaacatggtgaaaccctgtctattctaaaaatacaaaaatagccaggcatcatggcgtgtgcttgtaatcccagctactggggaggctgaggcaggagaaccgcttgaacccaggagacggaggttgcagtgagccgagatcgcaccactgcactccagcctggatgacagaggaagactccgtctcaaaaaataaataaataaataaataataaaagcatgcaaagttctcatttaagtgaaccaaaacctgaataacttgatcccaaagtcagctctgaatagccatggcatatatgccacctcaatagaagatttcacatgctacttctctatgctaagtaattgagaaggtctaatgtattagattttgatgtaggctatctctaactttcaggttctcacaacaaagtgccatgtatgaaaaaagaagatttaaatgttgtctttctgaataaaacttattgggcaaatttccaaatatatctaaaagtaaagtaggaattactttatattaataaatgactaaaaattgaagtattacttcagaaagctaggcatttatacctttgtatattataagactagatcaaaagagacccaatatttaaaagtttatggagctgctggagtaagataaagattctatatgcagaatttattatgttcatggcatgaataagaaaagcacattataggcagattggttcattattggttatcaaagacaatagattaataattttaagtgaatataataaaatctgctgtggtgaggataaccatattcacataaagaatgaggtatatattgatatctcttcagtagcaaaagaaaactcactgatggaaaatatacaataagtacaagtttaattcatttgcaaataattcacatcttcccaaagttgtctttgttatttctattggtttcttattaccttactctagccatggatgtggctacagactggatacatactgaactacagcttttctttcatgctatattaaatactaatgtggcacatatacaccatagaatactatgcaatcataaaaaatgatgaattcacgtcctttgtagggacatggatgaagctggaaaccatcattctcagcaaactatcacaaggacaaaaaaccaaacaccgcatgttctcactcataggtgggaattgaacaatgagaacacttggacacaggaaggggaacctcacacaccagggcctgttgtggggtgggggaaggggggagggatagcattaggagatatacctaatgtaaatgaggagttaatgggtgcagcacaccaatatggcacatgtatacatatgtaactaacctgcacattatgcacatgcaccctagaacttaaagtataataaaaaatatatatatatattaaaaaaaaaaaaagaaaatcaagttagatgtacctaacctgggaagtgactataacaatttctaaattcaggggacagagtgctcaccattaccccatggaaccagctgttgactataacaatttcttatcgcatttatatatcccatagatttatacaggatctgaatattattttatatataaaatgcttttcataaatgttaactaagaaaattttatgaaaaccaagatagattttagaaatgcaaatggaatctacaaatctacctcttttcctagaatgtgggatttcatgtgcactttccctcaaaagacttcacaaatatcaactgttctcaagtaattcatcccatgaatcaggtgtaggcagggcataaaagatcagagagaagcctttaaatttctgtgacatgccagcatgaacacagtgtaatttgtacctttactggcagaaaatcaggaatcatggacatatcacacctacttgatgtttggctttaatcagtagttcaaactgaactcttcttaacactgttacctttgccacagaggacaaccgtacccaaataaaaacttcacagaaattattattcttttgtgtgttttttttttagtccaaattgaaatgtttaagtcattagtgaaatctacacagctctttaattttggatcagagaataaactcttcagtcagtttagatttaatatgattattttctttgagtataatctgaagattaagtctaagtatacaattatgaagcccatacagcaactttaaaaaaactattacaatgattttataatttcaaaaaacacattcaaaaggaaaacttgatttgcttatagttctctatacttacttggcatttagtttccctattttattaattcccttcatgtatccattttcatttcttcattttaaaatagataattagtctttcttttattcatttgtgaaagttctttatacaatatggatgtcatatattcttctataaactaatctttattcagcatgcactgtgagatacatagatgctggaggtacagtgacaataaaaatccctcccctcacaagcatacaaggaaatctaaactgtgtacataagttactaacaaatgctgtgaagataaatggttaaaaagcattaagtgacaggataaaaatggcagttagaaaagcctggagaggctactacttcagtagaaaccagaaaaaagtgaggcttccacttcctactattcttgggggattcttttctgttcatgtgttgctatgtcattgtgtatatttaattttatttttatgttattttgttgttttttaaatttttatttgtgcagatttatgaggtgcatgtgaagcttttacctgtcttccatgtgtgtttaaagaggatataattgtggtgtgtataattgaggagcagatataggttattgggttcattcatgctaactttttgaccaaaccttagtaaacttgtaatgcatgttcggttatttgagtatgatactggcatcagtattacacatttatgaagaatctataaggatcacaatttctattctgggtacagtgtataacaaggatatatcttctggtcttttgagttatctgtcttccaatcaagaaaacagttctaggaagattcattgtttctttccttcactatcttcaaacttttacattcagtagcactttctacaaatatctacaatatcatcattttactctttcagtcctatgaaacaacttgactctgaaaaatttagaggaatgcctaaaaatactatggagaatggataatttaataaagatatactcacactaatttggttgtttttatatattaatgtgtcaaatacagagaacaataaaatgttattcaaccaaaattataaagatatcttgagtctagagcacagagtagattaaatatatggtgtttcaggtattttaaaattaagattctgagtacccatagctttgaaatattatcgaattctatatataacaaggtgatatcaacatgatatgaaactaaaacgaaattctatgaatcagatattttaaaacaatgatagtgtaaagagacatattgtaaatatttcatagaaacatgctatcgtatacagagccacatatagagaggacaatctcatatattcgtaataaaatatcatttttatggctttaaagataaataggagaagctcactgatctttacttactgatatatttgctttgcttataattttgaccacaaaatttaaattctcccttttgagctttgaggcagaggcaaaattctgacatggtttggttgatcaatttcaaaattaagccaaggcagtggtcaacataggcttcaagagtttctacttactactttcttgtcttatgaaaaatacacaaaaggaaagataaaaaattaataaaagagactcaaagtgttccttggaatttaatagatttgtagatttaacctttcttaggctggtggaccattggttgttaatgatgtcagtgaaattgctaatcaaactggaagtgccttcaaattaattgtaggtgaccttgggaaaaatcattatcttctaaatggatattcaaccaaaggtaaaataatttcagacagactttggatcattaacttgtgactgcaaatcctcttttctaaaagttgtttactctcaagtaaatatgccaatgaatcaatttcacactaaaattaagtttccattaaatttgataatgcaagcacacataaaacaaaaacatatagccttgataaatcttatatgcacttttctcttctgtattacacatttttgtggcttcagtatatattaaactaatctatgtaacctttcaaatgttctcattcatctttaggacactctatacctttttctttttaaaaaaaaattcactgtacttgaaaccaccttttattttatatcagtcaagcttggcttttgtgaatacttttttaaaaaaaatttggtaggaaaaagatatattaaacttccaaatatcttttggcaaaaaggcagggagaacagcattcttatacatggttgaggggagaaaattgcttccaaactgtaatctggaaatatattaaaatgtattttaccctttgacccagcagtcctacatagaggaacccaacacacagagaaaagcaacaagaacaagttgtttgctgaatatgttttgtgatttcaaaaatctaaaaaaaatccataagaaataattacattaattattgctcagtcatacaattaaattgatctataagtgttgtctaacaatgatgcaaattatatcttgattagtgataaaaagccatctatctgttatgtacgcactgagcttatatctttaaaagacaaaaaagataaatccttatctaattgtgtttattttcatatgggcattgagatatagtaagcagagttccattctataccattgatattggtgaatttgaacaaggtatgaggtatgagtgatgttgtcaagagttctagtaattctatttcattgtattttctcagttgtgacaataaacacatttttttaaaatttcaaaattaaacaagcttcaaaaaatgttaaatatgaaaaggtaaatggtaccaaacatattctcccaccagaaacaatttaaaagtggacaaacaatataagtcaaggttttcaggattgaatgacaaagtatgtaaaattacaatccttgaaggaagaaaatcacaaaaagtgatacctacttttatcaaagctttcgttggcatatggagatggtgcccatgcagagtatctggctccttttgacctgagaagctttagactgaaatgtgggtttgaggatgtagctggaattgtggacagggtactgaaaagaagagaaatgctagaagggaggaggaagtcaagaagggggtcttgagtgtttgcatggggatttccctgggaaattagtcaaagcctaagatccatatgtgcagggaaagcgtacacaaagcctctcaataaatggcaactgaggaacaaaaaacaataaaacttccagagaccatgcaattgttggagttcaaatccagtcgtaataaataaacttcaccgattcttttaggaaattggtagagatccaagtaagaacaaaacttaaaagtcagaaccaagccataacatttctcttggaaataaagagaaaagaaaaatagaaataactaagaacaaagcagtctgaagaggtgtaaattatgccagtaaagtttctgatgtaaaaaaactcaaaaatctttttttttaaaagacaacataatacaaacccactacaacatattatccataaagcccaccataaaaacaaaacaaaactaccaaaaccttgacatacaaagaagcagaaaaatgtgacccgtgatcagacaaaataggattcaacagaaacaaaccaagaaatgacacaagtattggaattaatagataagaattttaaaagcctagttataaacatgttaaaggacttaaaggcacagataaacataattagttaacaaataatgaaatttcagtagagaaattaaagctataaaaacattagaaatcttagaattaaaattaactatctgaaatgaataatttattaagagaatttaacagcgtattcaaaattgtaggaaaaatataagtgaatctgaaaacaaaagaacaggaatcatttaacctgaagaacagagagaaacaaagtgtttttaattagcaaaggcttagtgatatgtagaggaatatcaagaggtctaatacacgcacaactggagtctaagaagaagagaagcaataaaatggaatgaaaaaacatatataagatatgatggcccaaatactactaaatttgtttaaaataatcaatctacagattcaaaaagtttagtaaacctccaataggatgaaaaaaacacccataggcacatcataggaaagctgtaaagaatcaaaaatgaaaaaaaagtaaactcagctagaaaacaaaacaaaatacattcataaacgtataataatgtaactgctaaatttttaacagaagcactgaaggtatatatatgtttcaatatagcactctgagttcacaggatgccttcctatctttcagcactttaaatatgctattcatatatatatatatattttaatattggggacgatataaagcatattcaagtaagctctaagtgaatttttttttttgttttttgacatgaggcacaaaactatagggaatattaaagaaagtccctcaggcctaagaaaagtaatactcaatgtaaactcagatgtaactgaaggaattaaggacaatagaactgggaaatatgtgtgaactactattttagttctattaaattatttcatcctgtactattgttgtagtacattttacatctaaaaatatctgaaaccacacagtacaaagcaattatttttgttcagttaattatttttcataatcttttaaaaaatcagtaaagtgctacaaaaaaaaaaaaaaagaatactatgtcatgaccaattgaacttatcccaggaatagaaggttggtttgagattttaaaagacaacctgtaatttgctacattgaagaaaaaataaacagaaaaacatgagcactcaatagatgcagaaaaacatttgacaagtactaatacattttcacaatgagaaaaagttaataactagtaatggaaggaaaatttctcagtctgataaaggaaatctacataaaaatttatatttaacataacatgcattactgaaatacaggttgagtaacctttatccaaaatgcttggggccagaaatgcttcatatttcaattttttttcagatttggaaacatttgcatataaataatgagatatcttggggatgggatccaagtctaaacacaaaattcatttatgatttctatataccttatacatacacataggctgaagggagctacaattcaagatgagatttggacagggaaacagccaaaccatatcacatatttatctcagtagatgctcaaagatgatttgacaaaacccaacactcagtttaaaaactcttggaaaaacaggaatggatggatatttccttaatgtaatattgtataaatacatcaatctaaaatcaatatcttatttaaaggaggaaattaaaggagaaagagcaatttccactagggtcagaaacagggcatgggtatctaccatttttgccactatttaacatcattgtagagctaccagtcaattcaatcaggaaaaggaaactgaagaaatatgacaatagagaagagaagtaaaactatacctatccgcaaatgacatagtagtttacctggaaaactttagagaagcaatgataaacctaattcaaaaaataagaattctgcaaattagcaaatagaacactaaatgcaaaaaaaaatacaggcacaaatgataatcagttagaagaagatataaacactgagaaatctcataccaaagtaacaaaaaaatgttcagaaatatacccaagtatataaaagatccaatacatgataaaagtggtatctcaaattactaggacaaatgcgatctttttaatagattgtgttagagaagatggatagctatttagaaaaaggtaaaatcattttctgttcttcaaacaatacatcagaataaaccacaagtagatcaaagatacataaaatgtaaagctatataataactgaagaaaaatttattaaattcctctatactgggtataggaaaagctatcaaaatatgcctaaaaatccagctacaataaaatatgtatacatttgaccacataataacaacaggaagctttcaaaggaaaatacataataagccaatgatgtgacagtctggaaaaatgtttgaaatatattacaaacaaagtgttcatattctgatttatgaagaacttttgacatttgaggagaaaatgattacaaattctttagaaaattgggcaaaatcataaacacacaattcaatatataaaatagccttaaacacgtgaaaagatgtttcattttgctcatggtaatagacacacaaatttgactgtactgagatgccatttctcaacagtttgaaaaaattggaaagcttaataaaatactctgttagtgaggttgtaggaaacaggcactcttacaaactgcaggtgaagattacagaagtcatagatccgtttgatgaaagagcccagccacagaggcaccctcacagaaatgagcacaactagtgactaaaatttattctcttaacattttctagggaaagaaacgagggctccttggagaaatggctgattctagaactaggacaggccaggaataagatcctggaatgtcttgttatgctaggaagttatgaagtttagttaagacagtcacaagcatacaggagcttgaatgggaacccactgggctaaatccacggcaaccttagcaccaaaatattaaatgtattaagcatcaagataactagtaaagtaataatcataataaaattgaaaaaattaatgcaaaggcctatacatataaaatgatcatttataaataacaacgaagagaggcagttctcttgcttatactagaaagtcaaatattggctggttgatgtggtaataaatctataatacataatcaagattggatcagccaaaaattatcagtggattggaaatctaggagctttttaagagcagtgagatatttgcatggcctgaaaatgttttttagcagacagtttattaattgcaaagggggaagtaactatacagtggggaaaattgacctgttcaagtaattaaaaggaacattgccactaagggatctatgtacactatatgccttctgatgcggaacacttataaggaccaaacattacctgtgtagtattccagctgagaattcataacttctttctaattatgagaaacaacagacaaaccccaaataataaaagttatattcttttaaaagagcaaggaataagagaagtatgttcttcagaaatatcaatgtcataaactagaaagcctatgtaaatatttcagatgaaaggaagctaaaatgttatggcggctaaatgcaatacccaaattttgttggatcttgtactggagatttaaaaaatgcaaagaagggcattattgtgtcaatttgcaaaattgaaataaaaatagatgatagtattgtattgatattaaatccactgaaattgaaaactgtactctgataatgtacgaaaatgtccctaagaaaattcatcttgaagaataggagtaaagagctgcaatgtttgtaattcattctcaaatgacttaggagaaaatacacacagacacagttacacacacacacacacacacacacacacacggaggtaaggaggccaggacaaataaagcaaatggtgtaaaatgtagataataggtcaatctgagtaaaggctacatggttatttttttcatgtttttatttttgccatttttctgtaagtttgaatttatttttaaaaatttaatataaagcaaagtaaagagaccccaggttatcttgcaactgatttctaagcgcttaatctgttttggttctttttactactttattctaccatgcaggtctccttgctgttttgctgagttttagcaagcaaaatactcacctgagggcctttacacctgctctctcttccttacatattttgccccttatttcattcagttctgtactaaaagattgtcttatcagagagacatatccttattagctcttccaaaatggcactcaccttcatccattaatatcccttaaactgatttattttcctcaaagcacttgctattacttaacatgttatatgtttgctgtttactttttatctccccttagtagaacactagtcaataagagcagggactttgttttattccctactacaaccctggaacataaacagttcccggaacaacgcagacactcaatgcgcatttgttgacaaagcagtaaatgctttgaaggttaagtaaatgcatgaaggttaaataagaaatatgaatttatgaaattcaaataaataatgtagatgatgacaaaaggattactgttcctaaagatttttaaacagttttctaatttacaaaggctttggaaattaggtagacataattctaaaaattcttattttctataatgttttattaaaatctgttatttttcctaataaatacttaaatttaaccaaaaattttcattggaaatcctaaaaattatattcactaatcagtaaaaacagggaagatctctcttcttcttttaatctttaaatttagaaaacctgtataaaaaagaagagtctttgtaagtgcctttggaatatttcaatatctattgatatgtatgggcaataatcatgaaatataatgaatatgtcatttcaagaaaccaagttctgctataaaacattattttcataaatataaagaataagattttaaaaacgtaacacattttcaaagtactgtatgagtccaaagaattttacgaggagaaataactatcatttctcatcaccatgtagataaaaattgtacatggttatcttatatgcttgagttattttcagacaaattatgtattataaatcactaaatgtactctgtatatttgcactttcaaattaaggttgctttcatatcattttccctaatgaaaacatttcaaaacaactcatattgacctttttattttaatcaagcataagagttgtgattgtgatttttataatgattcccatggctttatagacaatttgacatactttcaaagaaattggaatttttgttcgatgttaattccttttgcatttctgaattttcacatgatatttcggcttattttgttttttgcaagtttgtgcaaattgtttgaaattagctcacattcaggtggttatttaaaaaatgaactatttttgagatcatgttcctcttgtttattacttcctgagatatacttcattttgcttattcctaaaaagagtattaaatattatttatttatttctatttttccaacaacttcctttactaaacaggtcattttaatatttactcaaaagtataactccatattaattaataaattaatattatttttgaatgaattaatatttactcaaaatatagctcattttaatatttactaatattactaattgctgcttttttaaagcaagtcagattttattgttagctcaatgaaatttactataaattaattttaatctagcataatttttaagatttttgtgttctgatataaaataatatgtcaccaagtgcaagctctatgacttccttgttttgtgaccttgggactttttgaaattcttcgtttcctagtttctttatttgtaacatgagtatggcattagtacctgctcagtatggttgcaacaaacagaaaaggattaatgattgtaaaacactttgaagaggacatggttcattgcaataatatatattagcctttattatttatatatatttttacaacacatgctgacatggagaagtttcaaaacatttttgacaattttcaacttgtcaagtatacatatatatatatatatttatcttaaaattattgaacatttagtgtctgtggttttattctttcattatttcatcaaatatatatcaggcactttttaaggcaaaatcctactttaagctgtgtgtgtttatgtgtgtgtatgtgtgtgtgtgtgtgtgtgtcggtaaagtattcatgtatctgtgtgttgtatataaggaaaaaaaaacatgtttctgctactaaaatacatataatattatttccagctactaatcggtaatggcaggcaagtatacaagtaattccaaggaaaaaaagaaacttaagaaagaattaaaatcctgaatgtgggctgaaaatgaaaatgatcatccacattttttctagcatgttcctacaacatctaatcttcagttaagacaaatgaacaataataccatggatttcccatcagatagaccagatagatgtcctacaatttcacaccttcaaagacctacacaaaaatttcccaagaagtctaggtgctattcgtttttggttaaatagtatattttctttgtattctgtgcttaatattgttttaggttctgctttttaaaacctcaacattttaatctaactttgggttttatactaattcctctttggttgatttttattttgtatttgcccattactgaaactggtcctcctgtctctattttgcttcaataaaccccattcatctatagacatctacaatcgaggctttacattctctgaaaacaacaaacatattttgtgaaaatattaatggaattatataatgaattactatccctaacaaacatccatttatgtcaattattattctcaaactgtgtcacctatataaataaatgacatttgtattttcatttaatctaccttctaattatatataacatctgtttgtagcaatatatttttaacttagaatttttgtgaacagtaaatacattagaggcaactaaaatatgttattacatggatatcacactgcaataataatttacctaaataatatttatatagtgggtccttaaaaatagaacattataattactataaaatttgtgtgtgtattaaccacctgtgtcttccaacattcacagaggagaggcaatagatgtgtcttgtacaatgattaaattctggctcttgtgtaaatttttttttttaatttttctccttatcttctcatttacctttgattattaagttcatctaagaggtatgaaatgcattgtgaaatggggattcatttgcttattgaaatagaatttcagcatctgtgtgcaattactaaaaatttagcttgaaaggtaaaattttctatctcagcaatttagagctaaataaatatatgtattactgttttcttctcttaatcttaatatgaatctgatcattttgagaagtatgaaggagattatttcagaggtcctgcccattaaatgccatgctcttttccattactgagttaaaggtgtttatattaattgcaaagaaaacatggaaaggcagtgttgttacctaacgtcctaggattatcaaatttgattaataattagggaaagcagaggagtgactaattccattgaagtatcattttggtgcattaatggcaaaaattgtaattatttctgcaccgtcctgaaaatatccagaaagaacattcagaaaaagttctctgttcttctcttgtccactagtgttaccttttagtttaatttattgtttctgctctcctttctactagtcagatgtcccatttcttttatctcatcagtgagaatttatctgaatatgttaagaagccagagcagtttagcttttaaggaactggaagccattatccttagcaaattaacacaggaacagaaaatcaaataccacatgttcttacttataagtgggggctaaatgacgagagaaaaaaaattctactcttctttacttattggtacactgactaaacaaatgtgctacattgacaagatattgttaattacatagacaaatttctttgagcgcactctgccaagaacagttggtatgaatgtcagatgagtaacatacaattcagggggaaaaaagctagataatgaaaggaaattttgagttagagctgtacctgcgagtctccagagaatttctttctttaatcaggttagtgtttgatatggtctggttctatgtccccacccaaatctcatactgaattgtaatccgaattgtaatccccacttgttgaagaacggacctcatgggaagtgagtagatcatgaaggctgttcccccctgctgtcctcatgatagtgagtgacttctcacgagatctgatggttttataaagggctttttcccccttcccactgcacttctccttcctgctgccacgtaaagaaggatgtgtttgcttcctcttccaccatgactgtaagtttcctgagttctccccaggcctgtgaatctgtgaatcaatcaaacctcttttctttataaattacccagccttgggcagttcttcgtagcagcggtgagaatggactaatacagtgttataatgttattatagtggctcacagtttttcatagttcttagtattttcctcataagaaggaggaatgtgatgtaaataaatcttcatattaaaaatattacatggataccaactaatgtgcccaaaccacaaatattaaaatctgctatgactaattaatatggctacaacatggtttatacaactttacataaatgtatgtaactacattatatagatatactgcaatcctatccttgcaagtcaaaaagcagttccacagatggcatgtatgagtatgtctgaaaaagcagatgtttgacctggagtcatttctatcatgcatatggtccatcccttggttcgtttttctggccattgttgaatgacttgtccagccagtgttctgcaatgccttagtggaaattaactcatgcactactggttgttagaaacgatgaagttagtgttgcttcttgattgtcaacacatattccactatttaaaatatgaattctagatcctcagaagaaagcagtgcacgggactaggattaaaagccttaaaactcttttcctgcccctgaagcaggcttccttgaagctgttgcggaagtaatttacctttctgcaactgcttccttatatgaacaataggtataacaattgtctttcatatcccataaagatataataaagataaaatttgatatgttttgaaacaatttgacaattgtaccatgatacaggatattgatattactgactttctgggattgcttctgcctaatattatctacatttaccactcacaaaatcagatactttactaggattattctattttacatagaaatggaaatatagtacagattgggttttaaaataagcaaaaggacttgctcttgttctcttccttttgtacacactttccacaacaatattcttttacatcattatttttattcatttatcaaaaaatggaaaaaaggagaaaatgagaacaaataaaaattagagaaataacagaagccttgtagaggagaagctggaaaacttttatagtaatttctcctgtaaaataatgttaatagcaaattctgatgtcaataaagaaaggttgtggggtctgtccattctaggacatgtgccttacttcatcaatagccagagtagaatggattaaaagagaatgattggctctgatctaactcaaaagaaattaagatattgaatctcttaaatctcttaggaaacaaatttactaattaaaaagaaatataactttataaggatcaggcatgaatatcatacatgatatggtttgagtctttttccccactcaaatctcacctagaattgtaatccccatgtgtcaggggaggtacctggtgggaggtgattggatcatggaagtggttttccccagagttttctcgcgatagtgagttctcatgagatctgattgtttaaaagtgtttggcagttcctgcctctcttgtgctctctcctgccaccttgtgaagaagatgcttgcttttccttcacgttccaccataattatgttttctgaggccaccccagtcatgtggaactgtgagtcaattaaacttcctttatttataaattaccccatcgcaggttctttgtagaagtgtgaaaatgcaccgatacaatacacagtctctctagaaacactcatagagtgctagtttaataattacagtaaatcaagagcttaatgaaaatctctccaaaatttgtctatcaagatgactaaagatcaagccacctaagtcaaaattagaagtcacataatctgtgttcttaggtcatttttttaaatttcacctctcttacaacaataaattggggttatcatgttatattttgccttgttttttggtatatttttatgttggttgttaacataataatataatgtaataacataataatataagctatagcttatggtcttcatgtttttaaataaagaaggttttcctgtcttcttaaaaacttgaaacattttgattttgccatcatatatttaatttgtttacacaccatatttcaggtccaccttcccctatctctgcctaattataggagtaaggtaaagataataaaagtaacaaaaggaaacctgaattatgattacatagtgctttgtatttcaaaatttatttcattgtattatctggacattgggctcaaaatgtgtaaactctaatagttctatgtttataaggcacctactcttagtctcagataaaaaattcactggagctgtacaaaaatttgggtattgtacattccctatactggaaaagatatcatactcacagaatgccatgaaaagggatttgaacttccccttttaaatacatttcattgagcactttaaaaaaaaaacagggccaaacatatggatggttccatatttatataaacatcctcctccttctaatcctcccacctcccacatattctgttggttgatacactaaactctgccttctgatctctcaaggatagcgaaagagtgtgaaaatatgaaaggaacccctgctaagtatttcatacttaatgatattcagatgtcattttggaaaaactacatccaaacagcataacaaagggtaggtaaattacttgatacttgctctagtgaggctgtagaaataactgacgtgtataaggcctcaaagcattttcttcctactccatataatttagtgcccatccatgcaaaagtataagaagattctcccaccacttaaatatctaagtacataattcaccacgttcaagttcttaatcatacctattctcatcatacatggttctatctgcattattaatcatgtatctccttactttagtcttgcatggggtatctttgaagtgatgaaatgggaattataatagagaatctacaatttgacagacatatcaacaatttttctgtttcaataatgtatgtgaaattatattgggcattatagttacatatgaaaagccacagatactcagtacagtgtaaaattatgtggtgctgtgaaactatcctttaagtgtgtatatctcacatgttgtttataacgaacattttgttcaaagatatgttgaagggatatttcttgttggttactttttaatgttcacatatattgtgaattgtggttctttttgaaagatcagtcactttgcttaaataaacaagtttcaaattagttcctttccattaatgagtagagtccaattaaagagaactttaaaaaacttaagtctctttcacacctttgccagcaaaaaaaaaaaaaattatattcagtacttggtattcattcacttaggagccccactatcctagagacttgggcatattgccaaagagtaaggcagatgtaacctgagctcacagtttataaaatcgtgaattaaggaaatagtagccacaacttggcaaagtcactgaaattatatacaaatataatgctgacatagatttccctctctaaaaccttgaaggctttgtaaacttgaagtatattacctatgccaacagcccaattgttctgaaatgacaccacccatgttttctcggcctaaaattttctgcttcctccttactcccagtctcagataggttacttgccctcatcacatactctctagtgtcatataatttgacctggtaatgcttattttacttataattactctctctatacctgtattttggccatttgtctagaccccataccacgtgaagaaagggcttgtgactgctgtgtttaccactgtgtttaccatgtccagtatggaacctgccagaaagaaaaatcatcaagagattgttaaatagagttaactgtctccattatagcatgtctgaaagatgctgagataataggttctgggtactttggtttctgatgttttaagttaatacatggatagaaattaaggactagcaagattgctagtgaagacctccattaaatagtttatctcaattgccagatgttttaaaattgccttatgcaggtgctggatagacaacataacatctgttgatttaattagaataagtttaacatctttgaacttcagttttttttccttgtagaattatgggattgattgaaacactaagtaaatttcctttcagttttagaattctgtaataatttttatgttgcctttctgtacataattaaatattcttgtataatactcaaatttttgtacagctccagtgagctcttgtctaagcatagatgtcatcagaaccagagaactattagagtttacatacttagagcccaatgtccagagaattgaattaaggaatctttgaaagtaaaagtataaataggtgatccaaagaccattataccctcccacttacagagtacttactgtttcagttcattacatattctaaagacagattttatttaaatgtttaacattacaccaagcatcccctgttattaatgtcttaacactgactctcagcaagtttgtttctaattttgctctttagtctacttctaaacccttttcccatgttggttttttatgtttgaaaatggatatcagattatcatattttctataaaatcttcacttatgtcctccagaataaaatttctcatgtaataatacttttttatatggacataatttataataatactaattgtgtccttcagcttacaaatatgcccatcacacttgccatttctgttcattttcaacaatatataaatgtcatttaaaaacttgaaactaacaaatttacatgtatctcctttgttctatctcaattttttttcttttgaatacccacatatacacatacttgcatgcatatatgttcagaattcatgcaatacttctgtattcttcccttttgattaacattattttaaaaatacttcctagattacttataactatatttttcccataaattagacttgatcagtatgtaagctatatattatttaactatttttctttatagttataccttggttgtcagtttgtgtttttgttatacagaaacagatacttctgtttcataatttgttttcttgtatcaaataattaactactcaaggatatttcctactagatgaaaatgttgggtcatggatatatatctttctaaaagcataacgtaaattcagaagataataatataggcataaagtgcactttactaaaatgtaggggcatttaagggctcactaatactgttgcaaaatagtagctcaagtacacttttgtggaaatattttttaaaaaacaaactaaatgaattttaattttgttggtttcaaccaatgctataatttattgtgatcaattttaattttgagtgcattgttaaaaaaattatttgtagagaaattttcttcattcaactaatatttactgataatctaagtcctagagttacagtacaaaaaatacaaaaatacttttcttcatatattgtactttctgacaggcagagatagatattaacacattttatggatagcaaaaagcagttagagagtaattctcaaaaaatattagataaataccttttccctaaaaacaggagtgatattagaacaactggtataacatgaaaagtgaatgatcatttagtcataggctattaacagtgtttaccagttgactataagctctgcctgtatatatttacaaatatgcattttaagagtcattagaagtaattttttccccaaaaaatgagtaaaaatacaacacagggatcaaataactctttataagactttttttcatcataaattatatacaatgcaatttaaaccactacttgcatcgcaattcacaaagaatttatacccttgaaattttatctcattactgaaaagttttgagagggataaggttaaggtgtggaagtaaatgtattgctgggtaccttccatgtacttttctcagtattggctatttacttgtaaaataatgtatatttcacaaaattgcttctataaaacttcctgaaaaatattaaaggacaaaataataatcaccacattttcacaacagatttaggaaaaataagttttcaaaaatttttattttgtaatttgatgaatgttaaaaatgcattcctcttattttctctcttttccactgtttggagatgtctttgacttattcagaccaatatttctcatattttaacgtgcacgaaaatacatttgggattgtattaaaatgtgtaatctcactctgtaattctaaggggaagcctaatattttcattgttaataagttccatgtgatgacaatgctgctggtactatggattctattttgaatagcaagtgtcaagacagactggcaataaaagtgaaagcaaaaacttttattttgtaactctcatgtggttaaaaacagtattcattatcaaatcaaaatcaacttttatagaaggagtaatgtccagtatgttgtagaataacttttaaggtaatcaaataccttgccttcactatagcatttgattacccgtaagtgccatttattggtccattggctcttttatgaactttactctcataaaaactcaacctaaacgaagaaaaaaagaggaaacagtctggttaactctactgtaagtgttcctcccacaaatgtgttttcaactgcgacagatttaatgtttcgtaacattattcttttatgtaggtggaacatttcatttttatccttttactgtcttccctagtaatatttttaaaagtcagactaaagttgagttagactttgtaggctgaaaaagttaagatataaattttaacaattgattctcacaatttcttaatttgttatttccataatttttggaagcttagttttgctatttaaaaaattaggtataatacctgaaaatcaataataaagtatgttaattaatcaatgctaaggtttgaattgaaattatttccaatcgataactcatattcaattgaacttatatgcaattaataattcctattcaattgataactgttcatatatttgggcttatatatctctgattatttctaaacaatatcatagttgatgctattgtgtcatgcaagtagtgattctaagattccttttaataatgtcttgactgtataataaaaaagtgtattttaaaaatacataaaatgttcctagaaattaaaaacatgattgttcagattaaaaaataataaaaccttgcatttataaaaaagtaaactaataattataaagtagaatattaattataatatgctaatattaatgttagaatattaattataaaaatatttacatgatataataagaagctagatattaactccactatatagataattaaatgtaaacagactataaacatcaatgaaaaaataaagacagtcagataggacaaagaaaatcctcaatcataagctgtttataagaaacacttatattcaaggattaagaaaagttgagaaggaaaagataaaaaaatgcaacttgaaaataaaaattaaatgcattgtctaatagcagacaatgtatattataaggcaataagcataattttttactaagattttactctacttttaggctgttagccacaatttgacggttgctgacagaagactccagacttctgagttagataaaaagatcagagtatcatcacagcagtagcagtagccagaatttccacattttcatattgacagctgcacatacagtaggttctattactacagtagatctttccaagctaagggaacctgatacctttataataggcacaagcacacattccctttgccccagaggaaggctatcttccaaagtctgttactacaaaaaatatccttggaaagatagttccgaataaaggcagtcaatgttgttgctcagaagacatgcagaaatgtgaaaaattcatagagaatcttcttccaatattatccacccctcattttcacatcttggctcctggaaatttttcccatgaatacattgtcaaattaatcaccagttaaattaatcttactgacagacactggcatcgaatctttccagtttgtctcatatagaatttacttaagcagctaacaacatgactcaaagcagaatgatgatgtcagcctgcacaatagatatcaacccatgccctttagaagcccagacttaaccagctgaacaaaattccttaaacgttatgaccttagaaaggaagctaagtgccagtctctataagtttctgcattgacatttctgctaggctggaaacattaattcaagcagagcaagatgtattcatgattacatagcttctactagaacacaaggaagaattctagggcaattctaccacttataacaaccttggccaataattttcaggctgacctgaatgcttttcaatttcaggatgatgtttcttttaataacttgaagataccttatgaccaccactagaaggcaagtcattatcatttggttaggaagcaagtaatgcctgagttcatacaagttcagtctctggggatgcaaatggtgtatctatggaatgaaaatgttgactccagtgtgacctcaagttcagctaacacgtgtgacgattttctgtcagcttaaagaaactgggtttctgggttttctgggtctgattctttttttaaggagaaatgcctggagccaaactaaatggttcgaccatgccaccagccaggtggtattcatctgctctatggagcgtctaggcagagaatgtataaatggggtggaaaatatatccagacgtgttgacagatgtttttcatgggaggtgcaggagctggggacatttcctgctgtttttgactgacttatctctacatttaagcggactttcaaattgtggtgaaagtcttcggcagggaatagtagatacagcagtcatttaaattaacacactagtaatgtttagtagagatgcatttaggcatgtttccttcatgaagaaagctctaggaacagtttagaaagagaaagaccactaatgtccctccctaccttcctgtacctggtggaaactaagttattttctcaccaggttctgcattactgctctctctccgctacctcaaaaatagtgcaccccattccaatagccataacttcatcttttcaccaatattccatagtcatagccagaccttttacacagagtcaggtataagaataatttttaaaaacttacaaggacatattgtgtcccccactttgacctgtatgggccacagtaggaaaaaatagcaagcagtaaattcaactaaatggtaatgggcattatgatctaggatgatatctgtgatggttaattttaggtgcaaacttgattggattaaggaagacagagagagctggtaaagcattacttctgagtgtatgtgtgagtgtggttccagaggagactggcatgtgaattggtagattgaatggggaaaatctgctgtcaaggtaggcagcaccatccaattgagtcaggataaataaggttaggaggccaaactggcttgtccccttgtgtgaagcccagcaggctctgcatcccttgcaccctcatgcatgaccacccaattttttgcaaggttagtaaccctacaggaaggataccggcagacagccagatggttacaggtccctgatacccagtatggcccaggaaagaacaaaagccccttattcctgatgtaacttccccaatcaccagtccatcagcactaaaagccaaagaaggtattagctacaaattccaacatttgggggctagagacttccctggggtcccacatgcacagctaggctcaaggtttagcttatagtaagcttttcctcatttgaatagtaaaaaacacaccactaggtggagattttatatgctaatgatacatatgttacatgttagagcatgtagatgccgagcacatgttccaactgcaggtccgcctttgcatacttgaccttgccagtattttatgaatatgtatatacagctaccataaaaagagattccccttaaggcactagctgctgtctctccctttgagcagcccactcttgcctctcagagtgtacttttgctttgcagtaaacttctttgcttactcttactttggacttgctctcaaattcttaggtgcagcaaagtcaagaacctgaactggcctaccagcagcacaataagctgcggggctgaatagaacagaatggcagggaaaagacaatttccactctatagtgctctctgtctctctctatctctctctcctgttgatgtaacaccctttttttttcctgcccttggacattagaactccagtctcttcagtctttggactccaggacttagactaggggctctccaggttctcaggcctctggcctcagactgagaattacatcattggcttccctggttctgagacttttatacttggactgagacacacaatcagcatcccagcttgcagacagcctgttgtgggacttctcaccctctataatagtgtgagccaattcctctaataaccgcctctcatctatctatctatctatctctctatctatctatctacctacctattcaactatctatctatttttctatctcctattggttctggctctgaagaattctgactattacaatgccaaaccaataagagaacccagtgtggctgaaccagaatatacttgcacctcctaagattctttgttcatcaggttaatagagagtataataacaggccagtctggggttccctttaggagaacaaaagaaacatcatgcttgacaatattctgtgcagaatcccaaatattcaaaattggtctgtatattattccctcatcccttttgtccaaatcattacctaagaagtgattaacatgaaataacatttttaagtgacttttacaataaaggatgcctaaatgaaaatgtgccacacagccaagaacacaatatggatttgcttcaaggaccctgatatcggggtgggaatcaactgattggattcaaatagcaacatcataaatgaaaaatggtcaacagtggtgaattactgcaagttactgagcaatgagaggacttgaagggttcactgtagtcaatctacattggtataatgctctgaaattggtattcctcactaggaaagaaatgagtgacttttggccagactcacatatctggcattaagtggtagcctctgtgacagaaacaaagccatttattttgcatacattttataatggcggatgtattgccatgtctagtgcagtaatggatttagttagcagtgatagtaatttgggtggtacaggcatgatcagcagcttgattccagttggtctctagatgaattactcagattgtttaattaacagccatttgtttctacagtttacagcttcagtctttaatctgctagtttgtagttttctaagtgtcagagtaaacatctaggctactaacaacagaccaatactcagtaaaaatataacaatgtttatcaaagggagttctgggccgggagcgatagctcatgcctgtaatcccagcactttgggaggccgaggtgggcagatcacgaggtcaggagttagagaccagcctggccaatatggtgaagccccgcctctactaaaagtacaaaaattagccaggtgtgatggtgggcacctgtaatcccagctactgaggaggccgaggcaggagaatcacttgaacctaggaggtggaggttgcagtgagcagatatcacaccattgcactccagcctgggcaacagaacaagactccatctcaaaaaaaaaaaaaaaaaaaggtggggagtactggctagagtgatgagaatggctctgaattatgcctactcagtagagataccacatttgtttttagttctgcatatttggtggtaagaatgaaaagctacatcaaacaaatacacaccattgtaggttagatagctgaaccatcagtaatctaggtcaacctttttaagggataccttatgaatgaaaggtgcagtggggccagcggctttgcttcatgtaattgagaaacttttccccaaggggaaaacatccactttttcatgtaaagacaaaattatattggggttagaccagttgaattttggactataccatttccatttgacaaattagatagatggggacttcctaccttattagttcttgagtctccattgactcatcctgataggcagtatcaggcaggagagttgcaaagcctctgtggatcaagtcttcagcttcagcaaaagcccagtagcaaccaagtaggtgctttgcaagaagagtacagggagcagtcatattagtcagatgtaggattcaaaagtctaaaggacacttccagctcgattttgcgtctttttgctagaggcttcaatttgcaaaactatgccacacaaacttgcaattcaaaaggttctttagatttgtggggcccaagaggtactagcacttttctatatgtgattcttcctaagcaggagaatcccctctggcacttataggatagggaagtgtaaacatatagcacatcagctcctactgtgatgattaattttatttgtcaacatgactggaccatgggattccaagatacttggtcaaacattattctgtgttcctacggaagttattgagaatgagtgtaacactgaaattgatagaccacacaaagcaggttgccctccctaatgtgagtaggcctcatccaatctgttgaacactcaaatataccaaaagtctcaccttccccctagtaacagggtatttttcttgcctgtccgccttgagctgggacactacgcttttcctgcctttggactcaaactgaaacattggttgcctgtgaataaccatcagctctcatggttatcaggacttaaaactcatattggaagtgcaccaccaggtctcctgggtctccagcttgccaccaacaggttgtgggatttgttagcctccataatcatgtgagccaattccttatgttatctttatacataaagtataaatatataatgtatgcctactgcatagagacaccatgtctatttttaattttgcatatttggtactgaggatgaagaactgcatcagatgaacgtatgccactgtgatttagatatctgaaacatcagtaatccagggtgagaattataaaaataaattatatatgcagtatgtagttttatctatctatctatctatctatctatctatctatcatctatcttatcagttctgtttctgtacagaacccagaatattacagattttggcatgaagaagtgggctgtttctgtaacaagtatctaaatatgtgttaacatggctttggaaatgggtaatgagtaggagggtggagaggtttggagtttcgtggtagtaaaagtctagactgctgtgaagggactgttcgtagaaatatgaattattagagatgattctcatgaggtctcagaaagaaaaaacaatattggagagaaagcctctattttcttagaaaatacatatatcctcatgacctaaatgttggtagaaatctggatttcaaaaaccttttattttaaattcagggttaaatttgttacataggtaaatgtgtgtcatgggggtttgttatgcaggctatttcatcacccatatatcaagcctagtactcattagtaatttttcctgatcttctagctcctcccaccctccacccccgataggccccagtgtgtgttgttcccctctatgtgtccatgtgttctcatcatttagctctcacttataagtgagaacatgcagtatttgtttttctattcctgtgttagtttgctaaagataatggcttccagctccatccatgtcctcctttcaaaggacatgctctcttttggttttattgcttcatagtattccatggtgtacatgtaccacattttctttgtccagtccatcattgatgagcatttaggttgattccatgtctttgctgttgtgaacagtgctgcaatgaacatacatgtgcatgtatctttataatagaacaatttcttttcctttgggtatatacccagtgatgagattgccaggtcaaatagcatttctgtctctagggctctgaggaattgtcccattgtcttccacagtggcttaactaatttacactcctaccgaaagtatgtaagtattcctttttatccacaacctcactaggctaagattggttatagtgtaaactttctatgacaacttctaagtttctgcatcagtaattaatatagtttcacaaaagaaaacccatatgtttatcttgtttctgctaattacctgtaaaattgtatgtcatatggttgtattattaaaccaaattcctatatttgaatatctgtatcaaatgtaacctcatttatttgtccatatattgcaacatgaacaggtaatctgatgaggtataatctcacttcaaagaaatagcttttcacttccaaattattcttccaaagaaaaatgacatgtgaattacaaaaagcaggtgctctgtagtaagataaaatttgtactatttatttgggattagtttctctctttctttctggcttccagtgagtaactcagtttcaatttcttcaagtctgtatgtcttacactggatactggggataataagaaatataataagggattattacgggaacaagttggataataaatatggtagaaacatattatcaagatattagctgatattgttttgctttttttgccacttattcccacttttctcttttctttattcaagtactttgtattgcctttcaggcttctagggcagatgactagaataatgtaagaaatattctaaaatgctgggacatttctaatctcaaataagaataacaagaagaaaaattatggggactatgttcatcctctgcaaaacctagagaaaatatgaatagagaaaataaatgtagtttttgctgtatcaatggcaacaacagcagaaaaaatgttatgttccattcacgcctgtgattatggaaggagattcatacctgatacatatttaaggcacctagcagtgggtccctgaaaagataagagagaaataacaatagctatgcctacgttgatctatttcatcacaaatatcttttcacaaaatgaattggtagaatcttaaatgttcagaaaaaaacattatattgaacactagatcatatatctaatatataatcatcctgatgagttcttcaaatgctatttgtaaattctatgtatttggatgcctgtattttttgctgaaaaaaaaaaaagaatgtctcagtacaaaagacttagttgcaaaatggcagtgtggaagtatagtttttcagaaaagaaaacactttaaaatctctcagtaatagaggtaacacctaaagtattatgtattagaaattccaaggaatgaaatgtcactccaaaaagaaaaataaaatttgagtgggaagattctatcttgtcctctgacacacatcactgactttttcagaaaaacatccatactgacaccagaaaagagctgcctttttgtccatgataggtcctgatgtgcactgaatgctatatttggtgtgcaagaaaactgtttatataaaaaattactatatatatatatacacacacaattttagacaggttttatatctatatacatatatacatattttactaagaatattaatagcattatattttaaacataaaatagtttgactttttcccaaggtcgagtaatgtcttataaaattaaaatgaaaatacattattaaaaaatttaataaggaacaattatgaaaactaaatgatgaatgccaataaaacaaaaaattgtatggtacttggatctaaagaagtacaatattttagagctagtcttgattcttaggcacatatacctactcatgtacattttaccttaatgaacagaataaaatattaatacaataaagaggagcttttttggttattctaaatgctgtcagatatcaacttagagactgagaagccatttaatgttttcaacttattgcaacctaataggtcaattctggaccatgtttgtgacttaaatgataacacacaactactcacaataatagactaaaattgttgtgggcagtggccagaatgactaaagttcaccaatctgaaaatcatatattattgctaaccccattgtaaagacaagtgattagatcatcatcaaactgcagtccgcttctgctttgtcatgaacaaaaaattctttattgtgaaaactcatcctttggtaacagaatggacttaaagatcctttttattttttaatagaaattaattgatttttggtaacaaagaaatgcacttcaagtatgcaatttttaaacatgaaatgttaacatgtatatgttttctttattccaaggtgtgaaatcctactgtgcttgaagtatatttttctttattaaattcaaaaatggggaagacattgaatatacctaaaatataggtaaagttctcacgattctcaattaatatttactaacttactagctacaatataattttcaggaaaaatgaatgtaaaggtttctggctttctataaatttaaaaaaagtgccaggaattttcacagcctatttaaagttatgatactctagcacaaataaataaaagagaaattggtaaaacctgacaatagttctgcataaatttgaagttattaaagcaattttaacttgtatcttttgattttctttgtttttaatttcatttgcatatttcttcatctctattaatacaagaaataatatttatgaaatatatattaagctccacttaaaactgaaagaaaaaaactgcatttggtgtaaaattatttatccacacattctttctttaaaaaagaatgtcttcattgagatgtactaaactttgcccttttaaaacacacaattcagtgactgttggtacattaagggaaatgtcactgctatctaatttcagaaatattttatttattttcatcagtatattttattttaaaatatagattgtagtcttctgttttcaggttttcaaggttcgtgcatgttgtagcaagtatcagtgtggtgttctttttgattgctaaataatactgcattatataaatatgtcaatttatttttaatccagtcatcagttgattgatattcatcttgtttccacattttgactatttactaaatagtgctatgaggagccatcatgtacaagtttttgtttgtatccctgttttcaatttatttgaatatatacctatgactagaattgctagattatatggtaactctgtgtttaactttttgagtaactgtcaaactgttttccaaagtggctacaacagcttacatatccataagcaatgcacaaggattccaatttctccaatccttgtcaacacttactattgtgtatcttcttgatttaaccaactactgggtgtgaagtagtctcattgtggttttgatttgtattttccccataactaatgatgttgaacatgtttatgtgcttattggttattttaatatcttttttgtagaatgggtattgaaaactttgcccatatttaaactgatttatttgtaattttatttttcggttgtaagcattcttcattatagtatagacttgtatctatctctagtcttgtatagtatagatttgtatctatctttcaaattatgtatcttctccaatacacaatttgaaaatattttctccatttctatggattgtattttcactttctttttggtattctttgtagcacaaatgtttttaactctgatgaaattcaaatttcaacttttactaattccttgtgcttttggtatcacaacaaataaatcatcgcctaatgcaaagtcaaggatatatatgaccttttcattatgagttttgtaattttaatcttacatttaagtctatgatatggtttacattttttgttttgttttgtttgagacggagtctcatgctgttgcccaggctggagtgcagtggcgtgatctttgctcactgctacctctgccacctgggttcaagtgattttcctgcctcagcctcctgagtagctgggattacaggcatgtgtcaccacgcctgactaatttttgtatttttagtagagacggggtttcaccatgttagtcaggctggtctcaaactcctgacctcatgatccgcctgcctcagactcccaaagtgttgggattacaggtgtgagccaccgcgcctggcctacattaattttttatggtgtcagcagtaatcaaacttcattctttgccatgtgaatattcagttataccagcaacatgtggaaaatgataaatttttcttcattgagttgttttgaccataaatataagggtttatatctggactggtttttttcttgtgtttttgagtggagtgttctgtgaatatatgaagtctaatttgcttattattttattcaagtcttctattttctcattcatattttgccttgttgttctattcattattaaatatgaggtgttgaattcaccaactaattttgttatattgttcctgttacctttcatttatgtcaatttttgctatttgtagttttagtctctgttgttaggtacatgcatgtttacaatcactgtatcttttatcattagaaaatgtccctctttgacaattcaaacagttatcgtcttaaagcttattaagtctaatattagtatagccacttgttactgttggcatggcatatatagttttttcagcttatttatgtatttgaaataaaagtgtctcttttggatggtatagagttgggtcattttaaacgtacattcggccaatgtttgcctcttgattgaaatgttggagtgtttaattaatttatgttcaatgtaagtacctattagttagcatgtgtatgccatttttatatatctttatatgttttaaatcattttgttcccctagtattccactactgttttgtattgtattaaatatatgtcctattatatcattttaatttcttttttattttactttatattgagttattctcttagagcttatcctgtagattaaaacacatgcatttaaaataatttatcttgaattaataccaatttattttcagtaatatataaaaaactttaatatatgccatcttctccaaccccctttctgctgttattgtaatataaatgacctcttcatacattatatgcccattaacagagtttcttaattaatgctttatgcagttgtttttaaaatcagacagaatattttacaagttaaattacatttatttatactgtattttacatttcctgatgtagttacatttactgttctctatttctttgtttggacttgagttactgtctaatgtcatttcctttcaatctgaaggattttcctagatatttctgtgagaaagatctgctggtgataaattctctcagttttggcatacctggaaatgtattaatttattctttatttttaaaatattgtttgctactataaattcttggttgacagtctttcaaccctttggaaatggcataccaccacttttaacctccataagaaacctctctttatcttattgaagatcccttatgtgtgattagttgtttttcttttactgctttcaagtttctctcttttagacttttgataatttgtaatttatctgcttgtctccttgagtttatcttacttgaatttatagattaagattcttaatagaattcagaaagttattttttcttattatttctattttttttatcttttctctctcctcttcttcatcatagagtcccgttatggtccatgttaatacactttattgtgtaccacaagtctctgaggttctattcaatcttttgtctttcaagtttcacaatgaataatctcaattgacccatttgtatgtttactgatactttttactgccaactcaaaccttctgttaatctcatctagcaaattttttattttagttgttatacttttcaactctagaatttctatgtggttcttttttaaatgtatatctttttattgttatctaatattcagtgtgcaatcattctcgttcttccacttaattctttagatataatttcctttagttctttgagcatatttaaaacttatttaaagtctttgtctagtaagtccaatatctgtaatttggatataatttctattaactacttttttcctattatgggccatagtttcctgtttatttccattataacttgcagttgagaactaggtaaaattattttacaaatgtagcatgttttgtctgagaattagtgtcccttcccccaagggcttcttgtcactgtttgttgtggtgtttgccatttatttgttcagtttaattctaaaagtcactcttccctgatgcatgtggtcaattaagtctgcttaattatctcagtgcttgactaagattgaacggagatttatttaaattccttgaaccagtaaatcttagatactttgctggagaggtttgtttgtgtgctgggatacacatgcaatgctccagcaatgtcagactctgccttagcttcacttcctgctggtggaggaccagaagtagtaagggtttggagttttctaaggtattctctgggcatgtacacactttgcacatgtgtgcactttcttatgtctgtaggattatgtcaaaggctttcaaagtttcctatgtctatctcattctccacaggagctgtcttttgactagtctcttgtttgttccaaccagtatcaatgcctcaggcagccactatgttaaacaactaacacttatttatttattgacaaatgccctggagataaggatcttcccactgagcagttctggctcaggtcaaagaatgaccaacttggtatatgagacttttccaagaagttgtcagacagataaaatagtgacaattctctgaggatgggcctttttgatgagcttcaaagcttgtcttccccttgcagtgttttacagctactgtggttgtgcacctaatagttttcaagggtactataggtccagaaagtagggcaagttaattcatcacaatgtttagtgttcttaaattatcaaccactgagatttaatcactttttgtgaataaacacaccagattgttgaaagtcattaattttcagagatctgaaaaaatgaattttgacaatttttgccagtgttcatgttgcctttatgaggagtagatttctgtaagtaccatttattcataatgtcttgatttggttgtcataaatttcaaagttactacatagaattaattgttaccttccagtttaaagacagattcttaaactgcttagcaataacagattcttaagcaatgcatattatgaatataccttctgttattaatataacttaattaaatcaatatttaagggggagtgttacagtagcttatattaatgatcactgatgtaactgacatataataaaacagataacaaaatttctacacttgcaaatgactggagttttcgtgagctaggtcatattatcttttgcatgtatttgaaaatagaagattaagtcaacaaataaggcagaaccatacttttaaagaagtttagaaaaacatttatgaagggaccacactgcatctgactctcaagaaattcatagaacaaaatgtcaggaatcaaatttattccactgacatcaactggacttgtgaagtatctgactttttgaaaatgtggggtattttatgagtggtgataatttaatgaagcataaattgttcttctgaactggctctcgttagtaagagtgttgaatacaatggttaaaaatagagatgaagcataatttacctatcttacgtgtaccatttttcaaatatgagaaaagtaacttagattaaaattaaggctaatttgttttagtgtttaaaaactctattgtatataacacatacaatagagattttagtatataatatacactatagagattatagagattctattatatataatatacatttggaggaaataatatggaaatatatgtgtgtgtgtgatatatatgtatatatacatatatatacacacacacatatatttccatattatatatatatgtatatacatatatatatatacacacacatgtggaggaaataaattgttatatataaattgccatgtatttatttatttattgacaaatgccctagagataggatctttccactgagcagttctgggtcagatcaaagaatgacaaattctaaatgagacttttccaataagttatttaatttatttccaccacacgtataatacacattcaatttatttcctgcacatatatgatatacatgtggaggaaacaaattgttaagcataagtattttaaatctggtatgatgttcaagaaacttgaactttctaaaaacagcttaattttttttaatgtaacggcgattgctgaaactgtcaactttcctgacaatcttatttagaaaaaaatgttattcatatgatatattaagtcattggtatggtttggctgtgtccccactcaaatctcactttgaattgtaataatccccacgtgtcaagggtaggaccagatagacataaatgagtcatgggggtggtttccttcatactgttctcaaggtagtgaataagtctcacaagatctaatggtcttaatatggggaattcccctgcacaacctcttttgcctgccgccatgtaagacatgactttactcctcattcaccttcagccatgactgtgaggcctccccagccatatggaactgtgagtcaattttctctttcctttataaattacccagccttgagtgtgtctttattagcagtgtgagagcagactaatacagttataacctatgaaaacagtaaaatcttggacagcttagcttaagaacagtggatattcggcatggaaacatttgagacccacgttcttccagaaatgttttatgtagtattgtgaaagatggtcccagaaacaagttttagatagtagttacttgcctccccttgagtttgaggtatttgttacaacagttgtacatattataaggaatcaattttttattgtgaatttttctatttttaaatcaaatttaaataaggtaaataaatatatactagtacttacccatgattttcagtggtgtaaatctggttgtacgtgttttgaatatggcatataatatttttgttggacagagcataaaaagaaattcgactgccttatgtcctgagtgaattctctgagctcccaaaactgttacattgttacattattttcctgtacccttaaatatttaatgtggctactcttgccataagtctttgtgaatcttgtttcctgaaaaagaagaagtaatctatggcaatagtattcaagaaaaaaaaaaacaacaatttaaagacttgtttataagaaagatggactgatgaccaactggggaacagttctataaatctatgtaaatatacagaaacagactaattgtagaagtgtgtatttagcttaaagatataagggaagttagttgataaacatagaaagttgcttattcaataaataaacaaataaatacaacaaatcacaggttcttttctatgtcctctttaagttaccaggggtaaagaagaaaacaaaacagacacgaacaacagttttcaggatttgcgtcaggggatctaagagaattgtaattataggatataattacatctaatctttttttacacatttatttgacatccccatctgccttcccacaacaggtgatggaggtggaagaggaattcccaaacttggtttctgcctattcatcaaataaaggagttcatattattagaatttagtccattaaaaacaaagaaggctatattcttgaagatgcgtttgtgagaatgacacatcctgatgtagaagggagtgtagctctctcaagaaagagagatggaggaaaaacaataatttcacactaagcagaccttgtgggcggttctaggccatcttaaacattttttgttttattcgtgaaataataggaaatatattgatgcttcaatattgattgtagaaacagatttgcattttcaaaagattccattagatgcagagcggagtttggatttaaaagaaaagagattgtgtgtatggaacaggatggaaggagatggggccaaacagacaatcttgtgtctgatggattaaatatggtcaaaatgtagagtatacattcaaaagcttgttagtaggtagacataattgattggattcagtagatgaggaacataatagtgttaaaatagatctctcaaatattacagaatttaatgggcttgtttactggggttaaaaaccaatagaagagtgactgttgctcacagcgtcacagcagaaattaagagactggtttctagccagcgcggaagacagccatatttatgaatagaattgggcattcaaaaaataaataaagtgtaaattacagaagtttaagtggatgtgaaaattgccttgcagaagggttactaggtagaaattaagctaaaaaggaaaaaaaaagtttaaaaatgagtacatgaagagtaaatacagagcttttacatactttattctttacaagttattcagtatctactatgtgcaaaatgtgaatagtaatcaataatgaattagacatgcctcccattttatgaagctaagcatatttataaacccatatttggataattcatcattttttaataaccggagtcactagctcattgattatcaatgtctcattcatgataatggagaaacagagagaaacagtaggaagcacaaagaatttcatacatgaaagtaaatttaagagtggattcaaatgaaattaatgctctaggcctctgttaacagactgtgacctaaatctcatactgatcgcacaactaaaattctgaagtccaaggaaaatgatgagacacagagatttttctccttaattttaatttattcttttttaaagaaagcatgggggatatactattaaagttaatatcaccttccttattaagacataaaaaatgtcttacttgtaatcactaaaagtaaaaaaaaaatccttaaatcttgatttactttgggatttctattgtttagctgtaagttaaaaaatccattatctaaatactagtttaaataactttaatctggtaaccaaaaatacttcccttatagaaattgctaggatatattgggagcattaatttaaacacactaatgttacatgtaagtttttgacccttgagccagagacctgccaggaaaattaaaaggtgaaaataaccttagctttagtgacctgaattctccatgatctaacacttttctgattcacttgacagagtttttatgtttttatacaaaaattaaaaagtaaattgtatactttcttagaaatcccatgaattttaaaagtgtatacataaattaatttgggtacagtcagcaaatacttcttcagataaaatttgatgtctaaccagcacctattatgctcaaatgttacagttaaaattttcacagataccataagtgtaatttactttttatatttttcatactgctgctattatacttgagagaaaaatttccttaaaaaatctgttcatctttctagagaatactcctgatttctcagcaagtcttctactatttatgaatcttttatctgttagtgatcttcccttctctctctctacatgtcaaaatcaataatctccaatttctccctgatggaataaatactcataaactataaaccaatgtctggaacattggttttcacagctattgtcattcctaagagatgatactatctatcatctataacaaatgatgatccacagaggcttaaaaattgtccaattttttttaaagtgcatgtgaagttgtaattcactggggcaaaaaatgctatatgaatgtcaacatagtcttctttaattctttcaaattttatgtatttttttttaccgttttcttcaatcttctcctttagaaaactttcagatatctttctttctgatacagataggatactctgcaactaactcagactccatagagcaaagtgagagaaacaacctttttcatttttccaagtttttttgccttctctctatggccttctctattatgacaaatcaatttttttatatcaaactaaaaatcttgggaaaagattttgaaagaaaattattacatttaaaactccatcttttgctaaaatattaagctgtttaaaactataaataccacatggagatattctgcagatggatacatgaatttcataagtagtgggtggaccaaattaagaaagcccaatatctgcatttgacactagatctctagatcacatcaagatattatggaagccccacattgcaaagaatcaatgctgagaggtaaacagacactagaaaaggcattatttaagaatgagggcgtaagaacacgagtgttcggcttaaggagataagactaggtacaggacagaatttctccactcagtagaacagaaactcagttctcagaaccagagcacagatcaataatataaatttaaaactaaaagaaaagcacagaatccagataagagctaaatccatgcaatcccacatttcccaaaccaggactgagattgatcctggacagtacccaagatagttcagtttccctatctacagggattggctggggacatcaggacaagttagctgacaaaaaaaaactgacttttttttttaatctttaagttctaggatacatgtgcacaatgtgcaggtttgttacatatgcatacatgtgccatgttggtgtgctgcacccattaactcgtcatttacattaggtgtatctcctaatgctatccctccctcctctccccaccccacgacaggccccggtgtgtgatgttccccttcctgtgtccaaatgttctcattacaaattgactttttaaatttaaaactgttttttttttctttctgaattctgccaatttttctttctgctatagcatccctccacttcattcaactcctacaaggaaccaaaacttggctgggcgtggtggctcacgcttgtaatcccagcactttggtaggccgaggcgggcagataacgaggtcaagagatcaagaccatcctggccaacatagtgaaaccccgtctatactaaaaacacaaaaattagctgggcatggtgatgtgtgctgtaagcccagctacttgggaggctgaggcaggagaatcacttgaactagggagttggaggttgcagtgacccgagatcgtgccactgcactgcagtctggtgacagagtgagactccgtctgaaaaaaaaaaaaaaagaaaagaaaagaaatgaaacttatgtcctcgctgtgacagtttatgtgccagtactatatcttatcctaacatgtagttacaagatttttcttccagatataacattccacttcaatttttccctgtgcctgacatgacctgttcctctacaattagatactatgtctttccatgttatttaccaatctagacctgcaaacatccaaattgacatcactatttagaacacaaaaatatttttagtatcctccgtctgatctgagtgtctataattttctcaatgtcatgctgtacattttcaacgtgtctgtgatacagaagcaaaaaagaaatttaggcagttagtgaggataagagagtccttggtaaggtttcccttctaatgaaaatcagctgtgaaatcatttctttgttaacagaaagcagcctaaaaaattgagctacagatacagataagctggaagcgtgcatgattgaatgtcagcagctatgccaacaggaaaaggctaaccagggtccaggcgtgttcagcatggaggctccatctttcctttcctttgtcaaccacatgcacagtaaggaacagacagcatggtactggccaggtatagaacccatctgcataataaaagattagggtagggaggccagcttctttgcccattatgtaaggcacacatggtccaacaaatctttggaatgtatgtaaatcagccatcacctccttaagctagtctaaggctattaaattctactatgagttttaagtgtggatttaggtcttacaatattaagtaatggagtccatcatctgtcaaagaaggagagacataaatgaagttgtatatgcctaaaatggagacaactttctaatttctttttaaatgaagtatataaaaataaaaattgttggaaattctggaaattctgttttatctgaaacttttaattatttttttaattccaacaatttagattatatttattttccagaaacacactatattaaggtcatcatgaatcacacttggcattcattcagttatttatctaagtagatattcaacaaaaatttattataacaattgggtgaaagtattatactaatacatttggaaaataatgagtacttaaaaaaggttagattctagaaagcaagtaaaagaatggaggacaatgctgaaaaggcaaggacaagcatttcttatttctcaattcacatacgttcacgcatttaaatggaagtaccaagatttattggacaagagacatgatatagtttttagtgctccaaataataaacaataatattaccttagactatctaaatataaaattggatgtttaagttcttcaatacatattgaaaaagtaaaactagacattgagactaggttttggatgccagctctgttacttacatataataaagactgccctcatttttggatctccgattctttccttgtttttaagttgtttgtttagttttgtattaaaattataaaatgaaaacttttgctgtactgaaaattaaaaggagcatatctgatgatatttctataagcacatcatgacaactatgaggagttaaaaatacaaaattttatagaaaaataatgacaaaacaatgcttttttcagttttatatttgagtatatttgatttatcataagctgaaatgttgcaactctgagttgtactaccctgatcaccaactaaaacaattatcctcactgtgtattagccttgaattgttactttatggtgatgaataatattagaagtacaatgttcaatcctgctaataaagggtgccaacaaataaaaaacagaacatattacacatccataaaatattgaaactacttagattttgaatctgaaaatatactgatattataatttttaaaaagtgttcatatctactgtttgtctctaagtgtatttcctataatatttaactataataatatatagtaattagtttataaattaacagtgaaccgttttacatcccttgattttatacttttgctattattttacagtgtcaataacaaattaaaggagaaataaagtaattatacatagactgtgtcattatttaagcctccaattctttgtctaacatgaatgaaaatacttacaattttctatagtaagtacatatatcagaagatgcatttactcaaatgaagagaaatgtgctacatgaggatcctacatgctggtagtgaatccagggacaaagagatttcatgagaagcaacagcagaaagaaaaaaaaagcaaatgtaaaaatttaatcttaagattatgaaattaatctctggttgtgttgataaatatcatatttataaaacaagtccatgcccattaagaagtcattagataatatagttcaaatctaagctgtttgttttctttaaaatatataaaacacttaagatacattttaaaaattcatattaaaagatttggacttgtaataatttaagtacaaagaaatacatgctcagcaccgacaccattccttattccccagattaagacctaatggccactgccaaattaactaaaggaatcattacaattgaagctggcatagtagactcagtcattttacaatgtgctcactaggaaaagttataactgagtttcttcagaagtaaacaattggaaatattgcataactttacaattgtcaagaatgtatttcctaacaacaaaaagtgaagctgatgagtggagtgcagaaacctcatttagagcagatttctatttctaactgtaaaaaataactggcatcaaattaatccatcctacttaaggaggagtaggatagtttggctgcaacaattacaacttttactgaagccaccaaaatatgtcttagtgatgatactttggaataacatgatgaccaaacagacattgcaagttttaagcaaaatatacaagattttgcattaagtggtttgtagtgtgtaggatggaaagattggtatcatattagattacgtagaaatgcaggctcctgagccccactccagatgtgtaaaataagaatcagcagtttagccagattaccagatagttcttataaacactgaagtctggaaagccctgatttacatgaatgttaatagaggaaggagtgcagggtgtacagaatgagaccttagtttcaatcagcctctatctactaccatgggctggttaagtgtttaacaactggctctctggaaaagaataaataaaaacaaaacgggccgggcgcagtggctcatgcctgtaatcccagcactttgggaggccgaggcgggcggatcacgtggtcaggagatcaagaccttcctggctaacatggtgaaaccacctccctactaaaaaaattcaaaaaaattagccaggcatggtggcaggtgcctgtagtcccagctacatggaaggctgaggcaggagaatggcgtgaacccaggaggcggagtttgcagtgagccaagatggcaccactgcactccagcctgggcaacagggcaagactctgtctcaaaaacaaataaataaataaaaatgacaaaactgccggagcttctgcatacctgaacacatgaagtttcctcaagagtggcaaacccagagatgctctggaagctctgtaccctttccctcatcccttgtctaatctatctattcatctggtgttcattagtatcctttgtaatatcctttataggaaaggagaaaggagtaaaatactttctcaaaggagaaatttgaaatatttgcaaaacattgatgtatgtacaatgtctaactcttttcatactcaacatcaggaaattagataataactttctgcaatgagtcagctaaatatccagccattctactgtggcaaattaaagcatctcacactgtatcaagtgtagaaacataaattgctcacatcaacttcaacaaatacactgtttagtgaaacatgagtctttataaacatactggaatttgaaaaaaataacacactaagaaaaaaattttttttaatttgctgatttatgtaaagtaacactgccaacatacttgatttcaaggtactaagatgaaaactctgaatgcagctggaaaaaaaggtcaactgcacaatttgttcttttgaccacatctgagttggctgtagtacactattatctgtaagtcactatctgaagaattgtttatgacaaaataaaaaatgatatgaattcctcatgaaagctgttagaataatagttgcttttatttgtttctctaccaaaataactattaaagattttctgacacaaaacataatggccaaaacaggattggtgcttattgtatgttttggaatacattaatagatagacaggactgtattccatgccatttttactagtagaacgagagtattttcatctttataaaaagatagtacacgagaatatttgctgcttgttattctgacactgtggcagagactgccagttgtctcctattggtctctatccctttcaatcatagcaatatattgtttagcgggacatattaacactcaaagactacattctccagcaaccaatgtaaccaagtttcatgtggctataatctggccaattggatataagtagaagtgtcataacacagcttctaggaatcttccttaggaaaatatttgtcccatctttcttcccttcatcttctctgctgcttggtacacatatattattgctatattatgttttggactgggaagaaaaagtttcccatcctggagatggaagagtaaatatttaaataagcatatgtctcaaaggcttaacggagcagaggaatataacggttttgagtagggaagcgttaagagatgactattagagaaaattcagcagtaaaaaggcaagagagaaagctagggaacttgttaggagtctagtgtagtagtctagtttggtccagggatgagacgatagtagctaggagtagagtgttagtggtaaagaccataagaagtggtaagattacaaatatatgttgatttaatattttctgatgaattggatataagctgttagaatgaaagaaaatcccaatgtttttggatgtgaacaattaaacacatgatgctgccatttattgaaaaagacatggagatgagacaatttggaattcaggaaagatatctaattgaaaaacaaggtaggtagttacagcaagttgattgcaaaaaaatgccaccatttcttcattccatcctgtccttatatgtgcctttggccatatagccttgtcatgcccttgtggtctcatccttctcttgtctgtgacttgcttgagccaatgagaagttagtagactgaatcaatcagaacttgataaagggtacgttttcattttcccatgtttgcacttctgctataggcatgagaacatgcttaaaataattgtactagtagatgagatattgtcctataagaggccaagtggattagcctcaggcagaaacatgagtgagtccatacaagatcaccagaataacagccaatcccttcagaagcttgaacaataagaatttattttgaatgactctgaggttttctatgttcatggagatagctaaatgaaatatatcctcagagtttctataattattttagagactggtgtagattgccccatgtagaacatgagtgtaggtagagatgacagccccaaaactgagcactatgccattctaatatctagaaataaaaagcaggaggacttacacaaggaatttaaagaataaagatatataaggagaaaattaaaaaatggggcatcctgggagggaaagctatgaaaatgctttaaggagtgttaaaaatggagaatattttaaagtctgaaaagaggaagaataatgtgagaattactaagtggcagtaattatactcaagggttgtataagagcagtgatatggtttggctgtgtccccacccaaatcttatcttcaattgtagttcccataatccccatgtgtggtggtaggggcccagtgggaggtgattgaatcatgggggtggtttctcccatgctaatctcatgatagtaagttctcaccagatctaatgtttttatcagggatttcctcctttactcagccctcattctttcttctgctgcattgtgaagaaggatatgtttccttccccttccaccataattgtaagtttccagagccctccctagccctgtggaactgtgagtcaactaaacctctttcctttataagttacccagtctcaggtatgtccttgtaacagtatgagaatggaccaatacaggcaggattgaatgaagaaatggtggcctgttttgcagtcaacttactataactacctaccttgttttctaatcctatgccattcctgaatccaagttgtctcatcaccatgtctttctcaataaatggcaacacgttttgttcagttattcatgttcaaaccttcataaatataacaaattccagttcttggagttcctctcctgtaaaaagtcactatgtgtgggggtatcatcagctctctactgattgctttgtggaaattgaggctctgggaacccaaacaagtttgaaactctggctatttctatggctgtatattaaaaagtcctttgtccttgtctcagttttgtgcattctgtgacatgttaacttgttaactctcaagaatgataaaatctccgaatccttttttttcttttactttaagttctgggatacatgtgcagaatgtgcaggtttgttacataggtatccatgtgccatggtagtttgctgcccctatcaattcgccatctagattttaagccccactccataggccccagtgtgtgatgttcccttccctgtgtccatgtgttctcattttcaactcccatttgtgagtgagaacatgtggtgtttggttttctgttcctgtgttagtttgctgagagtgatggcttccagcttcatccatgtccctgcaaaggacctgaactcattcttttttatggttgcatagtattccatggtgtatatgtgccacattttctttatccagtctattactgatgggcatttgggttggttccaagtctttgctattgtaaatagtacttcaagaaacatacatgtgcatgtgtctttacagtggaatggaaatctctgaatctttacagttcttgacaataagtgaagtacatacagatgggccgagttcttgataaaagtatgaagtatatacagattggtccatagtgtctatttatttgtcaatatggaatgaaacatggtatttaattaaacttaccaaaataataatctgttatagtttataactgttacttttggttccaggtatcatctcttatggccataatgtctgcacaaaatgtttgtttgcttcagggacttcataattatcaataaagttcttatgaatttttgtttacacaattacttaagggactctaattagcatgtatttttcaattaacttctgtgtaagccttgtcattcttccattgtgacctctttttaaatgaattggtctgtctctagcattgacctttatctcagagctgcaactcttcagtgaactacctcccttagcctctgtgagggttttaattttgcaactggaagagctttgcgtgtgtgggtgcatgtgtgataagtgtcacttcttcccttggttcaagctgaaaattatttacctcattggcaacattgtgatttctgggaagccccagttaagggtgccatttcttaaattcttcagtgcaaacacatttgcttatttcaacaaccctctaaaaaatacaaaataaatattagaatattgttccttttgaccaaatggagattgaaagacacctccaaacattatagtatacatgggcatattcattatatttaaactatatggtagaacagaaaagatactagctaacatatatgaaatgctgcttacatgccaagtattgctctgtggatgttgtatcatttgctccccttccttatcttcaaaataaccttgtagaatcattattatattttccacttcacattttgaagaatttacagtatctgagtgataaagccagcattaaaggtcatgtcttttgacaccctgttagcatatttgtgattcttctattaccatatatgtcttacaaagaagaaatatatatttagaagatgcatttatattaaaatgtggccatcttgacaaatgaagccatttgaagcataatatatgattatgattgaaatgtttgtaacctataagaggaagtacaaagatacactatttttgcccccaaaatttatttactaaaataagtttgaggaaaaatatgaagaatacattgactatatatttttaggtaaagcaaagtacattatgttgattaattataaaatgcatcttttaatcttctattctttgtctttgtacatacttgttttgaattatcatctaaataagtcactcaacataatatagtaggcataattccactattggctccaagatttccactccttccccatgagtgcaggtggaattatgcagctaatataatagttgttcctttgattaggtaaagctatattacaaaaggtgattgaagagtcactcttatgactacattatgctgtataaaactctttttagccaactaaagagggagataaatatagagatatattcctgctctgctgaaagaaagccatgttgtgaacggtctttgagaaagtcatggataggaaccaaagggagcctctaaaacgtaagaaaattttccagtcaatagctagcaagaaaatagagtcatcaataatacaattgcaagaaaataaactctatcagcaatcagtatggttgaaagaggaccctgagtcttagacatgaatcacagagctgccaacgcctggactgaagccttttaagacctgagctaagaacctagctgactgcagctcagacttctaacctacaaaactacaagactgtaaacttctgttgtattaatcctctaaattgtggtcgtttgttatgcagcaatataaaaccaatatacatgagaatgatcattttttaaagatttattttaatatccctaggcaaattaaatgctatggtctgtccacagggaaaggcacaatataatactgcataaaggatagtgagtgaagacttgtgcttgtcagttacgaccaaaagagcacactgccagagatctctttgtaacacgtgaaataaagtcttcaactgaaagcacagtgaaagaaccaaaaatattgataagtgccttcaaagatgacaggcagtcaaagaaattattataactgcaaatgaatataaagaaaacaatttagaagatcaattatttttactacatacttggaaataccatcattactgtaatcattaaataaaaagaacaataactaatcaatatttagttttctgaataattctaaagtcccacaaccagtgctttgaggtcaattcacatttcctgacaaaagaaaacatcatatccttcaaaatgtattattaatcactattgctcagcttcttgcattcctttaaattttacatcattgatttcccatttactttagcctgttattatgactttgcaagaactaaaattatactccccctcaacctatgaccaaatgaaaacgacttttgggcgcttcttttttctggtgttctattaattaagattttgatagcaatttctcacacttggtagcattaaaattcacttgaacatatatgattaaaagaacatataaaatctgaagaatattctagataaaatcaacatatgatactgtgtaagaaatttcttttttggtatattgaaaacattttacaaactatcttgtcctttgtgataccaggttaataattatcagtgttaaagctgatagttattatttcaagtactgagaaaatgaaatttgaggctattattttattcatgctgaaaattttatctagcatagtataatgtatagccaccatattaaaataattgagacttattattgctattgcagtatttgatttgtacattttactttattttttctgatacttaaaatgatatagtaaaaagaataattatcttaataaggaagaattcatttcaagtttattttttatgatgtaccacaatatttagcatcaaataatagtatgaaattattttttatcagtttactaagttttgggaaggggaaattaaattctcatattaatttctaaagcaagctcatagtgtaactttataccactatttttgcactatcaattataacaactattactctgtatggcctttgagtgaaaaatagcaaaataccttttacatataattagaatctgaaataatcactctatcaaacttcattcttacatacttatcaaaatgataaattatagcagttgataagtataacacattcaactatatttatatatatatatatatgaaggaaattcattgtgaaacaggattacataataagtttgatcactttatttctggagaatgaaataaagccttttatgccatcccatctttttcacatgaagcacaaagcttatgtaggtcatatatcactaacttaagcaatttttcattctcagcttgtttttctttttgtgctacataagcaattctgtatttttgaaatgcttcaaaaagtaaccatttaacctaagaaaataaatatttttaaacaaagaaatattcattaaaatcataaataatttcgtctatttttaattatttaaaaaataaaaggctattttccctaaaccttaattatttaatgtaaatatgtatgaatatcacaaattctaagtgattaaatatagctcatgtctgccttttaacacaaacacattcattggagttttaattccttaacgtaggagatgtattaaaccattcctcattactaatcaatttttttgttagatggtctgtatatcagctgagtttaacaagcatttattaagtgcttggaacatgtgaggaatatgttgaaaccagaggcaggtacacaaaatgagtaaaacatgttctatacttgtaagcttctcacagcctactgtgagtgaaaaatccaaaatgattttttatacatgttgctaaacgtgtcatatctgtcaagtgctataatttatcattttaatatgcatgctagaattgtttaattgagacaaggtatggacacatctgagcatagagagaaagagcattcaaaaatctatgattttttgaaggtaaccaaggcctgcataatgtctggaaagataagtatgtgagccaataagtgaagtgtgtgcagggtgttctgagcagaaacaaaaaaaaatagcctgggttaagactgggtaattcaaataatacagtatatgtattaacaaaagtttgatatgcattaatagtgttaattcaattgttttataaattgaagtaaaccctggctagaaatgaagctggagggataggtagtttgtacaggttgtgtatgctacactaagctaaaatgggggtgataaaatattactgcttaatgtctaaaagcatctatagtattgctaatctgttgaaactttcctgttaatacagtaaaagtgatttataccttcctggataaaatatgtaaaatgactagaaaattaataaattattgtttatatctagccgaatctgaatattcattgtaagtttctttattttgaagattatatttaaataataaactgatttgtgttattctctagattaggattttgaacatttacaactgcttagaaggtagagagatactcatgatttagctaaaaagtcacttgtggattagggtgtttccatgactaactaggttgactttatgggcctctaaagacaaaagattcgaatttgaccaaaagacaaaggtcaaggtctttgcaggtatgacatttcctcgtattctgttttttgaaatatagtaactctcatttattcttagaagtatttaagaatgaaaatccattaactttttatgaacctaacctaaatttattcctagcaaactgtttaataaatggaattttataacataatcttatcttactaaaatccaactgttttgccagaagcataattgacttgattctaaattgtaagctctctattaaatttcatgatactgccacttagatttttaaagcttagtagttgaaaataacccctaaacttaaaaaaaaaaaaaaaaactaaagtaatttaatgctctcaaggataaatttctaataaacatgtttgacagagaactaaatagaatggcaaatagtaaaactatccttttatatgtcattattttaaaaagacaaagattatataagtcatgcataatatttgcaagggtgtattttgcattttatgttacctattgttttaatatacattcttgtttaagcaatgttttttgttctaaattatattttctcatatccatttaaatctaagtggaatcacagctaacagttctaaattaaatttctaaaatgtatacagttctcaaatgtaagacatttaaatacattttttatagtaagtgcttcgttaaattattggtctttactatttctcatgtaattttgtagggtgagataatccatgtaaaatagctgtgaatggcacatataaataacttaataaatgtttcttagtagtagtagtgttattagccacatttttatatttctgaattaaaatgtgagaatgatttattagcaaatttgctaaatgtgagcattttttctataatgttttaattagtaatacacatcgacaatcatagaatagtaagtaccttgtgtttgaagtggttttcaatgtatattctttatttgcaaatacttcatccaacagtgaactaatatgtccagaatacaaaacgaactcaaacaacacaacaggagaaacatgaataatttcatgaaaacatgggcaaaggacacaaatagacatttctcaaaagaagacatacaaactgctaacaggtatatgaaaaaaatttcaacatcactaataatcagagaaatacaaatgaaaattccaatgagatatcacttgtcccaatcagaattattattgttaaaaaggcaaatagtatcagatgtgcaatgatgtggagaaatgggaactcttatacgctgttggtaggaatgggtactagtacagccactatagaaaacagtatggagctttcttaaaaaactaaaaatagaattaccattccacagaaattccagtacagaaatttctttttacagaaagaaaaagaaatcaatatatcaaaggaattcctgcactaacatggttactgcagcactattcacaatagcaaatatatggaattaaccaaagtgtccatcaacagatgaacagataaagaaaatacacacaatggaatactatttgaccataaaaaagagttaagtcatgccatttgcagcaacatcgatggaagtggaggtcagtatcttaagtgaaataaaccaagcacaaatagacaaatattgcatctttttacttatatgtgggatctaagatatttgatcaaatgaggtagatggtgggaagatagaaaacagaaacttggaagggtgaatggggaagaaggggagggtgaagagaagtgggttaaagggtacaaacttaagttagatagaaggaataaattcaatgtttgataaccgagtaggatgaatatagttaacaaagttgtattgtacccagatgatggccaccctaaatatctgactcaatcactacatattttatacaagttgcaagatttcacacgtatctcatgaatttgcacaaataaaaaataaagaaaatgcaaaactatacaaaaagactataattttattgattatataactgttcctgataattatattgtctaactgatacatgccgaaattatttagctcatcccagatcttaagataatcattataaatgatatattaaataatacatacatataattacatatacatatacattcctctaaatgcttgaactatattaccatatttccataataaatgattcctaagatggtaagatattccatggtaggttctcatatactctttcacctataaaaagtgactatgcatctgtcaaagaaaagtttaaaaggattctatattacaaaataacttttatcagaaactagaatgcatttagaatattgtttggcaggtctagaaagacttaagagcactccccaccctttgttccacagaacacatatctcatcaattgcaccttgatcaaattttgacaaatggttatacgactattaaacttagtataagttaatattttttcaattttattgtttctcagaagaactttttactcatttggctctttataacattaaaacatataaaacctaagttctgtgaaacaaactttgggaaattcaagtgtatggtagaaattcagaaattcaagtgtatggcagacataataaggaaaactagagatatatgcaactagatattcattagaaaatttttctgcagaaatttaatagttcacagattcgactgcaagaagtttcagagtaaagggtctccaatacataattaaaggcccttaaactctagcaatatttaagaaacaggaatatcaacttccacagttttaaagtaaatgggctaaagaaggctaaaatacactttgaaaatggagaaattcatctctgaagatcccagactgacttactttaattaattgtttattccacatttgagatattaagtagaacttcatgatagttctatgccactaatggaaaaaatgtggcatatgcatagcttttatagtcaagaggtcacccattcctttggatataatttgatccaataaaaaattcagatatattttatacgtgatattatatagggaatcaacagaaccctgaatgaaagaataaaataattagtttttaggagttagggcaaaagctatcatgaattttagtccttttactacaattaatgctggaatccaagataattgcaaaatataaatgtcaaaatggtttgtaaaataaatgtgtttaatacatatatcaaaaagattttatttaattcttttgagtagctttttaaaattaacaatttaataaaatttttagcacctgttatgatttgcctctgtgttcccacccaaatcacgggtaaactcctattcacatttgcttcaaagagaataaaatacctaggaatctaacttacaagggacgagaaggacctcttcaagaacaactacaaaccactgctcaatgaaataaaagaggatacaaacaaattgaagaatattccatgctcatggataggaagaatcaatagtgtgacaatggccatactgcccaaggtaatttatagattcagcgccatccccatcaagctaccaatgactttcttcacagaattggaaaaaacgacattacagttcatatggaaccaaaaaagagccctcatcaccaagtcgatcctaagccaaaagatcaaagctggaggcatcacactacctgacttcaaactatactacaaggctacagtaaccaaaacagcatggtactggtaccaaaacagaaatatagaccaatggaacagaacagagccctcagaaataataccacacatctacaaccatctgatctttgacaaacctgacaaaaaaaagaagaaatggggaaaggattccctatttaacaaatggtgctgggaaaactggctagccatatgtagaaagctgaaactggatcccttccttacaccttatacaaaaattaattcaatatggattaaagacttaaatgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaataagtgggtgagggatatgaacagacacttctcaaaagaagatatttatgtagccaacagacacatgaaaaaatgctcatcatcactggccatcagagaaatgcaaatcaaaaccacaatgagataccatctcacaccagttagaatggcgatcattaaaaagtcgatcattaaaaagtcgggaaacaacaggtgctggagatgatgtgaagaaagaggaacacttttacactgttggtgggactgtaaactagttcaaccattgtgtaagatagtgtggtgattcctcatggatctagaactagaaataccatttgacccagccatcgcattactgggtatatacccaaaggattgtaagtcatgccgctataaagacacatgcacacgtatgtttattgtggcactattcacaatagcaaagacttggaaccaatccaaatgtccaacaatgatagactggattaagaaaatgtggcacatatacaccatggaatactatgcagccataaaaaaggatgagttcatgtcctttgtagggacatggatgaagctggaaaccatcactctcagcaaactatcgcaaggacaaaataccaaacaccgcatgttctcactaataggtgggaattgaacaatgacaacacttggacacaggaagggggacatcacgcaccggggcctgttgtggggtgggaggaggggggagggatagcattaagagatatacctaatgtaaatgacaagttaatggattgcagcacaccaacatggcacatgtatacatatgtaacaaacttgcacgttgtgcacatgtaccctagaacttaaagtataatcaaaaagcataaaaaaaaaaaactggtggcattgtgcacctgccctagagatgtgtggaactttgcacttcagagggatattttagggtatctggtagaagaaatttctaagcagcaaatcatccaagaggtggcttgggtgctgttaaaagtattctgttttaaaacggaaacagagcaaaaaagttcagaaaatttgcagcctgatgacgcagtagaaaacaaaaacccattttttggggagaaattcaagctggctgcagaaatttgctaagtaacaaggcacttaatgttaatccccaagacaatggggaaaatatctccagggcacgtcacaggtctttatggcagcccgtcccattacagacctggaagcctaggagaaaaaaacggtttctttgactgggcccagggtcctcatgctgtatgcagcctagggacttggtgctctgcgtcccagctgctccacctgttgctaaaaggggccaaggtacagctcgggccatggtttcagagggtgcaagccccaaaccttggcagcttacacgtgatgttgagcctgcgggtgaacagaagccaagaattaagatttggggacctccatctatatttcagaagatgtatggaaatgcctggatgcctaggcaaaagtttgctgcaggggtggggccctcatggataacttacgctagggcagtgtggaagggaaatgtgggattggagccctcacacagagtccctactggggcaccacttagtgagctgtgagaagagggccaccatcatccagaccacagaatggtagatccacctataacttgtaccatgtgcctggaaaagctgcagaccctcaatgccagccagtgaaagcaaccagaagtggtgctataccctgcaaagccacagggtcagagctgcccaaaactatggcaacctgcctctttcatcagcttgacctggatgtgagacatggagtcaaacgagatcattttcgaactttcaaatttgactgccccacaggatttcagacttgcatgggccttgtaacccctttgttatggacaatttctcccatttggaatggctgtattttttcaatacctgtacccccattgtatctaggaaataactagcttgcttttgattttatgggctcataggtgcaagcgacttaccttgtttcagatgtgactttggactgtggacttctgggttaatgctgaaatgagttaagactttgggggatgcttgggaaggcaggattgattttgaaatatgaggatgtgagattcggaggggcaaagggcagaatgatatggtttgtctctgtgtcttcacccaaatctcaccttgaattgtactcccataattcccatgtattgtgggagggacccagtgggggataatttaaatcatgggagcagtttcccccatactgttcttgtggtagtgaataagtcttatgagatttaatggttttatcaggggtttctgcttttgcaatttcatttttctcttgccagcaccatgtaagaagtgtgtttggggtttctgcttttgcaatttcatttttctcttgccagcaccatgtaagaaatgtgttttgccttctgccatgattctgaggcctccccagccatgtggaacaactgtaagtccaattaaacctccttttttccccagtattgggtatgtctttatcagcagcattaaaatggactaatacagaacctattcaattacatctaaaatattttattgaaataatatctaatacggaacatatttccacaaatctggaactattttcattctacttatatattgtaaaacatattgaagtagagagtagaatgattgttaccagaggctgggaagggtagtggggaaggaggaataaacaggggttggttcatgggtaaaaatgtagttagacagaaggaataagatttaatgttcaatagcataatagggataatatagttaacaataatttattgtatataaattctaaaataactagtgaagtgaatttgcaatgtttccaacacaaagagaagataaatgtttgaggtgatagatatcccaattactcttatttgatcattacaccttgtatgattgtatgaaaataccacatataccctataaatatgtataattattataaaaattaaaataaaacaaattttgtttaaataaaacattttcttgattattgagatcccactcatgggatatgtgaacttaagtgacttctaacttcacattttaagttagtttcctttgtctaacgctaaacattttgaatacattaaaaaaaaacctcagctctaataaaattagcaggattatgtactatagggtccccttgttatcggtgactttgttttttgcggtttcagttaccattgataaccaagatcggaaaatattaatttaaaaattccagaaataaacaattcataggtttaaactacaggccacactaagcagcatgataaaatctatgagcactctattctgttctgccccacccatccctttgccaagctgtatatgctacctgcctattagatacttatttgtggtctcagttatcagactgagaaaacatactactgtatatatggtttggtactatccacaatttcaggcatccactggaagccttggagtgtatccctcacagataaaggacaatgggactattctactgtcaatgagtatttaagaaatatagcctaccctgatttaatggatctcatttgtagtgttttctgatatctgacagaatttcactaaactattacattgtattatatgttgattaatcttttgtatttaggataaactatcaggtatagctaatacagagaaatatttctacttagaaacattcataatgatgttttatattttaactgaattattttcctgtcttataaattggtagcaattgcctagagctaaataaaatataagaataagtgaaagtaacaggtttttgaaacttaagaagcaaaagaaatcatagaaaatgtaaagaatttgatagcggtctttattaaatatttttgtaatttgacaaaataaaagtatactttacatttctaaataaagcataaagtttttacattttgaaaatcataatttcaatataaaaattttaaatgtatagaatgattccaagcacacagaattgttaaattattaatatattgatttttttgctattaatggatactatatggaatttaagatgaaatatttgcctaaagaatataaatttaatgtatcaagggatctagaaaattaattttaaacaatattttaaattgatctgcactctagtatgaaagtagagactgtataactcattctggataatttagcaacactaaaggaaaaggtgagaactggttcgtggaccagtgtgctttggtaaacaatttcttacttgtccacgatgaagtatagaaatcaagagtaagcatttaagtactttcaagcaaattgacatcagtgcaacatttcctccattagcttttattttacaaaagtattggtgtgcaattacagatacctattggtctttcatcatagacagtttgaaaaatgtagagagtgaataagtagaacttctcctactttaccttctcctctgcaagttaaatcaatttcaatacgctaaattgtcttgaaagatctcatagtagttacagcacattaccttaactgagaataatgtgtttgttcattagcttgatgacctttactcacctaataatgatttttaaagaaatatatttgtaacattaagtcattaatcacattcagctacacacacacacacacagagagaaagagagagagaaagaaaaaaaggaaggaagcagggagggagggagggagggaggcagagaaataaagagagagagagagaatgtgtgattacttcaacagctcttgctaaaagaacagaccataaaaatagcctttttaaaaaagcatattaactccattatagaaatttgtacaaatatactgtatgtccccatagaattgaaatgcttatatataaagtactcttttaatcaccatcatgatactatcaatattgtaattcatatgtatagactgtttattatgttagatcctattctaggcactctatattatttttttcctcacaacactatgaagtagggagaattattatctcaattttacagatgaagacaatgagatttagatacattaagtatcttctccagaataattctctttgcagtataccagttgaacaaatatctttcttagcttttattatacaccagattagtttggtctggtttagtcctctttccagggagagaaagatagaatttacaatctcagtaggcataagaatcagtgagtctcttattacaatgcatattccagggctccacggcagagtctgactcagaatatgtaagtggggccaagaattctagattttaatacagtctccagataaagctgatgcatgtggttcagtgttgacaatttgagaaacacagataaatgaataacattagtaataaatacggtctcataaatactaatacacaaggacaaagtcttaggaaagttttttaaaaatagtaaatgattatatagaggaggatgaaataaaaagaaatgagatttacacattaggattagcttgaaaaatatttttaaaaatacaggtaagagaccaggagcagtggctcttgcttgtaatcccagtgctttgagagatagaggcaggaaaatcgctagaagcctggggtttaggacaagccagggcaacacagtgagactcctatctcaaaaatataaaaattaaattaaatttaaaaatacaggcataatacttgagaagatgtccaggttagtagatctattttactgtatcatacacagggcaagagttgtaatttgaggtaactgcagaaaaaaaactggatccaaatgcaggggagtgggagacagattttgtaattccaagataagatttccgagcttcacaatatgccagttggccctggcagtatcactggctacagttaaatatagaaatgctaccagctactccctctggatcatgttacatagacttaagcatgaaattgtaggccaaataatgcccctctacctccccaaaaatgtatctctggaacttgcacatatgtcatgttacatggccaaaaagcctttgaagatatgattaaggttaaggactttatgatgcggagattagcattcattagccagatgggcccaagccaatcacacggactttaaaagctgagaaatttcttcacctggagtataagatgtgtggagggagaaagtagcagacagatacatcagaggggaaatcaaagattccaaggtgaggaggattctttttaccagttgctggctctaaggtatgaggcctctacgtgaagaggagagaaagccttaggagctatgggcagccccagctgacagccagaaggaaacaggtatcatggtcctacaaacttgaagaactggatcttgctaacaatcagaatacgccagaaagtagattttccccaaaacctttggatacaaacccagcccactgaaatttttattttagccttgtgggactccaaacagagaaatcagcaaagaacaccaggacttttaacttataaaactgagatagttttttaagattattttaagatgttaaattgaaaactaatatgcattgaacaagatactgtgaatcaatacctgaagattttgcagtatgataacccatccttcagtactatctgaatgtcaagtatcctatattttaagtcagcacatgccaaacatacatttaaatgtcaaaaatatatgaatctattttaccttaagtgaaaaagatggacagaaatttagtgtggtatatgtagaaacaattgggagctatgaaaatattttttagtatgagttcatgaaacctgacagccaaaccaaaaaacatgccaacctcataattcacaagtacattttcaatatatttagtacttcctgaaagcttaaactaatctaaaaatatctttatattttgatgaacagaatacaggttttttattaagagcgcttagcacaaaataattgcattactaacttcttcttcagtattgccaaaattataccttaaaattaaactttgtggttatagtgttttaaactatgaattaagttgccaggataaagaatattcaactattgtgagagctccttagaaaaacaacgattattactatcaccgtggaggaaattaagtcttggaatttatcctcccttgctacacaaaagacagttcagaaaagtattaggtagaaaataatgttcaaaactgctgctatctgacattatttaggatataaaacagagaaagcattttactaaattattagccagaggattttttttctagtgaaaaatactgtactagaattagtgtttagtttaagacattcccttacatgcaagatgttaacatttatactgaaacaattctatttactatgtgattgttttctttaaacacattatattttgaattattatatggtttagaaattaattgcccttgctacggtatttatgtatctctttatgataatgttagacctgatgtgataaattctgtaatatggtcctggggagatgaattgaaatctgatacactatccctatggggaagaaaaggactctttcctaaattagatggaaattttattgtcaaatcacatagataagaaatgataagtccatgatttctatctgaaaccttcaagaacaaattatttttgccatcagaattatttttgctagcacattttttaaaaagcaaaacatgtagattctgtgcctttaaacactctgagtagagcctgggcaccatcccattatcaaacgatattttcctagtgatatgtatgagtatccacactaagcgtgataaataaagatcataaatgtcctctattcatttggcatcaggttttgatgccaactgagtttgtaccaaacttctaggaaaaagaaaaaacacaaccttcagttttgagaaatatttagttgtcctcttcctggtttaagggattattgatcttattcctggaaaggctgtttcaggagtagatgtcaactcttgtctctttctgaacttcttctcttgactctaactttcagagaagacagattactagtttactttctggtagactggcacagcacaagggactgtagggtagggtctgtgatgcctgacacacaaatcaggtctagagtcctattactctcacatttaattccgttttgttaattcgtaaccctgtagcaatttaatggtctcacatagtgatataaaatattaaaacccactaagtatagcattttactatacattaatgattaataacaagataaatttcaggacaagatttgagacaacatgatgttgtctcaaatgttgattcttctttcctacttgaaaaattttgttagattacattaagggcagtggtttgtttgccactaccatcacttaccttcgtaatataccttaaatccatgagcactaactgcaaaatcactggtcaaacgtagtgagaacacagatttggtacttgtcactggaggtggcagatggaatcctgttaacctaaaacaaaatggaattaattgttagagacataatcattttatctaagagtttttaagaaggattaaagtcatatttaaaaaaaataataaaacagattttctcctataatttccagaaggaatgctatccagccaacaccttgatttcagcccagttaaactcattttggacttcagccctccagactgcaagataatacatttgtgttgtttaagctactaagtttgtggcaatttgttgtagcaggaatggacaactgatatacaattctttcctgggttttggaatatacatttttaaaatatctagataaatactaatttattctataattgaatatggaagtcctgtgaaacctagtgactaagttaccaagactgctgttgatattatataaaatgagtacattcagaacctattaaggcaatatttatgtaattatgactaaaaatctctctatgaagagcgataacatagtatgagatattatatatatagtataatatgaaattacatccttacattagaagatacaagagaccgagaagaattaggcaactagatcaagttcacagaagagccaggtctaagactacaactgtattattgcctcctattatcaattaaacaccctgtttggcatctgattgtctttgagacattaataaaatagaaacaataaatatttgaactattaatgtgtacattaacatccaaatcattttgtatacaatttcaaattggtattcactcagttgtattaaataatatttgaagcaatatttagaacacttttatcattaagttactcaaagtaatagagaagaacattgtgaagaattgttcacttttagcaaaagctgggtttctgtatatatgtttaaataatcagcatgtagtggcatgttgtgtaatgggagatttgttttgtttttttaattttaatcaatgagagaacaaaatgtattttttaaaagttattttcatataatagctgtatcattatgaggatttgaggtaacttgttttactccttcttgtaatacgttgtataattgatttaaaaataaactcagttatgagtctaattagttttttctttataagacttcattttgtaatttcatatttatgtgcatagttattaaacatctttttctcctttggatactatgcttcaagatgtcaatgttttttctgcatctgttgagatgatcacgtgaattttgtttttaattctatttatgtggtgtatcacatttattgacttacgtatgttaaaccatccctgaatctctggtgtcaaacccacttgatcatggtgggttatctttttggtatgtttttggattcggttagctagtattttgttaatgattttcgcacccatgttcatcaaggatatcagtctgtagtttccttttttggttatgtcctttcctggttttggtattaggatgatgctggcttcatagaatgaattagggagggttccttctttctctgtcttgtggaatagtgtcaaaaggattagtaccaattctttgaatgtctggtagaattctgctgtgaatctgtctggtcttggactttttttcgttgctaattttaaaattaccatttcaatcttcctacttgttattggtctattcagggtgtctaattcttcctgatttgagctaggacggttgtatttttccaggaatttatccgtctcttctagtttttctagtttatgtgcgtagaggtgttcacagtagccttgaacgatcttttgcattttggttgtgtcagttgtaatatctcctgtttcatttcttagtgaggttatttggatttcttctcttttcttggttaatcttgtgaatggtctatccattttatctttttgaaggaccagctttttgtttcatttatcttttgtaattttttttgtttcaatttcatttggttctgctctgatcttggttatttcctttcttctaccggctttggtttggtttgttcttgtttctctagttccttgaggtgtgaccttagaatgtcagtttgtgctatttcagtctttttgatgtaggcacttatggctatgaactttcctcttagcaatgcctttgctgtatcacagaggttttgatacatcgtaccattattgtcattcagttcgaagaatttgtaaatttccatcttgattgcgcttttgacccaatgctcattcaggagcagattatttaaattccatgtatttgcatggtattgagggttccttttggagttgatttccagtttcattccactgtggtctaagacagtgcttgatataattttaattttttctttatttattgaggctcgtttttggcctatcatgtagtctatctactggtctatcttgtagaaagtttcatgcattgtttaatagaatgtgtattctatggttgttggataaaatgtgctgtatatctatctgttaagtcagtttgttccaaggtaaagtttaaatccattgtttctttgttgagtttctgtcttgacctgtctagtactgtcggtggagtgttgaagtcccccactattattttgttgctgtctatatcatttcttaagtctattggtatctgttttataaatttgggacctccagtgttacgtgcatgtatgtttaggattgtcatattttcctgttggacaaggccttttaccatcatataatgttcctctttgtctcttttaactgctgttgctttaaagttggttttctctaagaacacctacctctgcttgcttttggtatccatttgtatgaaatgtctttttccacccctttagtttatgtgagtccttatgtgttaggtgagtctcctgaaggcagcagatagttggttggtgagttcttactcattctgcagttatgtatcttttaagtggagcatttaggccatttacattcaatgttagtattgaaatgtgaggtacccttgcatacatcgtgcactttgttgcctgtgtactttgttttttatttgtttttggtttttaacttgcatttttgttttataggtcctgtatgatttatgctttaaagaggttctgtttgatgtgtttccaggatttgtttcaagatttacagctcctttttagcagttcttgtagtggtggcttgataatgtcaaattctctcagcatttgtttgtctgaaaaagactgtatcttttcttcatatatgatgcttagtttcgctggaaacaaaattcttggctgataattgttttgtttgaggaggctgaagataggcaccaattccttctagcttgtagggtttctgctgagaaatctgctgttaatttgataggttctcctttatatcttaatgtaataaaagccatctatgacaaacccatagccaacataatactgaatggggaaaagttgaaagcattccctctgagaactggaacaagacaaggatgcccaatctcaccactcctcttcaacatagtactggaagtcctagccaaagcaatcagacaagagaaagaaacaaaggacattcaaattagtaaagaggaagccaaactgtaactgtttgctgatgatatgatcgtttaccttgaaaaccctaaggactcctccagaaagctcctggaactgataaaagaattcagcaaagtttccatatacaagatccaagattaatgtacacaaatcagtagctcttctatacaccaacagtgaccaagtggagaatcaaatcaagaactcaaacccttttatgatagctgcaaaaaaaaattaaaatacttaggaataaacctaagctaggagtcaaaagacctctacaaggaaaactataaaacactgctgaaagaaatcatagatgacatggacaaatggaaacataccatgcacatagatgaggagaatcaatgttttgaaaatgaccatactgccaaaagcaatctacaaatttaatgcaatccccatcaaaataccaacatcactcttcacagaattagaaaaaaacaattctaaaattcatatggaaccaaaaaagagcctgcataaccaaagcaagactaagcaaaaggaacaaatctggaggcatcacattacctgatttcaaactgcactataaggccgtagtcaccaaaagagtgtggtgctaacataaaaatgggcacatagaccaatggaacagaatagagaacccagaaataaacccaaatacttacagccaactgatctttgacaaagcaaacaaaaacataaagtggggaaaggacaccattttcagcaaatggtgctgagataattggctagccatatgtagaagaatgaaactggatcctcatctttcaccttataaaaaatcaactcaagatggattaaggacgtaaatctaagatctgaaactataaaaattctagaagataacattcgaaaaactcttgcagacattggcttaggcaaggatttcatgaccaagaacccaaaagcaaatgcaataaaaacaaatataaatagctgggacctaaataaactacagagcttttgcacagcaaaaggaacattcaccagagtaagcagacaacccacagagtgtgagaaaatcttcacaatctttacatctgacaaaggactaatatccagaatctgtaaccaactcaaatcagtaagaaaaaaaagaaaaaatcccatcaaaaagtgggctaagggcatgaatagacaattctcaaaagaagatatacaaatggcaacaaacgtgaaaaaatactcaacatcactaatgatcagggaaatgcaaatcaaaactacaatgcaataccaccttactcctgcaagaatggccgtaatcaaaaaatcaaaaaaccttagatgcttgtgtggatgcagtgatcagagaacacgtctacactactggtgggaatgtaatctattataactactatgaaaaacagtgtggagattccttaaagaactgaaagtagaactgccatttgatccaccaataccaccactgggtacctatccagaggatatcaagtcattatttgaaaagatacttgtacatgcatgtttatagcagcacaattcacaattgtaaaatcatggaatcaacccacatgtccatcaatcaacgagtggataaagaaactgcgatatacacatatcatatatatgatggaatactactcagccataaaaaggaatgaattaacagcatttgcagtgacctggatgagactggagactattattctaagcaaagtaagtcaggaatggaaaaccaacatcatgtagtctcactaatatgtgggaactaagctgtggggaccaaaaggcttaagaatgacacaatgaactttggggacttgggggagagggaggtgggcacgggataaaagaacacagatatagtacagtatatactgcttaagtgatgggtgcaccaaaatctcacaaatcaccactaaagaacttactcgtgtaaccaaataccacctgtaccccaatacttatggaaaaaaaaagatgtcagtgtttgggactcagagtctaaaaccagtgcttctgtcaatgtatgtcatggaggagtctctcagtaagtacttattaatctaatgagttgaaatggtaggagaatatcgatgccatcttaacaatttcttattcacactaagaattgtgttcttgaaacatcataagaatataaatttattgttattaagttattaagaaaatttctatagcttaagtagagactcttgttcagagaaagtaagttttccccatgttaacctcaaaagtttaagataaatatctcatgcacacttttttgacatatctttctaggaacaacaatatagttcgaaaacttattttaaggtaaagctaatatgatttgtatctttaaaatgtgagctataaatttatggtatttaaatatattgttttcacttggacttaacatgttttctaggtaatttaaaagcatactattttatagataagtatgctatttttccatgtaattatttgtactggttttgatatttgtaaaatttagttttttgcatatattgctcgttactacattatcagttatattccctccgcgttgatgcacgatgaaattgcatagtgaatgacattttatgtttctttgaaaattgtaccacagtccagcggtattttctttgactcacagttgaagaaatcacagctcaggaatgataagtaaattgtttaaattcatgcaggtggtaggcaggtagtggagcaaagataaaaacagtaacttcagacttcaatccactaggactttcccataagagaaatgatttttttctatgaagccagaataaaattttaatcagttttggtttttgcacaatgcccatgtaggtttcttaacaagtattttgaatgaatagaacatatttcacccacatcacaactttaagtagttgtgggtggtaagaattattatgaagtcattgaattaaaggtgagtaaggcaatggggagccattgtctgactagttggtgacagcttttttttttttttttttgacagagtctagctctgttgcccaggctggagtgcagtggcacgatctcggctcactgcaagctccacctcccgggttcaccccattctcctgccttcagcctcctgagtagctgggactacaggcgcccgccaccacgcccagctaagtttttgttttttagtagagacggggtttcaccgtgttagccaggatggtctcgatctcctgacctcgtgatccgcctgcctcggcctcccaaagtgctgggattacaggcgtgagccaccccgccccgccagttggtgacacctttatagcgaaaactgcactggttagcaaagatatttcccgactgggaaaactaagtaagattagtaaacatttaaatatatgagacgaacatcctggaatcatgcaatataaatttcaggcagatatttttaatatgtcaaaaattaaggctgaccaataaagtattaaactgtattcattctgattattagtgaatattttgtcacatcttgacaataactatgttctctcaccctaaatttgtctttcaaaaatgcatgtaaactcatactaatgaataatcatttcattttgatacatttagtttcatgaaaattctacagcttttcctctatttatttttttacatttcaactgttatttggtgaatattttgtcatggaccaggacttgtctatggcaattttttcagtacattttctcatctgacagaatggtgcaatgtattagctggtattttttttttcattttaaattttatggtttctaattgataatctctattcttatttgtccctactcccacatacacctccaaccccatcttagcattttatgttttactagacaagaaactcatcagaggcttttgttccctgtttgaaaaatcatgcacttagaacatgtgatcctgtctcttctcatgttcccttttggatgaaaacattcttgaaatatttcctctgtaaaaacttagaaatgataacgatattttatactgaaatgaataactagtcacaaggagaattaaacaattaacttacaactttctatcaataactaatatgaaaagtactaaagtaattatttggtaattaatgaaaaagtgatagaaatttacattgcaagaaatccatttaaaatgtcaatgaatatgttttttaaataataaattgtacgtttagaatattttgtaattaatgagaattaacatactgtatttcaacttaatgtgatgggaattcttaaagcatcagacttgttaaagcatataagaatcagcatcattcttatagataagaatgatacctgtctcactatctaactatgtttattaggttttaactgtaagattttattttttctgggagagttgagaagaacgaccacacatatacattctctaagaatgtaaaaaaaaaagactctatttatttaaatgtaatgtgtataacagctgattacaatattaaaatgttatttaaagaatggatgtaacaggcatcgttttaaattaagaggttattagcatattgctgcttataataagatagaagcaaaatagacatggatgtaagaggtaagagagaaagggagagaaagggaagcaggaggaaaggagagaggacgaggagtaaagaatgactgatgaagaaagaaataggaagaggagagagagagagagatttatttaaaaataaaagtggtactattacaaactctcaggattttgtgaatgttaagtaaggtaattcatgtgaaatgatctagtgtactttttggataacaaattgtcattaaatattagtttctttagtgatgtgactcaaactccattgccctttttgctgcaccctgtactgctaatgctaagatatattatataatacgaccagcataagcacagtgatttcacattactcacagtaagacttttggatatgaattatcttataatttttctttggttcaacagtccttaaaaatgatccaaggatatacagagaattctctgctgaaacaaactattagcctatttaatgtcacaataaacaagaaaaccacaggaacaagctgatatttaaagtaatggctgttctgttaaaataaatcatgcatatcctattgatattggagtacatgaagcacagcacaataattcatggttatgtcaagatgtcactggcagtaatattaaagaaaaatatggctgtggcaacatttgaataattgtatcatttgttgagagcaaatgacctgaagcttctatcaaatataaaattccagaaagaaacgtgtgagaaaggcaaattcaccatgttgggaacatgtgctgggtatacatgtaaatatttgtcagtgaagcacttccataagatttggaatgtgaataaaagttgatgtcatggcaggtaggtacggggacttcagaaagttttagaggtgaggtttatgcattgacttaacagaattcttattaaaaacaagcatttgattttgcaaacaactgagcttatcactggtattttcctgcaattctgcaaattcttgattacctgaaagttagtgaaggctatctttgaccatcaaaagccagccttaaacctagaattcttattattaaaagaattcctgcttgaaatatttcatttttttggtctgagcactgagaaatgcaaaaagactaccagcctattaatgaaattttcctctccaaataatttcaaagtaggttattttctagtaaattattttcactctttttgttacaaaagtgttcctttgatttctagcacaagttacagtaatatgcaaataattcttagataagatgatattgacagtatattcttaactatttgtgtaaaactatgcataattttcattattttaacttttggcattttttcctctatataaataaaaatgatggctgatatttaaagtagaaaaatataaaccacaatcttctagagaaaactttttcttcctgcaaaaatggatattgataaaaatgtagatattctcagctcactatatttaaagataccatgtttccagaaaatttgtttttaccattgactttagagtttgatcttcaggatcaacattttctccagacccatgaaatacactactaaaaattttcttcaaaagtcaacctttccaatttgttctctttatgctacaaatacttcaaaccttctataatgtcccccttcttattttttccattgaataactgacgtttaaggttatacatgactgtaattccaaaggccatcttgaatcattgagaaaactagaaatacaggaaaattatgtagagcaattaatcaatttaaatatattttacagtttccccaccttgtataaactcctgaaaatgttaattagcatatttttctaaggtttctaagaagcagttgactctagtgactataagcttgtattttagagtatacaattgaaaaaaaaattcattctgctgcttattagcagtgtaatattgggcaagctactttattccaaaaaactagggataagatgaggtaaatactaggaattatcccatagttatgttgggagatttaattgggataatgcttgtaaaagcttaccacagttgctgacatatgctgaatatgatttttaccataattattttgatgatgaacccacccaaggttcatctaattataaaaaaactcattcagtgataactctggagctggactacctggagtaaatctcagtgattccatttactgttgtgtgacattgggcaggttacttgcctctcctgattcctcagtggcaaaatgtagatgaaatggtaccttccctttaagtccctgtcaagtttaaataagttaatacaagcacatcacttagaacaatgccaagcatttagcaaactagctactcttgagaaagatgacagatctgagaattagagaattctttcacacaccactcagagttttcttcttgacgcactacattattgatagctataacaaacttggagtatttgggataaatgtagtatttcttcaagtacatgctattgtgttctactaggttgtttattttttctgctaagtttatcattgctatgacttttgatctttttggatgtagaattagtaaagactcatcacaagttatttatttaaggtcaatttaaaaaaattatgaccgagagagaggtgagagcattgatgaagattctcaattagaagacagacagagagagacagagagagagagagagagagagagagagagagagaaatacatctgtgtctttagtaacttacaattactgagattgagtcaactgacttcctcccataaaccctgccacctttttttggtgcatttcaaagatatctatcagaaagtattgcacacactttatcatgttaattttactgtatttctttacaagtactctatattcattaaggaaaaactgaaacaaaacaaaaaacacgattctacaaatgcatgctttgcatttcccatattgacaattttttgtttggtccacttatccagtccacaacaataagaatttaactcaaaatttatggctccttctatttcccagaaaggtaatattaattagcacccactctcggttttagcaaaacatgaaatttacacaacttttattattttttatgcatttaaaatgtatatattataatgtggtattttctttgtcaatttcctccagtaattagagggtttgcacatacaatctatgccaacaaataataaataatctttgtgatatgttccatggtaaggatgaatcataatttctttaatctgaaataattatagaatgtttctgaggatctattccattaccagttttgttgacttaaatatttttaaaaaatatattaagaagagatacattttacataaaatacaaagagcactgcaattggagattttgaataaagccttatgatagtgatgattaaagatgttttgataaagaaactactatagtttcatctagacattgtaaaatttaggagtgtggagaaccttttcagaaaagttttgattctgtttttaagtcaatattttatttacaaagctattagagacaagttactgagaatataacaattactcttacaagatacatatagccattaattgtttccattgtgcccaataacactttcttataaaattatcaccactgccctctgagatgattatttatttgtgtgtatgcatgcatatatcccaatacaactggtaaataacataacacctcaaaatattatttctaatcattttaggttaaataaaagtataatctgtcttcattggaatacatcataaagaaaacattaacatgagaatgcagtgacatggaacgtacatgtggtcatttacctaattaatgaatttagacatgatttatggactaatttagtgttttcaaatgatcattattttcttgtcacatgaaaagccattcagtcaattattatactattttaaaataataatcataggccatattctaacatttaaattggaaaaatggttaaaattaaataataaattacttgtactgttataagctcttttactctatatgaagtatttttttaaattacccatttatataataaatataaaatgataaaattttctacttcacaatattgaaaataattaaggttaataaatactagtaaacataattacataataatgtcttcatatatttgaatgttctatttttcaacattctagggatacttatgtgagatttactaatatgagaaatgccaatttaattatattttagtaaactctaataactatatattttagttgttgaaaaccatggaaatatgacttgaagttgcaataaatgttttgctgtctattatgtatctgttttaaacataaaagtctgctataatacatgtgactttccccattatctgtcagctaatattatggcattaaaacagagtgattagattaaagtaactcatcataatatttcaatcatttaacattttcatgataactacgataggacttcattgggggaattaaaattttctttttaacactgcatttaaggacagttattggaaaattgcatgtttctttgaaaagctaataaagtttctatgtaagaaggaaagctaaggtattatggattctagatggaagaaataaaaaatactgactactttcgataaggctagtagatagactttttaatttgggattcctttgagagcatctcgttttcagttacactatggaaatagacaagaaaccaccattgtcctggaaacccaagatgtttgttcccctacgagtagccaccagtgtatcagatactgaaaggtttaatagagaaatatgttattgactgtacacaaagttatatgaaatcatcaataaagtcagagagagggaataaattttgtttgaactaggtgtgtattctacacaaaaaaactaaaggaagtaaaataaatatcaatagacaaatgtcaatgagtattttatagtgaaaataacaataaaagtaacttccttgatagattttcatttttcaaggttctacttctacttacttctaagtagaagttctacttacacatcacagacaagattagaataattgcataatgtttttaagccaatatccactaggtttaggaattagcattttaccatattttataactgttaatgtgtcccaggtattcaattaataatgcctagtttaaaagaatgtttacagtttactttgtaattattatttctttctttaggggacccatataactctgaaatttgggtacaattttgatggaatagaagaatgatagaaatagtttattcttacatggtgtgtagttagatgacaagaatgtaaaataaaaaatttataagttattgaatttctgaaagagagaatattggcaagcataatattaaacagtcatgttcgtaagtgcataaactaatttatattcaaaatattccaatcctattttgtaaatgataaaaatttaagaaaattcaataatatattttttatcattagatcaacaaaaatatacataaaacaaaagcatattcttaaactatgtactgatgtgcatatttggaaactaaatattatgaagagaaaattgtttgtaaatgtaaattggacaattatatgcagaagcattatcaattatttttattagtctttgggaacaaaaaataatagacaatttacacacaaaagtatcactgattttttggagaatttgaaatatgcttgtgaatgagacaaaaatgtaatttttgaggtaacatatgagatggcatgctgttaaacatagtagttatattaacagttgccagacaattttagcaagttacattggaggtaatattattaggttgatgcaaaagtaattgaggatttgccattattttttaaaggtgaaaacctcaattacttttgcaccaacctaataaaaaatgaactaatatgttaaaaatatgaaaacagagaaggaaaagaaggtggagtgatgggaaagtagggagaagaaagatgaaaaaaaattttgctaaatttttgtaacctatcaaccaaccaaacaaactgttccagcaggcattttgttttagagtcccattttaaattccttctaaacacattatctttgtgatgttccaatgttaaatcattgcaaccatgacacaccttcactctagctatgttatatgcacatgggtagagacaaaattttactatttatactatgtaatatagttctgaacattataacatctatactctcataggtgaaacatttttatcttcagataacctcttacctgacctttaagtatacatatatatttatatatatacatatatatatatgattcctattttacgtgcccacttggatatctaatccacatctcagacatatgtccaaaacctgaatttggagattagaaactgagaagtggagagaagctattatttctcctttctctcttcctttctcttcatttgcttctggtagcaactgtggaagtgactgtattgctttgaggatccctgctttggtggcagcagccctctctttgtggttcagcagtgaccatatgattccccatctatagggtgagcatctgctgatggtcctcccccattcccatatccactatgtgccacagtagtgcatggtacatggcacacacagaaatcagtttgttttgtattctggaaagcccaatccctcggtctcactctctagccatattttctttctttgctaaataactcctgaatcacttcttttcctttacccgctttcatctcttcacttcttttataacaagttccctttattaaattctttctatttgttttcctagtcatagtttgaaacagaaattaaagaaggtggctatttatgggtagaaaataattttctcatttttctcaccaaagatgtaggaagaaaaatacatataagaaataaaattaatagataaatactttacatttagttacagttaactgagtactaccttactgatgataaaatcagatcacggtttaagtgttatttttcttgagtaaaaaatatatttccacaaatgatattctatctccattgaaaccggatttatatctaggtagtcttaaatgaattctaaatactgttttacatcagaactcactgtactctctgagccattagatatgtcttcttgttaccatgtattacattaagaattacattgccaaatatatatgattcacttaatttaattttagctaattaggaacatgaaactatcttgaaaaggaaattcaaggatgcttttaaaattaaattatttatgttaatgtaataatagtttgtctgtttttatgttaaatcagcataattattttaactaatgaaataatgttaaatgctaccagttattaagtttctactatgaatcaaacattcaacatacattatctcattatctcccataacatatatgtctatacatgactttatttatattattccattttgaaaatgaagaaaacaaaggcctatgagaatataaatttctcgttaaaggccacattgtcagcaaacggaaaagtcagaaattaggccactttctttttgctgttctgcgaggactctcaattagttttgctaaatttttaatgagtgtatccaaattattctgatgtaagaagttaacgtgaatgcttaaaattaatctatggatctgataattagaaaatcaccttgttctgagtagcttcagtgaggtgacaaatctaacttattgcttattaatagaaataggaaaagaggaactatagtagcccatattgactatcattttaagctatttgactgtgaaaaaaaataagttacagcgtgactgacattcaccttaataaaggacaatcctaattacagacttgcggaaggagaaaatgaggaacagaatcataacatcataaatagtaatgcggagtcatagaagccaagatttcaagagtatcctcactaatgattatgtaaaacatcatgtgggtgtcatgtactgagttaatgttttacacatttaatccacaaaacactgtaaaaatagccatgttttatatccttattttccataaagtttatttttattttcattttatttttaatgggtacatagcaggtgcatatatttatggggtacatgatgtattttgaaacaggcatataataagccataatcacatcatggtaaatgggacattcatcaccccaagcatttatcatttctttctgttataaacgtcccaattatactcttatagttatttttaaatgcacaataaattattgttgactgtaatcaccctgtcatgtagaaaggttaagtggtttgctcaatcctgtttgtttagtggaagaactataattcaaaagaggttttttttctgactccaaaattcatgttctttctactaatttaacactattgccaccacaatttacatataatatgaaggtgaagaaaagacagacatttagaattaagtattagaagaacaaaatgttttcccatcaaagaacattaacataaaaaataatactgttttaaaatattagctatctaaaggtagagcagaaagaatgatataaaataaagttaaaaatttagcaataggccgatttagtggattggaaaatatgtgagtttaaaatagaatagtagaaaactagggccagcatgttagctcacgcctctaatcctcgcactttgcaaggcccaggtgggcgaattgcctaagcttaggagttcaagaccagcctgagttctagtgtgattgcattttggtctcagattgtggcaattcctcagatatctagaactagaaataccatttgacccagccatcccattactgggtatatacccaaaggattataaatcatgctgctataaagacacatgcacatgtatgtttattgcggcactattcacaatagcaaagacctggaacctacccaaatgtccaacaatcatagactggattaagaaaatgtggcacatatacaccatggaatattatgcagccataaaaaaggataagttcacgtcctttgtagggacatggatgaaggtggaaaccatcattctcagcaaactatcgcaaggacaaaaaaccaaacattgcatgttctcactcataggtgggaagtgaacaatgagaacacatggacacaggaagggggacatcacacactggggcctgttgtggggttgggggagaggggagggataacattaggagatatacctaatgtaaatgacgagttaatgggtgcagcacaccaacatggcacatgtatacatatgtaacaaacctgcatattgtgcacatgtaccctagaacttaaagtataataataataataataataataatagaacagcctgggcaacatggtgaaaccacatctctactaaaatacaaaaaattaactggttgaggtggcacatgcctgtagtcccagctactcaggaagctaacacaccaggagagaattgcttgaacccaggaggcagaggttgcagtgagtcaagactgtgccactgcacaccagtccaggcaacacagcgagactctgtctcaaaaaaaacccaaccaaacaaacaaacaaaacagaaagagagcttctgaaacatccaaataaaatatttgttgaaagtaaatgtgtgaccagattctagaagggattttcatgagaagaacaatagaattgaccctaacagggcaattagtgtcccatgaatgttatgttatcagatatagagaataccaaaaagttggcagagagaaactgtctttcctccttctgtttcttggttagaaaacacacgatctctacacgtcagaaaaccagccaacattgtctctaattcgtagttccaaatagttgccccatcacgaaaaccatttttctgcattctatcaaatataaacttccagaaaacaactagataaaaaatttagtggcttcaagttgcatccttgtaaacacaagcgaaaaaataaagcatttatagaaggtggtaatgggcagatacagggtcatgctactttctcataaagttaaacacaacattatttatgtttgtcctttcttgtatgctgtaagaaaagtatatcaatgcttgatcagaaaaagcaaaacattttgttaaaatattgtgttatttgtatatattgaattaaattgttttattaagttaatatattaaactaaagaaaagaatttccacgtagctattatgaaattaggtgctagaaatatagataagatactctattaggtctcaatacctatcataaaactatagtgtttaagtcagtacagtatttgttaaagggtaaacatactagaatctggtcgcacattaactgtcaatacatactgtcagtattatgaatgaaaatattttacttggaatttgatggaaactttggaatttcatgttagaaattgttcatagaaaacatcaaagttaaccacgagaactgaaatatgaaaaatttacctaacaatttgatgcagtagtaaatcagatgggaacaataaattactccaattaatcataccaagaaaacatttagtttaatctggactaattagtaatctaaaaatgctattttatttaaactagtagtcatttctgatccactcattaggcaaatattacagaatatttatatcataatagtattatgttaagtatcagacatacaaagacaaatatagctgctcctaaccaaaaagattcatagtctattcagcctattcaacaccaagagctggtcatattaattagttatatatttactttttgtatattttttgataaagaaacacattttaatttcaaacaactatagacgttttaccatgatggaaattcaaagtcattgttttatgtaacatgcacctgactgacacatttagttattccgaaatcttgtagaaaaatatcaaatttctgcttttattaaaacacaaatttagatgtgattaagcagaagagacaatatgtagcaaattaaaatttgttgatacacagtaaagctggatatatttaatcaacaggctttgatacaacacacagtaagtacaatattagctgtgtgaacttgcacaatgtcaaataatagagaatagtaagagcaattagaaggtataaaaataaggttaatactataattaaaatttaatttttaaattggatgtggaagatatgataggaatatagttaggttggtgttgaaaaataaaaatgaagattttatgtgaaaaattttcccccatgatttttatttattctggatattaatcctgctaggtttctctcaaaacatattttgaaaatacttacgtattttaacctaaataaggttttttttctaaaataacaagacattgatatgataatagtgggattcattttataacattagcacttcaactgtaaattgatataatcattttcaacattttattttcattattgacctcaaaattaagaagcaaattaatttgttaaatctgtttcataataaaatattccttttaaacttaaaatcagcaagtattttattgagcatcaattatgaattaatcaagaggatagtaggtactcatcatttaatgtaatatcttgcttattttaatattctcttatcatccaaagacaagagaagaaaacctcaaaataacagaggaaggtttgtttgtagtagcttctttttggaaggtgggaagctgatggaggagagcttggagagactagttacatgtttggtaaaatccgaaggacatagcagagatgaaaaactcacaaagcagagttcaaggtctggctagagatgagggtcacagaaaggatagcaaacagtagagactgaggaacaggaaggtaagaaggagcgagatccctagagcagcgatctgcacacaatgcctatatcaaaacattgtgtccatggattgttcatatttgttgaaggaagataggagtaaaaaatatttcactgaatattttcttattgaatacatattaatttttatactgtagtctaacagagacagaaaaatgtatttcttctggtaaagaactcacatgtccctctggctcacaagtgcattgagccaatcagtgctgctataaatattagccaaaagcgtgctcaacaatactttttagaaagatttgtctgtatgataaaggataaatacataataaccaatttggtttcaactgactatctcagagattactcatgggtttgttctgcattcttagtaatatcttatttttaatgtagaatatttaataatttgtaaataagatagtgttaattctagaattattttcctttcctttttttgctgctcatgcttatttgaaaaatatgtgtagaatagctatttgtgttatattgctataataaaagcataaaatatgttgccctgcctaagtagtcaatgggggttgaggaaacagattccatggtctagaaatcagattgaattcagttagtaacacaatatattttttgtttgcaataactttgaaggcatatcaaaagcatattgagcctttaattggagagaaagtggctagaaaaaccagaatgttagtggatgtggtaaataataagtacaagcagccaacaaacacatgaaaaaatgcttaacatcaccagtcatcagagaaatgcaaattaaaaccgcaatgagataacatcttacaccagtcagaattgccatttttaaaaagtcaaaaaacagctgggcacagtggctcatgcctgtaatcctagaactttgtgaagctgaggtggatggatcacttgaggccaggagttcaagaccagcttggccaacctggtgaaacccctctctactaaaaatacaaaaattagctaggtgtgtggcacatgcctgtattcccagctattcgggaggctgaggcaggagaatcgcttgaacccagaggcagaggttgcagtgagccgacatcacgccactgcactccagtctgggtgacagagcaagcctccatctcaaaaaaaaaaaaattagcaaagcatggtggtgcatgtctgcagtcccagctacttgggaggctgaggcaggagaactgtttgaacccaggaggcggaggctgcagtaagccaatgtggcaccactgcactccagcctgggtgacagagtgagactctgtctcaaaaaagtcaaaaaaaaaaaaaaaacaacagatgttggtgtgaatgcgaagaaaagggaacacatatatttttcatgagaatgtaaattagttcaacctctatggaaaaccacgtggagatttctcaatgaactaaatgtagaactaccattcaactcagtaattccacaactgcatatccactcaaaggaaaattctataaaaaatcattctataaaaatgatacctgcacatgtatgttcactgcagtactattcccaatagcaaagtcatggaaccaacctaagcatgcatcaacagttatgtggttaaaggaattgtgatacatatccaccctgaagtactgtgcagccataagaaagaatgaaatcatgttctttgcagccacctggatacagttggaggccattatcctaagcaaattaatgcaagaacagaaaaccaaataccacatattctcacttgtaaggaagagttaaacactgaagatgcacagacatacagatgggaacaatagatactgggaactactagataggggaaggagggtgggaatataggctgaaaaactacctataagtactatactcaacaccttggtgatgggattatatgtatcccaaagctcagcagcaagcaatatacccatgtaatgaccctgcacatatatcctctgaattcaaaaatttaaaaagggcacgatatttattatacaagtgtgacaaatgcatacaattgagttaaaatgagtgaaaatgaactacagcaatatgccacagcatggataactcttagaaacataaggttgagccaaaaaaagcatgtcccagaaaactaaatgggatgatatatattttataaatcttacaaattaacataattaaacgtgatgttgcttagggatgttcatgtatgattcatacatgttcatgtatgattaaagtataatttcgaaaaaagttaaaaatgaccacaacatggaggtgcttgttactggtagggtgaagtcagagcaaggagaggatgggatacaaatgaaacaaaatgtgagcagcatccttgtttagtggtaggcttattggtgctgattttaataaagcacttcacaatgtgtatgttacagacttatatattattatgaataaattgtattcttaaaatatagtaatagagaatatagaaaatttatatggcaagataaatggatgcaataaagagttaacgctagtattctaataaatatattatggcaatgaactgttttatatattttcatttttttaaataatcacatctcactcagatataatttgactgttatagttagaaaacataaccttaaaatgaatgaaatgaggttgctgattagtttatgtttttttttaattaccacaaaaatgtaggcagtggctgtggcaagggtctatattctatacattttagttcttctatctgtcctgctatatatatgtgacacttgtgatttttttctctaaaaatatcatttaaaaatacaactgaaaagcctttagtatttctgaaaacaaactgggtgactgtaaacttaattatatatatttttatgttgataaatttaattatttttctgtatgggttcagtatcttttaaataactttataacatcaaacttgaacatctatgaaggaaaagtcccctttttacatgattatttgatggcacaatatccttcagatgtatgtcacgttttaacagaaaataggtcatatacatgagatttttaagtggaccctgatataaatgtgaccacttttcttataccctttaacctttgtgacattttaatttatatttagtaaaatgactcaatgaaataattcaataaatttatctgattttatggttgcctggcttaagtcttcttattcatcactccaaaaatgctatagttgaaaaatgcaaataaatacaattaatgagctgtgctcgaacctatttatgttcacacttcagtctcttgaaatcctgtttttgatcttgaaacagatatcaatacttttgagattttattttctcacctgtatatataatataatataatatataatataatatatattatataaaatatatataatatataattataatatataatataatataatatatatattatatatataataatataatataataataaaaaatattaggaagaatatctgaaatgatgttatgagaattgtatatgaatagcctgacagagtatgtattcagagaatgttagtttttaacagatacagagtatatgtaccttccttcagaatatcaaatattaacacaactaaatgaatttgaagagttaatctaaaatgtcttatctaaacattttatttacgagctcatattaattatgtaaaaattttgttactaaaaacatttacatttatgagaacattaatatgctttctgtaagattatcaaatggtcacttcgattatgccattttactgatgagaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagtgcaatcaggcaggagaaggaaataaagggtattcaattaggaaaagaggaagtcaaattgtccctgtttgcagacgacatgattgtttatctagaaaaccccatcatctcagcccaaaatgtccttaagctgataagcaacttcagcaaagtctcaggatacaaaatcaatgtacaaaaatcacaagcattcttatacaacaacaacagacaaacagagagccaaatcatgagtgaactcccatccacaattgcttcaaagagaataaaatacctaggaatccaacttacaagggatgtgaaggacctcttcaaggagaactacaaaccactgctcaaggaaataaaagaggatacaaacaaatggaagaatattccatgctcatgggtaggaagaatcaatatcgtgaaaatggccatactacccaaggtaatttacagattcaatgccgtccccatcaagctaccaatgactttcttcacagaattggaaaaaactactttaaagttcatatggaaccaaaaaagagcccgcatcaccaagtcaatcataagccaaaagaacaaagctggaggcatcatgctacctgacttcaaactatactacaaggctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcacgacataggcatgggcaaggacttcatgtccaaaacaccaaaagcaatggcaacaaaagacaaaattgaaaaatgggatctaattaaactaaagagcttctgcacagcaaaagaaactaccatcagagtgaacaggcaacctacaaaatgggagaaaattttggcaacctactcatctgacaaagggctaatatcccagaatctacaatgaactcaaacaaatctacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagagataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcacaagaacaaaaaaccaaacaccgcatattctcactcataggtgggaattgaactatgagatcacatggacacaggaaggggaatatcacactctggggactgtggtggggtcgggggaggggggagggatagcattgggagatgtacctaatgctagatgacgagttagtgggtgcagcgcaccagcatggcacatgtatacatatgtaactaacctgcacaatgtgcacatgtaccctaaaacttaaagtataataaaaaaaaaaaaaaaagaaaatgtggcacatatacaccatggaatactatgcagccataaaaaatgatgagttcatgtcctttgtagggacatggatgaaattggaaatcatcattctcagtaaactatcgcaagaacaaaaaaccagacaccgcatattctcactcataggtgggaactgaacagtgagaacacatggacacaggaaggggaacatcatactctggggactgttgtggggttgggggaggggggagggatagcattgggagatatacctaatgatagatgatgagttagtgggtgcagcgcaccagcgtggcacatgtatacatatgtaactaatctgcacattgtacacatgtaccctaaaacttaaagtataataataataaataaatttttaaaaaaagagaaaatgaatgtttatggagcgtgagtttcactttactaaatattttattaaatatttttagtcaattacaacatcatgtgtagtttgcttttaggatatcagtgctgttttaccgaaagcaggctaatggaagtaaacctttccacagatttactacaaaagattgaataaatataatctaaggaacaaagtgtttaaacttgcttattgtcatcttttgtttgatcttttaaccccagttttaatggtttaatttagtctatttcttcactaaaagccacctcatttctttttggcaaaatgcctggtataaacaataaatagttgtgtatactctggaatccttgccttagtcagatttgaaagagccttttatgttgaccaaaagttttagaaatcctatctgtccttgagatctatgcaatcattaatttgaatgctccaaagtaagtaatgataactaaagagaataatcattaactgcctaagatgcatcaaaattttaattggctttttttctaattcacttgcatgcccaatgcccaatggcaatgcagtaagtcttttgtaaattaaagtattaggtagggggatactaaacacaatataatggtattttcaagtttgtatatagaaaaatgcatttctacactcagcttctgtttcctggggtatgtgttttatacaaggctatgactgaggtcatagttgaaccaacagtaagcaaagttcactttgtcacttggtgtgtctcattaatattatagataaataacaaaactctagtattgcttttcttatttattgagaaataataaataataactattattatagttgttaatatcacatatgtcatttcagcacacagctatacacgcaatcactctatgccattgagtcagacagtagagcctctgcgtttcccagatgttttattatataagagagagaatcagtacacaagggttggttccaactctgaagggagaaatctttatcgtcagctaattggattgagttatatcactctcaatgtaatctttaggaaaacttggagatagagacatgcgagacaatgtcatcaggtagagttaaatcactggagtgcactgacataaaataaaactaccctctggtcatttgtttctatgacctaaggcatttagatatttttggataattttcatggaaagtcattctctacctcaacattatgcctacaggaaaggaaacagattattgcatggcattaaaagaggcatcaagtatagtgaggaaagattttaattgtgagtattaggaagttctatgggacattgagggagcaaaggagagaagaaatactaaccatgtaagaaaataagtgtagtggctgctcaaaaacatttatggggatgctgccaacattttctgaaggagaaaaggtctacttgttatatgttaattataaagaaccaaaaagaaatggtctaacaattacacaagtgggaattcaagctacagatggtttattcactctaatttctgttccttaattatgtccattaggcttttgaattctatggttatgacaacaatccatcaagtttgtataataaatatgaattgtgacagaatgttacatattttaaatccctcaacgtatcaagaaaaaaaaatactgggtaaagaattgatatttaataaaggaatatataaagttcagataatttagccatggtaatgaaatatattctagaataatgaccaagaaggtataaaaatattatatatagtcacaaagtaaaaatccaaagagggagaagagtaatattactgtagaaatacagataaaaaataaggcctagccttttctggaaaaaacttagtttatcaagtaatacttttaagaatgtacttgaaacatgctttattataattgtgtccagaggcagccagctaggacacataatttattaagttgttatttctaggattccttaaaatgtacaccttaattcttcttcactttaatgcttaaatagaacaaaatgaacttagactccttcacatcttcaagaagaatcacagatctaaatataaagctaacactctaaaccttcagaagaaaatacaggatatctttccatctttggataagcaaatatttattgtactaccagaaagcactaacaaaatataatattaataatttggactttgttaaaattagaaaccttaactcatgcaaagataatgtaagaaaatgaaagagcaagtaacagattggaagaaaataattgcaatgcatgtatttgtcaaataaatgctataaagattgcaaagatccttataatttgatacatcaagactaagcaaacaacccaattaaaaaaatagacaaaatatttgaacaaactcttcataaataaatggttgataagcacatgctcaatattattaggcatcacaaaagtgcaaaataataccacaataaatgctgacaacctcaaatgtcaacaaaggtgtggagcatttagaattctcatacagtgatggtgaagtacaaaatgcgtacacagcttagaaaagctatttggcagttttttcttatgatattaaatctatatctacctaataaccaaacattttgactcatctcatttcacagaatgagagctttaaaaagttcattttacccatggctatagagtgtttctctattttacaactttatgtgtttttgcaatagactgcaatttttttaattctaagttctgtttcatacttggggaatttattctcaacatattacaaaattttgctattatttgcaatataatatattttgtgatttttcttaatgatgattgatgagatattgacatgtagcaacacattaatttttctttttagttctataaatatccagtaaatcatttaagtcttttttttttttttttttttttttttttgagatggagtctcgctccgtcacccaggctggagtgcagtggcgcgatctcggctcactgcaagctccgcctcccgggttcacgccattctcctgcctcagcctccccagtagctgggactacaggcgcccaacaccacgcccggctgattttttgtatttttagtaaagacgggctttcactgtgttagccaggatagtctcgatctcctaacctcgtgatccgcctgcctcggcctcccaaagtgctggcattacaggcgtgagccaccgcgccctgcccatttaagctttcttatgtatacagtcataaaatctgtaatgaattataatttggtatattgttcaatatttagaactcatatttctgtatctgtatcgttctattttgataattaattctttttaatgatgtgatagcttatacttcctttgtcttttattttaatggcatagaagttataattattgttttcaaccccgtataagtgaactttaccacctgtagaccctctttaaggagaagttaaagagagccacaaagtttatatatgcatctggatgttatttagtttaagaaattaagagatagtcttttatcaaccaacatattaaaatcagctttcaatttctttacggcagatgttttttgtttttttgttttcttttgttttgtttttagagacagggtctggctctgtcaccctggctggagtgcagtggtgcagtctctgctcactgcaacctccgcttcctgggttcaagcaatcctcccacctcagcctccagagtagctgggattacaggcacaggccaccacacccagctaatttttctgtattttttgtagagatggggtttcaccatgttgcccaggctggtctcaaactcccgagctccagccattggcctcccaaagttttttcttttttttaatgattttattataatttcaacttttatcttggattcagagagtatatgtgcaggtccattacatgggtatactgcatgatgccaagccctaggacgtgaatgatcctatcacccagatgtaagcatagtacatgacagtttttcagcctatgcttccttcgctccctccccacactattagtccccagtgtctattgttgccatctttatgtccatgagtacccaatgtttagctctcacttataagtgagaacatgtgatatttacttttttattatctgcctccgccttaagattttgtgttatgttaacacttacacttacatttgattttatctttacctatccatttgtttttaacatttctaatccatggacgtttatataactcaggaaagtgaagtttatgttgcagtcattactacaccatgactatgaccttgtgataattactccctgtttttaaatcacaactttggaaacaatttatttagaaataatatttatttatttacctatcaaaatatccaaaaaataagctttggatattgtgatagattttgtcagttgcctggccctcagtcttctccatgctgttttccacaactgaggttgaaaatgaaagctgtttttctagaatactgttgaccaagggatggtgatgtcaggctgttctggccaatgatataggagaagaatccttctaaggacttttgggaaagcttttgatttactgatgaactgtataataacaaacttcttgttatataagaaaaataaattttttgtttaagctacagtaagtcaggatttctgttacagccaaacatccaaagtgataggccatatcaaagtagcaatgaggagaccagagtaacatgtcaggagtcacactaaataaaagtttttgtactcaagtcttttaaaaaataactatactactacgttggttatttagaaataatcattctcttccactttgagaaaagattatcattccataatatttcatatgtattaaggttgtacatgttaaaaattaggaaaaggaatttaaaaatgagaatttataaaacatctagctcttgactttgtaacattaaaagaaatgaaatgaatctttaaataaatggataatatatatcatataaaaattttaaaattcttcacttatttgtgcagaaaaaacagctaagatttaacaagcaaccaagaagctgagaaatatttttgtcacaaaaaggaaatatttacatgtttaagaataaatgaattatgtaaatcatcaagaaaaatattgatacatagacaaaaaataaattacaggagaaaaccagcatggttatcaaacaagagaatatgttaaatatctataaaaatcagatatatgtaaataatcaaattaagaataaaagatgtaagtctgggaagactgagaggtaatgaagtatagttttctagttgtaataatattcattgatataagattctggaaagcatattagtaatataaagaatattatttgcttctgacctagacatcctgtttctaccaagaaccaatctaaaatatagaaaatatatattcataaggatgctaatacgtgaattaattataaaagaaaaaacaaaaatataatagaatgataattacataaattatatccacaggattaaatatttgcataaattaatgcttacataaaatgattaaatatacttaacaaattcaataaattaatgtttacaaagattctaatcacacattagacatgtacattataatgtagagagattattaaggacatacaatatcatatatggaatgatcctgggtaaatatatctgtctctgcctcattaaataataggtgattttttacttgttggtataagtttattattcggaaaatataatattaatgtaaaataaacaaggcttagaataacctttatgcttccagcaatgttgccttaaatgcatcagcacttgttctaagataaaattatgattaagaaagaaattatctaacggtgctttgccaatatcaattctcttttaataaaaaataacttacagaaaaacaagtaatatcattaatcattggaggcttagagtacagtttttaaaatatgaaattctgattatgaatcccagtgtgtttatttatacaagcaagaatgacaagacccacaaaccattttttttcctacattattgcaagacaagtgtaagaagccatttttaaaaaatctattggagctcatgaaaagtaaaaaaaataaatatcaatttctggaagaaagagaacagcaaacacaccataaggacatgcattaagtgagaatatgatccaatatgagagaaacaaaacccaagaaaacagtgagtcaaacagccagacgcaaatatgaatcaaactctgccagcagcagtttcgacttctaatcaaacagcagattttgtatataaacacagtctggaacgggctgtaggttacatactaatttttttctttccagtcttgctaactaaagtcagctataacattaactacagtacttcttgaagcacaaaaaccaataaatgtgttaaatgtttacagtgagcaaaacattagactctaaagactatattataacatagactacatgttagaatatagtcttgtcattttgcttgtataaatagagtacatgtatgaatatagtctataaaataaataggaaaaataaatttgtagcttacctttcggtttatatttgtatatattacacctgtttgaaaatataccttttattattatttctcttactaaatttgatccaatactgctaagaaaaaatagatttttatttatatatcaatacataaactttggagattgtgtctaactacatagaattatatatattgaagagcttcagatctaaactaaacaaatctgaattgtaatgatagttctgccttttgccactttcaaaaattttactcgggcaatcaattcaagcctcattttatcagttgtaaaatgatgatgataatagtaattattttacattgtttggatacaggagaagttaaataccataatgaacacaaaatacatagcacagtgacaggtgcagaggaatcattcaataaatgttaagggttagagtcactgagctttcattatattgtattccccataaaatctctgtgaattaagtgctattattcccaatttacagattaggaaagaaagaatgagaacaataaatttattttcctaacttcgcaattttttaacttcccagaggccacagttgtttagaaaagcaggaaagaggaaaaataaaaatgtgttttctcattttcaaggcaatctagagagaataggtacatgtacaagcattactatcagggaattgatactttgaaactaacaggtaatattgaaagaagtatttttatatatttaggaaaattatatcccacagattgccagtgtaaaaaattgtacttccacttataggtattatttgcattaacaaaagacaccagcttttaatgacagtggcaatgatgatcaaacagcagtcagacgtgcgtaccataatgtatatttataaaatagatgattattgtatgagttacaatgtaaaagtttatgtatgagtttacaatgtaaaaggaaaaagaaatcagatttactcggtaaacgagtatagaggaaaaaaagaaagaaaaatagaatcttagctgtaatcaacctagtaaccttgtttttgcacaacaaagtttgtgaaataactcaggcatttttaagtgtcatctgactggaagcagttcgatgtgctctaataggattttgtagacatgcagcaggttcatacacattttctcgtaatacctgcagaacagtataatgagatggctagaaccggccttactaccatctctcagtttaaacagaggtagcgtagattgctcaaaaagctggtgagcaacaaacctaacatcctaatgtaataaatctcatctccagatccaccattttccccactacattatgtttttcattgccaaaacttgaggaaaataaacactaattctttcttttttcttttttttttgagacggagtcttgctctgtcacccaggctggagtgcagtggcgcgatcttggctcgctgcaagctccgcctcccgggttcacgccattctcctgcctcagcctcccaagtagctgggtctacaggcgcccgccccgacacccggctaattttttgtatttttagtagagacggggtttcactaaaacactaaatttttacttaaaattgaaaaaatataaatgcaaaggaatatggaagactgatgaaactgtaaaaagttagcactgataatctgcttcttgtacattaggaaggcaagaacatgttatcaactattagaaagtaacaccatcagagaatcataactcaaacatagccaagtatgtaaagagtctttaattcctacatgttaccttcttagactattttaaattacaagtttaaaaaagcttatggcacttaaagaaaagtatacaaacactggcataaatctaggactaaataaaatgtgcaattcttggaatgttgaattttttagttgaattatagttgatttacaactaaaataagtttctggtaagacctcaaaaatacttctaattttacataacctctttgccaagagaaaattctgaagaaccagaagaactaccttaaaaatagtcagggtgctagttaatttttacatctgtttaatcaataagcttcaaaaaacactttcatttatagaggcaaaaatataaatgaccccatttttgacatgaaagtatgtagttttcagatatttagattttataaactacacacattatcagaaattaatttattctactattcatgaatgctgacttaaggtgtttttgcatagtgttgtatattaaaattggacatattatcactgaaatataccttatatagtatgttttactttatcaaaagttatatccataatgaatgaaaccttgagataatcatttttaaaaacaaaatacctttagccactataaagagatcaccactcaatatatattcacctttgtgagacatagtattaatgtactagcaatatgacatcagagacaccaagctaatttgttcatgggatgatatattttcaaataaataataattagatggtgaatacaactttattataattgcatcacaaatgttaagcatcttttgtaaaataaactacttttacccaggaaatattttctctccagtcttccattcaaaacacactaaccttgtcctaaagtttgtaggatgaggatgtccatcatataatgataagtagtcgtattcttcttctagagcaaatgactgaaaaacaatttgtattctatttcgttcttctgctattattacccatgtgcagtttgcaccatttggatatccatatggaaaaccagggctttctatagtgccattaagtccttttaaagttccaccacatgtataaataaatcctgcaacaaaagacaataaacagacattaatattatataaatcaagaacaatccatgagataatattattttgaaagtctattgcatttccaagaccaaagttaacaataattttataaatggcagtttaagagctgggcactatatacaaatatatatgtaaaatataagaaacaaaataatagaagatttatcatttataatacatactgaggtaaataattataaagcagttgatgaaataaaattatccacatacatctgattcattatccattacaggttcctatagacaaacacaatcctagaacacggtatctttcttcaaagagttttaaatctcattgtgggagctcataaacaacactgacattttaaagatctttgtatgcattttgggtcccaaagaattaactccatttttcttggcaacacatgctagcttttttgacatattcagatctctaccctgtagctcacatgctttaggaaaatctgtctcaccctgattatagaagaggaattttttaaagtctatgaaatggctctacctttcattaaaatatttagtccatgatgaacagaattctaaattaaccacatcagagtgaatccgaaggtcaggacaaaaatacgttaaataaatggatcttggacaactgacagcacccatcttaagaacttctgtatttgttccatggaaagtctaagttactgagagcatgagttctggagatacctagaaaacttactatatttcttcagcaatttgtctcttcaaatatatatatatatcaggtatatatattaaatatatatctcaaatatatcacaaatatatatcaaatgtatattaaatatatatatcaaatgtatattaaacatatatatcaaatgtatattaaatatatatcaaatatatatattaaatatatatttttttgagacagaattttgctctgtcacccaggctgtagtgcagtggcgagatctcagctcactgcaacctctgcctcctgggttcaagtgattctccagcctcaacctcccaagtagctggaattacagacatgcaccaccacgcccggctaatttttgtatttgtagttgagacggggtttcaccatgctggccaggctgctctcgaactcctgacctcaggtgatccacccacctcagtttcccgaagtgctgagattacaggcgtgagccaccatgcctggcctcttcaaatatataatattctgtagcatattgtgtaatgtaaaaacctaagattaatacaaccgtaagagaagatggtcccagtctttatgtaggctacatgctaataaaacttgcatttagaggcggttaaacaggatcagaagttctcatgagaaactcttcacccagatgttattatctttatctgtgagtcctacaggaagctgaagtgccagaagctgtaaatcagagttatcaagctaatctgagggagagaagtcgatactaccaaaagcatctatgtttggaactggcatagaaatgcaggaaatttggggctcctctctttgagaagaaatgaatatattttatgtaagtatggatactttttaaaagtaagaggaatgctgaatagaagtcctcagaagccagagttgtagattatggcagatagtggctgatttgggatgttgtacatttattccacattcttttcacaatagcaccttgtttttgccagggaagccacttctctatcaaacagctatatacttttttttttttttttgagacggaatcttgctctgttgcccaggctatagtgtagtggcgtgatctcggctcactgcaacctccccctcctgggttcaagtgattctcctgcctcagcctcctgagtagctgggattacagacatacgccaccacgcccagctaatttttgtacttttagtagagatggggtttcaccatgttggcaaggctgatttcgaactactgacctaaagtaaaccacccacctcagcctccaaaaatgctggattacaggagtgagccactggccaggccaaaacagctacatactttggagcagctgactctgctgactccagtgatgagaaatgtggctcagggcttggttgaccaatataatcctatcctctgagcaaaatttactacagggatcttttcctatatctcaccatatggcaaagtcttaagcctgggatatttggtatgtttatgtgctataaagcatagttcttgttatcattttgcctctttgaaaattgaccaggaagttggatcaggtagaagaggtttaaaaaaaatcaatatttgtgtatattcagataattttgctcatgcaccaaaagtcaaatagggcattttatgattttcaaaaataaataaataaataaaaggtctctttttaaattgcttcttgcagagcaattactttgaagccttaggttaattagctatcacccatttctattagttttctgcctgaacagcttccaatttgaacttcataactaaaggcaagcatgaatcccttcagctacaatctgatctacgggctgttttatatactctcaagccccataaccctgatagttttagaaaaaggacatatgtcttaaaataacatgctcagctttgtccactcattcttcaagggcctgctgattcatggatttcgagtacttttatttttagacaaattaggaattacacctatatttaaacttccttatctgtattcttctttttacttttgtttttgtttatcacaaagttacattaaacatagcattattctctagaataaagtacattttttccagaaaggagttttaaatattttactttaaaaatttgaaaatcagaagtaagcattataaagcaaaatatcctccctcattcatttatgcttcacagggttggtcatttttaatagcgcagtgtttttcttactaggcctttcctaggcacaagcagatatccattctatattatttttcaagtgatgtcagtcatattatgcctatttttctgaattgttatatctattttaaaaaaatcactggcattcttctgggtacagatgtagacttctactacattcttctttgaaagactttatagctacacagcatatagtacgcctatagtataatttattttaccattctcctaatgataacttcatttttatggttataacggtctaatgagcaactgtgtaaaaacaactctgtacatatatccttgtacaaagtatatatcttttgtgtacaaagggcatatatccttgtgcacttgcttgatacctcccaagatggaatcccagaaatggggttgcagaaaatttatacagatacagtgaaaccatacttaataaatatgaaaatttatgtttctggcaccactgtatgaagtgtttttcaccctcaatcctaattctggcaacattagatatttttgaaaggcaaattttgtttttcatttttgctttttaagaaattttatcatgtttatttgaaatttgcaacttgatgctgtggaacacatacagagagtaaagtggttaccatagtgaaatagattactgtagctatcatctcacatagttacttttttgtttgacaagagtagctaaaatatacttatttaacaaaaatccttactacaatacaatttcattaactgtagtcctaatgttgtacatcaggcctctaaacttgttcatcctacatacctgctatatgacctacagctccccactttctcttccccttactcctgctcacccatggaaatcactgtttcattgcctatgcgtgtgtacttaagctttttaaaaaaaatatattccacatataggtgatatcttccaatacttttatttttgtgcctggcttatttcacttagcataatgtcctctaagtccatccaggttgtagcacatggtgggatttcctcttttaaggctgaataagatgtgtgtgtgtgtgtgtgtgtgtgtgtgtgtgtgtgtaaaatatattccattgtgtatatataaaaagggatctatatcccctttttaaggctgaataagattccattttgtgtgtgagtatgtatatatacacatttcattttctttatcaatttatctctcaacgtgtatctaggttgtttccacattttgactattatgaataatgctgcaaaaaacatgggagtgcagatatttttacatggtggttcttgtatctcattttggtatatacctggaagaggagttgctgggtcatatagtggttctatgaatataatatttttaatttatttaggaacctccatacagttttttcgtaatggctgtactaatctacattcccgccaatagtgtactagggtttccttttctccacatccctgacaacaattgttatctcgtctttttgataataatcatacttacgggagtaaggcaatatcttatagtggtttaaatttgcatttctttaaagattaattatgttgagcatcttttcatatacctttttgccattttatagcttctttggagaaatgtctgttcaggtcttttgcccatttttaaaatcaggttattgttttttctgctattgagttataagaattctttataattctggatatattaaccccttaacaaaaatgtagtttgaaaatatttttaatagcccataaattgcctattattttgttgattgtttcctttattgttcctaaggtttttagtttaatgctgttctgtttatttacttttgtttttgtagtttgagctttttggagtggtatcaaaattaattgccaaagccaatgtcaagaagctaaaaggcaaattttgcaaggcaaaaaaaagttatcatactattttcttttgcatttctctgataacaagtagttactcttgtaattgctattgtaattttgctgattactgttgagattactattgtgattcacttggaatctatatttgcctttgtaaatacatttctaagtgaaacaactttggttattcttgctcattgttctcataaatctacaattccttattgttctttatagtacatgtggaacatcacctcctttttctcttgtctcctctgatgattgttttcctatattctttcatctattcatcacatatttcatgccttacaggtaaaatgatataaagaacattgtccaagctcatcttctgggagctgacaatctaaaacatgagatagcaggacatttaggccattgctacaaaatacagaaagtattatgatttgggtgtgcacactttgctatgagaacacatagaagtaaaactaaatatagattaagtcagtatgatgtatatggaaaactcccctcaaaaactggcattgcaactttttcatagattcgtgttttacaatttctaaatgccttatattatgtttttcagaccttatcttttaatgtgcacttaaaattaacagtgtacttacagttgaaaggtaactaaattttatatgacttaggtctcactgtcatcaagagtttgattaacaatattgatttcaaaaaacatcatgcccatatttcacctttactattcagcaagaaataatgcaatgactatatgtatagtagtttaatgatgttttaatttttttgagcgtgctaaggtttctgacaaacaacattcacacttgtgtttactttctccagccatcttcacaaaacactgcaactgagcttctgtgaccaattatgttgacatgactcttgcaaaaattactcatgacctttccattttcaaaatcagttcttttttaaaaaattgttcttgtcatctttgtgcatttgttacggctaatcgttgttctttcttggaaatcttttcttattgtttccatgatgatgccctgcttttctaatctcatgaacttctcctaaaaccactcctttactaaatttctgtcttcatctgtcttctctattttgcaggcttcttagcaaccacagatatagctgtaagcaatactggtgaccataaaagaggcatatcttcatttatctgtttccaccctttgctatatatctccgtgtagatgtagcataccatgtagaaactagtcatccatgtcctttgcttatcctcaaatctcattagttcattctattaactgtctcttaaatctatctctagtcccctctttgtttttctattctaaaccctgtggatttgattcaattcttcctcatctcctgcatcctatcctattttaagagcaaccagtctatcctgctaggctttctgcatttgcccatctactcaggtccccacattgctgctaaagtcatttctacaacaaacaaacccaatcttgtcacttccttattcaatagtattattcagctacttcttattgtcaatataaggttcatacttctctccatgtatcttatataatagctaactgatttttgtttttatattgctgagccatattccatctttaattttggagtgctaaactggattcttaaatttcttgaagctgacctaggaatagttctttgaagtttactaacaacttcttcttctagacagaggaaggagtggggcacacatatacacctgctcatcaaagtcctcaaaatgttcacttactagatattaaggtaaagtgtcacttgtcatttatcttttgcttttctttattgatacttctgtttctaatatttattatttacaatgtaattttttatgaatgtttttcctaagtctttcaaaaatttgcctttatgccattgtggtttgagcaaaacctggcattcagtagaaattcagtaagcactttttgactgaataaatactttcctctaccatttctttgcccataccaaatgactctccaaacttccacattgaggaaactcagagacaaatagggttagtattataattttgggtaaatttttggataacagatttttgtaaagatttggggtgaatgcatttaacttgtaaatttcacattgattgaaatgaaaagctacatactcataagaagaacttataatactcactgaggaacaatatttctttgcataatcccaaaagctttaaaattgcagtattttacataaaaatttggaaatattatctcctcagagaggcctttgttttaaattttttaatataaacacaacaaatatacaaaatgtgcaccaaattaatgtacatacatgaaaaatttaataattacaaactgaaaacctatgttaccagtaggtatatccaaaactaacactattacaactctttatgatgccttcattagttttaatcacaatatctttcattactcatcaaagtaaccattatcgcctcagatttgtgtaattttctaaacttttactcataaatttattatatatgtatgcatttctatcctcaagtcatgatgaaattatcctatcttctcatgttgtactggtttacttatcacatgcacattaggaacacataatttttggtgatgggagagatggatagagattaatttattttctatttagatatccaaatcacccagagccatttataaaaaaagacacactttttgacccatacttcagtttgtcataaattaaacatgggtattcgtgtaggcctgttttgagatgttctgttccattagtttataccacactatcttaacttgtttcataagaagcatcattctttttcttcaaaactgctccagcttttttaaagcttagcatttacatatgtattttagaatcaatttacaaaataaactgctaaaattttgattgggattattttgattctatagataaattggggagagctaacattttgccatattgacattttcaatgttatgaaaatattattatgaaaaccttcatttatactggcttttttttatttttgagatagagtctcgctttgtgcccagactggagtgcagtggtgtgatctcaactcactgcaacctccacttcccgggttcaagcgattgtcgtgtctcagcctcctgagtagctgggattacaggtgcccgccaccatgcccggctaatttttgtattttaagtagagacaaggtttcactatgctggccaggctggtctcaaactcctgacctcaagtgttcttcacccacctcagcctcccaaagtgcttggattacaggcgtgagccaccacacccagctcctggctggcttacttttttaatttagatgagtgcttttgaccatcttaccccatttcagtaactattactttaccctcattcgctttttgaagccctaatcactgtctgaaattattagtttactcgtctgttttcaatgtttttcccataagaatgtaagtttcatgagatttgaggccttgcctgtattattgttatatcctcaaggcttagtataattcactgtagacattgaacactcttcattaaaaagaatgaatagataaacagtaaaataaaataaccaaacggctcaaattactcaattgttattcaaactattattattttactagtggccaacaaaattacctactggattatccaataatataaactcctcaatatatttgcagctccaaatttgttcaaggctcaacctgatcctgttagaatcaagtttaacgtgtgttttgattaactgaaggaccctagcagatattttgccctataagatttcaaaatgacctcatttgcattattcataaattaacaacatgaatgtacttataaaaagtatctttttcactaaaccaaaaacacttttcagggtcaagagaaatagtgggtaaaacaacataaattttattcacatgttctttcataaatgtttatatatcaaattatttgggctactcacattttagcagtaaaagaaaaacctaagcactgaatgttaatttaatttctattgaatgcttgtttttgtcactagaaaataaatataaaaggtacatttttatattgtaaaattatgtatgttcctccaaaagtttctccagtaacctttcttcttttgatcactaaccaatatttctattgtgttttatcaatacatgaatgaatgaatacaatactttacagttaataagaaggaatcagtctttgacatggtttggctgtgtccccacccaaatctcatcttgaacttgagagagatgatttaggatatctggtggaagaaatttctaagcagcaaagcattcaagaggtgacttgggtgttgttaaaggcattcagaaggggagcagaccataaaagttcaaaaaatttgcagcctgacaatgtgataaaaaggaaaaaccattttctgaggagaaattcaagctggctgcagaaatttgcataagttacgtggaaagaatgtgaatcctcaacatagtggggaaaaggtctccagggcatgttggaagacttcacggcagcccctcccattacaggccttaagacctaggagaaaatggtttcatgggctaggcctagggtctctgggctgtgtgcagcctacggacttagtgctctgtgtcccagctgctccagccatgactgaaaggggacaacgtagacctcggtgcatggcttcagagaatggaagctccaagccttggcagcttccatgtggtgttgagcctgagagtgcacagaagtaaagaactggggtttgggaacctccacctagaattcagaagatgtatgataacacctggctgcccagccagaagttttctgcatgggcagggtcttcacggagaacctctgttagggtagtgcggataagaaatgtggtgtcggagtccccacacagcgctcctactggggcaccacctactggagctgtgagagagggccaccatcctccagaccacagaatggtagatccactgaaagattgcactgttcccctggaaaagccacagacactcaataccagcccatgaaagcagccaggaggtaggttgtaccctgcaaagccacaggggtggagctgcccaagaccatgagaacccacctcttgcatcagcatgactcagatgggagacatggagtcaaaggagatcattttggaactttaagatgtgactgccctgctggattttgaacttgcatggggcctgcagcccctttgcttctgccaattcctcccatttggaacagctgtatttacccaaagcctgtacccccattgtatctaggaagtaactaacttgcttttgattttacaagctcacagatggaaaggacttgccttgtgtcagatgagactttggactacggacttctgagttaatgctgaaatgacttaagactttgggagactgctgggaaggcacgattggttttgaaatatgaggacatgatatttgggaggggccaggggcagaaaaatatgatttggctgtgtccccacccaaatctcatcttgaattcccacatgttgtgggaggtacccagtgagagataattgaatcatggggacccatgctgttctcatgatagtgaatacatctcagaagaactaatggtattatatgaggcagtttatctgcataaactctcttctctttgcctgctgccatccatgtaagatgtgactttctcctccttgccttccaccatgattgtgaggcctccccagccatgtgaaactgtagttcattaaagctctttcttttgtaaattgttgagtctcgggtatgtctttatcagcaggatgaaaacagactaatacagccttacactcaagtttctcagtctattcctcatcccgtaattccccactgatgaaaagagttgtatggtagaaaagagttctatatgcagtcattgtagaaaaagtattggaatgcagtgccacaagagtttgtttaggcaaactcacctgctctctcctaaaagggtctctcagtcacagaaagtttcctaagtgaatgtgtcataattccaatgtagatcttagcctcagattatgagaaaatggaataagtgacagagagtgaggtgtctgtccatcagggtagacttacaataaataaactcacagagtgtgagatgaaaaactacagtgccaatatttcttcctaacatatttctctatatagcaaatccaaataagaagacatcttaaattataagatatttataactaatttagaaaaaagaagtaaaaacacctattttaaataagagggattatgtgtatatttcaaatgtttcataacatctaacttagctagtttttcatggttatctccagaatgcagtggtatttgccctatgggatataattacaatgagcaatgctaatgttcacatcttagactccacattttacggttcaataagtgaaaaagcccccttgtttctgacagtctttctttgaacatgttgatagagttcagttgattacaaatcttgctagaccagatgccatcttgtctttttaaagtgaccatgttgttatattaattatattaagatcccattatttctagttttttttcctgatgatcctcactataacatctacaataataataacatagttttttttttaaatcagggtaactgatttgtctacaaattaaacaacaagaagcaacagcaaaagctgcctccagaatattcatttattctaatatttctattgtcaaggaacatatattattttattaaatctctacaataagcttgtgaagtacatattagtacgctctacattttaaagatgaagaaatgtgtaagtgttttatctataaaacttattagtgtatgtctcctcatttggatctctgaattattaactaatacaaattatctgctactattaagtaaactgtatttcagacatttatgccactgtgtccttctgattttattttcttattttcacacaaaattaattctatacagttcagttaattttataaagtttataacccattccaaattcataagaatgacattttaagcttaaaccttttgatatttgagtcaatttagtcttatatattataggaaaaatctaggaatcactcaataaaaagatggcattaacggtagaaatacaaattaactcagaaagtaaaaattatttctttaggttgtacctaagtttgaaagtttgagaaagaatataatgaattatgtcaaacataattggatagctttaagaagtctaagtcccagctggatttcccactgccacccaagagcttatataaaatactactgacttttaaaaactaaagtatttcaaattagagagtagtatttttctgtgattttctttatttttaattgggcagctgacatcctgctgttatgagggctatattaattacactttctcattttatgagaatatatgcggaataggaaaattagtgataacatattactttttgaataaaatgacttgtatttggtggtacttctggaatggcagaggggaggcctccatatagagtctcatacattaaaagcaacaaatatactggcaaaaatggtcaaaatctattttttccagagctatgggatttatcccaaatctggaattaatataaggggtgtttttttcaagaaaaactgctgaaccttactaataatggcatggaatatagcactgtaactcaactgctcccactcccctcttcccagtaggaaccttcaaaatcagcagcctcccatccctggtagctgtgcaaaacagcctcccagcaatcagggggaacagaccagatttggtgctcctcaacgcattcctttccccttgcccagaagactgtcgctatttaacctatcttgcattcccctggaaaactcaatttgcacatgttgctgttatttggcctgacatggagatttctccatggttagagccctatccccagctcatttgtttaaaaaaaaaaaaaagttgaaacaattgtttaacattgcaactgcctgaagcttctgtgtaaattggaacaagagcctggtcaaaacataaaaggaaggtctggggaaagacgtgctcacagggggctttgaaaagctctaccatattcacaaggttatgtgcatgtacaggcctgtgtgaatgctaagctgagagagaaccagtctctcacttacggatgacctgagatcctgcctaaaaaataagtgaaagctaagacaaacttgtaaattgttataatgttgaagttgtgcccaaacacacacacagacacacacagacacacacagacacacacacacacacacacaccagagagaaaaccttttgggataagatgaaagatggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaatccgggaggcggagcttgcagtgagccgagatcccgccactgcactccagcctgggcgacagagcgagactccgtctcaaaaaaaaaaaaaaaaaagatgaaagatgtattgatttgcttatgacatttgaggaaatatctgacctataatttgctaactgagcagaagctaggatagccatgcactagaaagaatacagactttacagaattaacctgggaaagtcactaagtgaacaaatatcaaaacaatgaaaaacaggtacaggcagcaaaacctggaagggtgagaatatgatttccactgatggtacattctagtatttaaaataccatgttttcttttctttctttctttctttccttccttcttttcttttttttttttttttttttttttgatacagggtcttactgtcacccaggctggagtacagtggcgtgataacgactcatggcagcctcaaccttcccaggctcaagccatcctcccatttcagcctcccaagtaccagggactccaggcgtgctccaccatgcacagctaatttttgtatttttttgtagggatggaatttcatcatgttgcccaggctaggctcaaattcctggactcaactgatccgtccacctcagcctcccaaaatgctgggattacagctgcgagccaccacttcctgcactaaaatatcatgttttcaacaaaaattatgacacattttaagaaactggaaagtatggctcattttaaaaataagtggttagaaactattttcgaagttcagaaattggacatatatgacaaagattttaagttagctactacaagtatgtttaaagaatgaaaataaataaataaataaataaataaataaggaattaactgaaaatgtacaaataatgtctcaccaaataaataacactattaatgagaaattagcttaaaataaccagatggaaattctgcagttgaaaagttaaacaattgaaaaaagaaaaattcactaaaggaattaagcaagaaatttgaagttcatgaagaagaatcagtaaacttgaagataattcaatgagattatcctctctagggaacataaacagaaaataatgaacatgaataagcaaagcctcagaggcttttgggacaatattacacataccaagatctgcataattgaagtcccagagaagatgcaagaggtgaggacagcaaggatatttgggtgggaaaaaagtcgtcaaatactttcaaatatgatttcaaaatattaatctacacatccaggaaaaataacatatagagatccacacccagacacatcacagtgaaactgttgaaagacaaagtgagaatcttgaaagcagcaaagagaaaaaataaatcaagcatataaaagattaacaatgattaaggccaaaagttgtagaattacatgtttaaaggaatgaaacaagagaacgttaacaagaaaatctataaccaaaaaggctctcaaaaatgaaggagaaataatgacatttgaaaaaaataaaaactgctaaaatgcatcactatctgaactgtcttacaagaaaaattaaaatgagtcctttgggctgaaatggaaaagcatgatgcagcaattcaaatccacataaataaagagtaccagtaaagcagctacctaggtgaacatgaagagaaccaaaaatgtacattttaactgttttattttcctatataatttttaaactgcaaaaacagtaattataagacatttctgaatagtttacaacgtataaatataacatttaataataaaatgctactataaaaatgaggagggaatgaaagcacattgctgcaaatattctgtctgttttggaaattaagttagtattaatctgaactagaatgttgaagtaagaagctaattgtaatccacagcattacaaataagaaaatatctcaaaaatatattaaaagagacaacagaggaattaaaattgtacactagaaagtatttaacaaaaaaaatgaggcagtaatgaaaggaaagaacaaatatataaggcgtacagcaaacaaatagcaaaatgacaagaataagttctgccttgtcagtaataacatcaaatataaatggaataaacactccaattaaataacaggtattgctagatggatgaaaattattattcaagagacatattttaggtacagaggcacaaaacaaatgaaagtaaaataaaaggatggcaaaatatataatatggaagcagttatgaaaattgagctggagtggctaacctcatatcataccaaatagacaacataaaaattgttacagaggtaaatgaatacttttatagtcatatagtagtccatattaataaaaaaatatgaaaatatttgtacctaacagattctcaaaatacatggaaaaaatggcagaattgaagggataagtatatacttcaaaaataatagttggagtctttaattctctgctttcagtaatggatataacaacaaagcagcatatcagcaaagatataaaatactcgagcaagaccagaagccaactaagcctcactaacatctatagaacactgcacccaacaaagaccatataaatgaaatagaaaatacaaagacaacagaaaaaagttctcaaaaccaaatgttgattctttgaaaagatcagcaaattgacaaaactttatatagactaaccaagaacaaaaagagagaagacaggttactaaaatcaagaataatagagagcacataactaccagccttaacgaaataagggttataaggaattctatgaattaaaaagttagattattcaaatgaaatgaacaaattcctagaatgacccaaaccataaactgaagaagaattataaaatatgaatagaactacaataagagattgaatgtgtgactaaaaaaaaaaattgtaaaaagaaaatcctaggcccaaaaagcttcattggtgagttttactaaacacataaaaaattaataccaacttttcacaaactctttcacaaaataaaagaggaagaaacatttcccaactaattttaaagaccatcttgctctgatatcaaaaaacaaagacaatgcgagataaaaattccacagaccaatattccttatgaatattgataaaaatatccttgatgaaatactagaaaagtgaattcagcaaaataaaaaaataatcacacataataaccaaatgagatttacccaggaatgcaaagctaaacctaacattctgaaatcaattaatgtaaaaacatataaacggaataaaggacaaaatccactaagtatcccaatagaaaaagaatatatattttacaaaattcaacatgctttttatagtaaaaccactcaataaactaaaaatagaatggaacaccttcaacctgataaagaacagctatgttaaactgacgaccaccatcaaatttaatggtgaaagatagggcttttcctctaagctcaggaacagaacgaggatattcattcttgccacttgtatttaaccttatacttgaggttctagccagagaaattagataagaaaaaaataaataaaatgcaaccatacagcaaagaaagaaatacaaatatttgctgacggcaggatcttatatagacatacctcagagatattgtgggttcaattccaaaccacagtaataaagtaaatattgcaacaaagtgagtcatgaacattttggttttccagtgcatataaaagttaaatttacactatactataatctattaagtgtgcaatagcatttagtctaaaaaacgtgcatgccttaattaaaaaaatactttactgctataaaaatgctaataatgtaagcatatactgttgggaaaatggtgcctatccaatttgtccatacagcattaccacaaaacttcaattggttaaaaaaaaaaaaaaaagatatcttcaaagcacaataaagcagaacataataaaatgaggtatccctgtatatagaaaaccctaaaaaacacactaaaaactgttagaatgaaaaacaaattcagcaaggttgcaagctaaatatcagtgaacaaaaaatcactgtatttttatattttagcaatgcacaatccaacaaataaaattagagaataaattcattcacaatagtgcaaagaagaatatttgtgcatatatttaacgagagaagcaagacttttatactaaatactacaaaaattgttgaaagacatgaaagaatatgtaaataaatgatagatatcctttttttcatcaattagaaggcaacattttcaagaggcaaatacactccagactgatgcacttattcaagcagtaccttgcaaaatcgaatgtggctatttttaattgctaaaattgacaagttgatgccaaaaatttatattaacatatatgatgcaagggaaccaaaacagccaaaacaatttggaaaaaaaattagatgatacctacttcctaatttaaagtgtatttcaaagctacagtaattacatagcatggtactggtggcataaagatggacataagattaattgaataaaattgagtccataaatatagttttacatatatagacatttgatttgagtgtgggggagtcaagaggggaactgagcaaatttattgttttcttctttttaaaaatcttattttgagataagcataaattcacattcaagtatttaaaaaaacactttcatccattttctaattggatcattaaattttttaactgctaaatttgaaaggttgtatatattctagatgcaggtactcttctccagtttgtgatttccaaatattatctgatactcaatagctgttcttttcatattcttcatagggtgtatgacatagcaaaagtttttaatattgatgaatttcatgtcatcactttgtcctgttatggatcctgctttgctataaagactaattattgttcacctattcttagattttaaacattttttgtatctatttttctaaaagtgtaatagttttatgtttcacatttaagttgtgatctgtttatttaatttttgattatgtatcagacttaggtcaacattaattttgctttcctgtgcatgtccaaatgatccagcactatttagtaaaaaatctacatttccgtaaatgaaatgcttttatacctttctcaaaattagtttggcatacttgtttgagtctatctttgaggttctctattgtgttccaatgatctatgtttctacctctttgctaatgccaaagtcttgattattgtaactacataataagctttgaaatcaaccatactaaatcttcccacagtattattcatttttcaaaattatttattctagttcctttgtagtttgaaataaaatttaaaataatgttgtctacgtctacaaaaagtcttgttgaaatattgtcaagaatggcattaaatttataagtaaatttggggataattgctgtttcactacaagagactttcagtccatgagctcagcatgtctctccatttatatagatccccatcttgaacttcttctactagctttgtatagttttcaggatagaagtcctagacatgacttgttaaatttaatcctaagtattttatattttcttaatgagtgtaaatgataatttagatgtctacatgttcactgctactatacaaaaattacgatttttaactgatatttgctttgtatctgtaacccagttgaactcacttatgtagagtagtctttctgtacatctataaaattttctactttctgtcttaatcatctgtattattttatattattttagattcagggggtacatgtactgtatagccacttacaatatctgcaactagggatagtttaagttttttttttttttttttcatttccagcctgtgtacctgttacatatttccttgtattgggatgatatacttattttgtataatctcttaatatggtggatgacattggttgattctggaatatagaactatccttgcatttttgcaataggcccacttggtcatgttataattatttttcatatattgttgagttctacttgctgatattttgcttagggatttatactctctagaagtactgatcttcagctttcttttatgtactggatttatatggttttgatatcaggacagtgatacctgcttcatgaaatgaattgggaaatttccttgctattgtttctagaataagaatgctagttattttgaaacatttgatagaattatccagcgaaaccatctgggtcaggagatttctcttttctttgcacttttgtaattgtgaattctattttcttaatagttatagggctatttgcaatatttatttcatatcagaggaattggcatatttttttcttttaaggaatcggtgcattttgtcttaagttgtccaattgatgtgtatagaattattaatagtgtgcctttcattatgtttttaaagtctgtaggaactgtagtgatatctctccttttagtcctaatattggccatacggtttggatctatgtcctcaccaaatcaaattatatccccaatgttggaggtggggcctgatgggaggtgattgaatcatatgagtggtttttcatggtttaacaccatcccccttgatactgtcctagcgatagtgagtgaattctcaagagatctgattgtttaaaagtgcatagcacgccacctccaccctggctcctgctcctaccatgtaaaatatcttgctcctccattaccttccaccatgattttaagtttcctgaggcctcccagaagctgatgctgccgtactttctttcttgtacagtctacagaatcatgagccaattaaaacttttttctttataattacccagtctcgggtatttctttatagcagtgcaagaacaaactaatacaatggtaatctgtgtcatcttttttctttgtcagctttaccagcagtatgtcaattttacctatcttttcaaagaagcaaattttgtttcaataatatttctctattattttctctattttgttgttttgttttcagatgttcagctctttttctatatttactactccttgctctggatttagctctcctcctccttctttttttttttttttttttttttttgggtatttacatgaaaccttagattgttcctttgatacttgaaaagaatatatattacaatgttgtgagtaaagtgttctataaatgttaattacatcctgttggatattacaatgttgtgagtaaagtgttctataaatgttaattacatcctgttggatattacaatgttgtgagtaaagtgttctataagtgttaattacatcctgttggtcaaccgtgttgttgagtacttctgtatcttttatccttttcacctataagcgtggagcccttttgtctctggctgcttgtaatactttttttcgttagttttctatttaagatgtgtatgcatggatttattttggtttatccattttggggtatactcagtttttgcaatctgtaggtttgactcttgccaaatttagaaaatttttagtcattttttaagtatgtctttagtcctgctctctttcccttctccttttataattccaatgacacaaattttacattctttattttagtcctacaggttcttgatgcattatccatttttttggcctactttcttcctgttgttcagattgagtaatttattttctgtcttcagttcttagattattttctttgttccctctatttggctgttgatcccaataattgagcttttcatactacttattatacttttcgtagattttgatttggttcctccttacatgttctattctttgctgaaacttttaaatttttttgctgacactttcgcttgaaaaaaaatgtattaagtgtgcctgtgctgtttgtcgaggcatttttagcatggctgctttaaaatctttgtgagataattttaaaatctctgtcatctagggttggcatccaatttgttttttacttagtttgatatcttgttggttttctgtatgacaagtgagttttttaactgcaatcaggatattttcatattatgctaaggaactctggattgtattacattttcagtgtatgagtctttttctgagtctaccccagcagtggaatgggaaggggaggattacctcattgctgtcaggtcgaagaagtccatgtttcctaattggcctccattaacaacccagggagtcacattgttgtaattgggtgctggtgaccactctgaacactagatctcttttgacaccaccccagcaggaagcagaagaagcaccttgttactatgaagtgggtatgaaagtccaggatccagtgtttacactgacactgcagtacagggggtctcattactggccagcagagatgagtattctagctctttcaagcaccaccacagtgagggtgttggaacaccttcttgtagcctggtaagcctgaaagtaccagctccccacttagtctttttttgctgtggataagggtggaagccacatatttttctgtgttgtttggctggtataggacatatatcaactcaacggttttttgtctttctgtgtttccattttcttggtcctttgggtacagaaggcaggctgttattggtgctttttgtgactgtgtctgtcatttccaagttactggcttatttaagcctgagactgagatacttgaagtaaaaggaaattccagagaactagcaaaatgttgttctttagatgtcaagttcactagtcaatctgccttttttcccctacctctcaatattggctttatatataacatagagggtttttagttgtttgtagcatgagaaatggagagaagtatgtctatgccatattcctggaagagcaagtctggccacagatttttaataagggtgacaagaaaatttaattgagaaaatatagtttgttcaacaaatggaactgggacaagtggatacacacatgcaaaagtatgaacactagcatcatagcatacagaaaaattaactcaaaaaggacaacagaacaaatatatagctaacattattaaaatcttagaaaaatacatagaagtaaaactttatgtctttggtttaggtaatagcttagatctgacactgaaagcacaagagaaaatttaaaaaatagataaattagattttatcaaaattaaaagctttgtgtgttataaatgataccataaggaaactgaaagatcaggagtgaagttttggagatgttggtagagggatacaatctttgagttaggagaaataagttcaagagatctattgtataacatggtgactatagttaacaacaatgtattatattcttgaaatttactaagaaagtaaattataagtgtttttaccacaaaaaaaaaatgataactaaggtaatgcatatgttaattaactcagtttagacattccataatatgtatttgaaaacatgttgtaggcaataaatatatgcaatttttattttcaataaataacaaaaggaaagtgaaagaaataacccacagaatgggaaaaagtattagcaaattatacatctgattagatatttgtattcaaaatatataaataactcttaaaacaacaataaaaagaacaacaaaatgaaataaacaagccaagcattttagtagtcaccctggtaaaaatatataaacaaaagagcacatgaaaagatgcttaaaaataactcaggaaatgcaaattaaaatcacaatgagataccactagataaccattagaacatctataattgttgtcaaagatatgatagaatgagaaatctcaaaatgtaagatggtgcagccaatttagaaaataatttgcaaattcctcaatagattatacatagagtaccatctgacccagaaattccattcctgggcatatactcatgagaaataaaacagatatccatactctacttgcatacgaatgttcatagtagcattatttataggagccaaaataagttgaatctctattaactgatgaagggataaacaaaatatggtatattcatacaatagaatactatttaacaataaaataaaataaagcactgatacttgcaacaacatggaactcaagaacattatgccaagtggaattattcagtaataaaataagatatatagtgaatggttccattcatatgaaatgtccagaataggcaaatctatgcagacagaaaatgattagtggttgattaggactgcacagaggtaagtggctgggtaggatggagtgtgattgataatagggtttttctttagaataatgttcttaaactagatcatattgatgcttgcacaactctgaatatactgaaactactgaatttggacctggttgcatttctctaaaataaatcactgtattttattttgtattctctaaaatatgacttattaattaaggttttcttgtccacacttgtctgtttaattacactttaaaatgtttttcataattttattgaaaataacagattttcaatgagccattaattgactctgaagccagacattctcatttcacaacttagcacttcctttgtgcaaatcatttaatcatattatgcctcagattctttatccatataacagaataataagaataactattttaaagattaagcatgttaacaactttctttcaacaatattttaaacataatgaatactatgtgttatattccctttctcttcctccgcctcatagttatactataattattatagtttgccatggagctccattacataatataaatgtctcattgtctttgagttagaaaatacaaatttaaataagtacatcaaaaatcccagtatcaatttgtctgagaatacaaaatgcctatggcctaaaggtatcaaatatgctgccaaatggatgtttttgaaacatgatttcatggctgtatttcaggttgttaccaaaaaaatgcattaagttattttattttcttcagaagaggacaattttgatcttagaacatcatacaaacgtttactgctaaagtgtctacctctcttaggagaaataatataatttgatattggtgaatttctagtgtaaacataaataatgtatattcttcttttattgggtgaatgtatgccaattgggtccaattttttcattgtgtttagattgttattagatctactattttttcttctgtttctttcacctgttactgagcaacttcattaaaaatctttattgcatagattttcccttccttgttatttcagtttttgctgtacatatttggacaagttattaggtgaatagaattaaaattactatatggtcgttatatgcttacttgtctaccattatgaaatacccttctttatatctatcaatgctcacaccgtaaattataatttatctgctattagcatagattcattcagctatttgtaaattagtgcctgtacttataattattaaaatactataatcaaggtgtatttcttataaacaacatttaggttttttttagctcatgtcatagtctttacttaactttgaagtatataacatatctaaacttactataactatttatatatgtgttatgtgtttgttcctctattatttgttccttttatgtcattgtttttgccttctcttaatcaagtaggtgtttttattgcaagttttttattgacttgtaagttttgtattctcttaggaagcaaaatatgcatccttgattattagagtcaattataaattagtactcttatcacctcctgaacaaaaaatgaggacattagaccattttaactccacatcatcagttgatgtttgtactattgtttctgtgcattttaattttatatatattatacacacccagaagacataaatactgctttaaccactcaatattcatttagagtaacctacatacttattcattaatcattacagtctttccatgtagacttatattgtgcctgaaaaatttcttccagtattttagttctagcaacaaatatttttgtatgctaagttttaaaagaaaaatcacaattttctatctgttctatcatttctgatgaaagggtttgtttgccaagcatggtggtgcacacttgtaatcccagcactttgagaggcgaagtagggttgatcacttgaggccaggagtttgagaccagtcagagcaacatgaaaccctgtctctaccaaaaatacaaaaaattagccaggtgcagtagcccctgtagtcccagctactcaggaggctaaggcatgagaatcgcttgagcttggaagtcggaggttgcagtgaactgagattgtgccactgcactccagcgtgggcgacaaagcaagactttgtctcaaaaaaaaaaaaaagggaaatatttgtctactccaccagtgccagaagtagaaattgacctgtattgctttatctttatttcttatcacttattcttctttattctttgtcacagcaaccatcctcttaggatcctcttcaaccaacataaattttggaggtgatttctgttttttaacatttatttacttttattttttaattgtacatatttcaagggtacaatttgatgtttccatacatatatatggacaaaacttatacgtgtatatatatgtaagtgcatgtatttatgcacatatatgtacatgtatgtatatatgcataaacatataagcatatgtatgtattcaaagcctctcgtagctattttttaatatacaataccttgctgttaatcataatcaccctactgtgaaaatagagtactagagcttactcctcctaatcttaattgcacctgttgaccagcagcaaagtttttaattctgaaaacctatatctaaactacatttcaataatcagctgaaataatcattcaggcaaaaccaattgatagagtaatcaacagttcaaggcaatatttattgagcatgagctagatgccacacactgtactagacattagatttataaaatttgtctaacagtatttcaatagttaagttctagaatctaatggcaggaacccataaacaagtagtttataaatatatatatgagacatgctataataggagtatctgaaaggctgtttaaaatatggaaactgagggaaataaaaaatgttcaaatttgattcccgaaggagttaaacttattatttgacatttcatttttactctagttttgctactatcatataaatatatgctttaggtgtaaagtaaacaatgagattgtccaaaggatattttctaaagtttatcagtcgtattggtccaccggcattgtctagactgacgaacacttccaactttactgctcatatcattctgcatacccaaaatatccttcctttgcttcttgatggtgaaaaaatacatagttttgcttttctgagctcattgggctctttataatgtaacctctttgtattgatttgtccatttactctagaattacctatgatgttcactattttccataataaggaaattaccaaactcgtagaatagccaaaatattaccagttgctttaaaagattaaaaagaaaaaaaaaacaagaagaaaattttgataaattaaacagtaatgaaagaacacgtggaccaaatatgcctcttaaaagtagaaataattaaactgtgtcggaaagcctatcaatcagacaaatgaaactatctgagacaaatgtttcaccttccatgtaaacactagactataacatcaaagggaaagaactgattgtttcctattgcttcctagcttcaatacacgattctctaatgcgctttcaaaagtatagaaatactattgtaaatagacgttatagctgaaaatcctgaaagctgaattatttctacagcgctatttgcagactaataagcagttcatcagtatattattgtaaagataaagaaaaaactgcaataaaattgtataaatgactaaattgattaaattgatctgattaacataaaatattccaagtattatttatttagttaaatctgagacactaggaaccttgcaagtaaaatttgtaccctagacgtgactcaactcgactctactctaggcctacccctaaagtcagaagcctaaagacaaattttaacaagattctcaggcatattaagtttggcagctgagtcttgccaagttacaggccttggcaaatactttgggctttccatagatctcactcacaatgtatgacataaaaactactcaatttccatgtgataatagtccaaaatgccttctaagtcaagaattagcactcttctaaggaagataacagaatccaaagtctgtacatactgttattatatattattcccaatgtccaatgatgaatcaacatttatgagaaattcaactaaatagaaaaatgcaacccatagttgaagaagataattaagaagaggagaaggaggaagaggaagaagaaaaatggaaggagaagagggagaggcaggaggaggaagaagagtcaaaataggaagaaaagaaggaagaagagaagaagtcaataaaggagaaggaggagactgagggagcaggaggaagaaaagactgaaggaggattaagaaacataactcaagatggctctgatattggacttagcagaaattactctaaagtagctacttttaaagctatttaagagttttatccatttaaaatcttctgaaggtaatttaaatgattcaaagaaaaaaatatggtcttaatgagttaatcaataggaaatgttggtacagaaatgggaactataaaaaacttaaagcaaaactgtagaacttgggagatggactttatatcagattggagactaggaaaacaaaagaatagtaaaattgaaaacatatcaatacaaattgtccatttgaagatcacagagaaaaaaatatgtgaaacaaataagcagaacttaagggacttgtagtccagtgtcaaacagtttaaaatgagtgtcattggaaaagatagtgcctttgagacagaaaaatacagaagaactatcgtacaggctcaggcttcccatatattattgaaggcacaaacttatagatttagaaaggtcagaatgataagcaacaagcgaaccacagctaggtacattatagtcaacattctgattcccaaagctgaagagaaaaatatgtacgttactagagaaaaaacatattacacataaggaaatgggccaagaaaaaaatcataattttctcttaaaaataattgcactcaagccgggtgcggtggctcatgcctgtaatcccagcactttgggaggctgaggcgggtggatcacgaggtcaggagatttgagaccatcctgactaacgttataatctatcttataattcagaaaacaaacagaaatataaataattagttgtaataatgtactataattttctacaaaaatactgtaaatttatatttaaaaacaatcaaattatcacatccttcatatttttaggtatataggtatttctatactaatatgctacattctatattagtgttttttcttacatatattaatctaggagtgtgaagaagaacatttccactgactaaagaaagttatgaacaaaacaatcttgaaatttaatttttttttactcttgaaatatcttatgcctatcagttctagaagttagtttagccttctttgaatctcagttagctctggtccatttataactgcttaaaagcctaaaaccaaatttttctagtaattgtggggtattttattgcttgctggttgattcacatctgtttttttctttccagttagatttcaaagtcttttgagataaaattatgttttcagtatcttgttttgaccacaatgcaaagattatgaaaacatctattaagcagttgtatggagcttgaattctgtgaaggaacagaattggagatgcaggtttgaaagtctttgcttgcttcgaaataatgtgaaatttcacttctctcaattctactattttcccacatgcactataactccctaaactttattttacttttcagaaatttatacctaagttggcattcactgtaagtatcacttgggcatcataccaacaacaagtatagtcgatattgtgcaatgaatacaaaaataggtaacatggaaagacacagtttcatattccagcaactggtgttcataaatccataagtgagccactcatattttctgtagctaagttctctcatcacgcaaataaaatacaaactttaacatcaaccacttaatattaacaatctaatgagctagaaagtgcatgttaaaataactttaccttaaattttattatctagtagaataatgataattattattgtacatcactttacaacttccaaaattatcactggctttcacctgcttttgctgtgttgtagtattatacagatttcataagtcatgtgtcttctttggacctcactttcatactgttgcctgtttcttcaactgaagatagggattttagggttttaaatttttaggtttttaaaaacaatgcatataaagcacccaatgtacacagaaagcataatacttacctgaggcaacatacttttattatttgtattactatttgtaagtactgataaatattcaaacaaaggataagtctataaacccaacctactttaatattacattcaagagataagtactgtgaaaggttaattgatactactttctaaagattcttcaaaattacttctgaagtacaatctttttatgttagctaaccaaaataatttaatgatatctatggaactgccttattgctcaaatttgcaagttttagacattaacatttttctaaataaatctatataaaattcaatgtacttaatatgactgtacatgctaaacactatgtgtgatgtataggcttgttattaaactccaaaaaactgaatatacaaaatttagcagaagttctgatatttccatatgcttaagcaatgagaagttccccttagaagtctcaaataatttagatcaacccatgttttagcctgtttggattactcaaggtaaatttgtcatttaccatttaccttatttgtcattttataaggaagacaaatacctagtcttgaaatttacttctgtttttttaaaaacattttacatgtaataattcatttaatcatctcaacatcccagtgaggtaattctaaacttattcctatcttcagttgaagagacaggcacagtaagaagaatcattgagagtagttgcccaggttatacagctttaaaatggctgaactgggatgggaattcacacaccccggctccagaacttagctgtccacagctatgctatttgcctgcttctttgtttttaaccatttcatttttagtaactcctcctctcccaagtctatctctattgatcttccagttctgttgcaaactgtaacacagtaacaagttccccttagaagtctcacataatttagatccacccatgtttcagcccttttggattattcaaggtattttgtcatttaccatttaatttatttgtcatttttcttccacctggaacaaaactggaagatcaatagagatagaccatgggagaggaggacgttttcttactttccactcttagtcaataactgggatttttcttttttacttttagaatatcctcaatttaaatttaaatatttattggcctttcttgatatattaactttctgagtttccaccccacttttctctttactttcttttctgataagaaatgcaaacctaatttttaaaaccataaatgtaagatgaatgaacttaaaaaatctggaatggcagttcaaaaagcaattaaaattgaggaatcaaaaagctcctctgattctttgtcataattcaaataaaggtatgcttttctgactgtggtaaaaactagctgacaagtgccaaggaaactagattttttttaaaaaatggaactttgtatatgtaaccacattattaaaaccagggcaaatttttcaggatgtagctgtgttctttgtatagttatgacttttgatctctgtatctttaccctgcctgtttagaataaactttacactctatttcctatctccagtcaagtattaaactaagaaaatatctgagagaaatacacaagaaaataatcacaaagcattaaaattataaaataatttatagttgaatgaccatgaataatgctttaatgatcttatgccttatgtgattaagaatataaagatgttttctttcctcttttctttatagagaatatacagatttggggtaccaatgaataaaatactgagattttgtggagtctgatatttaaacttgttttttcatcaattcttctttatgagaaaatggagatactccaggcaatgaaattcatccagagtaatatatttgggggtactctgaattcaatcacccttttcctcacagtttacaaaatccagaagtgtctaacagtcctccagacatgagctgcctgtcatgtcttattacctgaacatgtctattaataaataaataaataaataaatctttgcaagaaagtgctgagctggaaagagcagagaaaatatttccacatcaataaagtaacagaaaggctttcatggttgtattttccaacttatcttcctttgacacttacttttcttcactgcagaaacaatattttccctttttttctttgtattgttaccctacccatcttaacctagtgctaataactgctctggttattatctccttccacacctccctggctcttcctttaggcctggagtcactatttactttagaaggaataatacattgaaaggcgtgtaaaggtgaaaatcaggcggttttgtaattcccaagagtggaggttacagcctttggcacatcagcaaacaaatcacaaggactgctgaattcccttgcaggctttttttctttcatggtttggagagcaagagtgggagcgacagctaagatgacattgccatttgggggacacaattctgcaggtgatgttgtgcaggggaataaaggaggtgaaagataaattgtcactgaattggctttcacacagctgtaggtgtattttagtttaacggcagtgacagtccagctcccacctgctgacagacggctgctagcaagaagatatatttgagacttactgtcaagatacaagctttcatgttaaacaaataacgttttttaaaagagtatttcaaaggatgatgaaaatgaagagaaatgatacttaacatatacaacataaagagagtatctgagagcccaaagctgggctaaagttggcaaaggcgagataattatattttccaggagtgaatacctccaagaaaaaaataaatcattaaaaaatggggttggtgttgaacttggacattgcatggctaagagttcctagtaaaaatagcaaaggtttccatataagtacaactgagaaaggcagtcacctcttactctctaaccagaaaataagaaaagaagatgagagaaattttaatatgccagaccataatatgcgtttagcatactattgttatctccactagaatcttcaattatcatcaatgagattaaggtccgttattaatgtattcgtgtgcctgttgctcttctaaattgtttgacatgcattgtcttcataagtagtttttatcacagcactgtgaggtacctgttactgtacagaaaggaaaaatggaagcacagggcatttatgtaatttctcaagatcatacagctttatacatggtagtagagccatgtaccaaacaaagacaacctggtgatgaactcatgtcctttgctgttaaatatttagtacagcttcttgtataagatgaaaaccattccaaatgcaaagatgcctctctttactaggaaacccagctttgagaagcagggatgaagcagggaggaagatgcaaaaagatgtattgattatcaggagtaacaaatcaatcctggagatcaaggaagcaggtatgcatgtgggagggacaggtgggggctacatcgagattgtgttcatattcagttaaaaatgtttttagtcctctgaatacagaaggtaaatgaacagaaggaatgctcaaagacacagttcttattgttgttttggggtttttttatttgttttatttttattagggcttagatttactaaaatttgtcctcttctattttaggcttacgtgtatcatacagaatatttagtgtgtgtataaattaaaatgtattcattttagacctttacacaatatgcaaaaactctgtataattctgcttctttcaaatagatgcttttttgttcacttttcaaatataatcattaattttacgtactgaataatgttactggtttactatttggtatatgtatatacatacatatataggttttataatgttgattagtgtaactagtttactatttggttttattcataatcattatttatttttatatgtatataccatcctctgagcctcacagctaaaaactgttgtctgtggtggagagaattccttagtgcccttaccaaatcaatgagtcttcatttttcatcatttattttatttactccatctaccagtttctaacactgaccaacacttgtgccaaagggacatataaaccaccccttttaatgtttgtaactgcaaaatactaggctctgaggagatttttctcactgtttgagatggctataaagtttatgtcttacagcaaaagaattgctagctcatgaaattttatcatcactattgaatgtgaagatgtgctaaatggcatagatgcttaatgcatttatacagacatctaaactatatgcctcaagaatatcttacaggaatacaaaaagaaaaaattttaaagctctaggctgggcacagtggctcatacctgtaaactcagcactttgggagattgaggcaggaggatcgcttcaggccaggagtttgacactagcttgggcaacacagtgagaacccatctctttttaaaaaaataattaattttaatccttatatatctatattaaattgtctttctgaggaataacctcttttataaacatctacgtgttatcatgtgcccttaaattgatattatataagaaaggagaatatctactttcagaaacaatctgcaaaatcggtaacttccaacgatgtagtatggtagattgtcttcaaataattcctctcttccctgaatactcatgtcactccccccgttaagatatgaaatctatttccccttcttgaatctggatggtctgtatgacttgctttttccaatagaatgcaacagaagcaagtctgtgtccattctgggtctacctcttgagaagcctggcagtttccaattatggtcttaagagtctagagtccgaggctaccatgtcagaagtctaactacttggtacagaaaggcacaaccaaccacaaccattcccgctaccctagaaaaggtccaggtcatttgagtaaagctatgttggatgtttcagtccaagcagaggtcatagataaaggcatgagtgacccccgacaacatcatacggaggagaagatccacccagctaagcccagacagcccagagaatggtaagacagaatgaatcgttgtttttaagtcattaatttgtggaaataatttcttgccttgcattagataactgacatatataaggaactaccgtaaaatagttgagtctaaagagttaacttcaaactcttttcagggattccaggacctaaaataaagatatttctccaatcgtggtaagaactgttatggtgaattaaaaagaactctaattaaggagcaaacaagtactatacaaatgaacttaaacaactctcttgaatttattgagaagtaaaatccaactggatatcaagtataaactggtcactttcttaatgtcacttaaaatgattcccttcttttcaacctccctaatacgggaaagatcaaaccattccaatttctctgaaggattacccaagaggtctttctaccctacctcctaggtagctcttctctagtttatttctcatttctaagttgctgcattctaaaatgtagatagaatcaagtcacagcctacctaatattctttgtgcattttccattagttaagaattaagtccatgtcggacagcatgatgttccagttctctgtgatttgacttctgatttgtttctcaccctcagtgcatgccacttttctcctttaaacacagactccagttattcagtctctatgcctttacaactgctggtacttctccctagataccccttatgttctttagatctaatttccatgtacattaaaaaaaaaactgattcccatgccctttaggttcacaatgccctgaactcaagtctgaatgcatcctgcctttaaattaccatagcactggcatgcacacactcactgtagccttcaccacactccattagtgtgcttcctaagtaccaggcaatagcttttagttctttatcacagcactcaccttggtgtcaggaaaaccagaaaactgagtgtttgttggataagtggataaatgatagatgaaatggaaactgcatgtgaaagcacttcatcaagttaaaagtgcttgaaaatattattctgatgactccttcataacaagttgtaaagatagttcctataaaggtagactaaaaccccaaacagttaaatgaatatatcttggaaaaaggcaaagcgattacaaatatgtacaataaaagcaggattgccctcacctataaaatagataattctaaactgttatttaatgatactaaggaataatgaaaagaataattcaattatttacaacttgatcatgatagcttttaaagtatctgagaaaaatggagatagagtgaaataaattaaatatattaaataaaataagatgcatgcatttaaattatatttagtaatatttcctttagtcctgaaattgaatgtattcactatggaaatcagtacatattaagatgcagctgctgagtgtttcttaaacaccaggcattcgctaagtgctttgcagatattatctagtttaagtcttagaaaaacctatgagataaagattagcatcttctttataaaagtggtaattaaagtttgcctatgttgaaataattaataactgacaaagccattcctagatttctggtttaaagccttgttttcttgtcatcaatgaaactgtaagacagattggaatttcctgcatagaagaatctttcagaaaagagagttaccatttgtcttcaattgcttaatgatttttttttattaaagcagcaccaaacctcttaccactatggtattactttaccttgaacttccatgaatgtctgtctcatctagagtttccttcctgggaaataacagatgttcctcacatatttcaggattatttcttgtcatttaattgctacacaatatcacttgcagaaggttgaataatggccattctgagatctacttagaaccccaaaaggtaaccttatttggaattagtttattttcagatataattatagtaaggatcttttgaatagaccatcctgcattgggatggtccctgaaacctatgatgcgtatgcctgtaagaaacggaaaaagagaagacacacagagatacaagagagaaagccatgtgaagagggtagagactggtattattctgtcacaaaccaagcaacttctgacaccatcagaagctggaagaagcaaggcaggattctccccgagaaccttcagaaggagcacgcccttgctaacatcttgacttcagacttggcctccagaactgtgagaataaacttccaaaattttaaaccaccaagtctttagtaatttgttactctaagaaacaacctagttctcatttctgcacacctgctaaggacagtgctatgtctagagcacaaaagcaggtgacctccttagctgtttacagtaattaacaatggctctctttaggagatgacattttaagattataccaggagtgagtcaagcacactggaacagacaagacaaagactgaaaagaaaacagcttaagtttgcaagagagaaaggaaaccaggatggctaaagagcagtagttggtggatcacaggaatcaagtggttcataaagaagcaaaaaagaatcacatcacataggtctttgtacagcttatcaaggtgtttgaattgcacttttcaatttaacaaaaagccacgcattaatatttgggtgaattggtacagggacacaagagcagaagaatacacaatttcagtttgtgttttaaaagaggtgatactaattactgccatggggaacacaaattgcaagctaaaatgatggaaggaataagacaaggaaataggcttttgaactgttgaggagaggtgagtttcaaagtagtgccagtgatgatggaggaatgacttccttatgatgaattttgtggcagtatcacttgacattctgatggattggatgtgaagaggaaaggaaaatgatacatcaaatctctgcaataaaatactaaaggacataggaggagtagaaaaagcgagtaacttgggattgtagaattaagaaaagtccctcagaggaagagattctcacacatatgaataatagtggcctactcatatttttttaaaaaattttgcatatgaatgataggaacaagaggctgtagagagaatggtagataaaggatttttgtactaaatattctaacaagaccaatttgcagttgagctgtttatatccctttgactataaagagcagtaattatatacaacactgaaacactaaattattcaattgcctcaaatttgttagcctcacattcttttactatgttcctgttttaggtccatcctctgcattgagacatttttagatttgttttaaatctggtattattctattcaaagtgaatttattcaaaactatttctacttgattctgggaaatatttttgcctttctcacgagttctgcacagtgaccttttatgagtcctgttaaagtggattcactcttcagacaaggtttcttatcagtttttcacacttactgaagaggacttttttccccccaaatcatgtaaggttagctctataaatagtattttgtgattttgaattttatgctattctattttgaaaaaatcactggctgaagtgcatcttttaagaattacttcatttcttaaaaaaagatattgcatcttttctgcttgtctcagtgacctacttagctttttaaagctctccactgacatcctttttgtctcctacttttctcatattatctgttttccttttagcaaaagtctattttgttgttatttttaataaaagtgtacaaagttataaatatgcatagactattctttgcacttaggtgaatcacctctttaaattaatgaatgaccgaccattgcatgtttctcaaaggagaggccaggtaaagtcaggacttactgtgtcaaagagagagaaagtgtgcccttgacttctactttttatgtaatactctcattctcagaacataaaatgatttcaacagggcagtgttcataattggtcaacttaacttagttttgtactcctgaatttgaatacctgaataaataactcttaaaagtatataaaaagtcagttacaggaaagacagaaatttagctaaagtttatttgctctatcttaggggaacctccttgaaattaaaggaagaacgtttgaggtatataaaagaaaatacaaatcataaaattattttcctgaaaaaggagtacagactaaggatggaatccaattataaagaacttatataaattaatgagtgatataaaatgatcttgctaaacatgaatgttctaagaaacatttcaattggggagctattcagcaatgtcaaatggggatccccaaagtaacataacatagaaatttgttattgttgttgttttgtttttgtttgttttttcttgaaacggagtccaactctgttgcccaggctggagtgtaatggcatgatgttggcttcctgcagcctcaacttcctgggctcaagccatcctcccacctcagcctcccaaataattgggactacaagcgtgtgttaccatgcccgactattttttttttctttgtagacacgaggattcaccatgttgccaaagctggttttgaactcctgggcccaagcactccaccgacctgggccttccaaaatgctgggattacaggcatgagccaccacgcccaaccaacagagacaaatgttgatagtccccattttactctcaaatttcaagtatcttgtcaagtcttctccatctcaataaacatcaatattattttcagcatttcacaagccaaaactttacaaattttatgaaatatgaaattaggttaaaaacaatacttcaaaacactttaaaattaattcatatatgaacttatgtattatacagttttaagtgtatgtgtaacataaacaagtatcatatttaacaacttgaaaattctatctatattcctaatgtgggtatatatataaacatgtatgtgtaggtgtgtatgtgtgtgtacatatataacacacacacacatatatatatatacactttggctcacaggttttcttagtcagttctggctgctacaacaaaataccatggaatgtgtgtcttaaacagcaaaggtttactctcacagttctgaaggcaaggcagtccaagatcaaggtatcaagatgccagaaaattcagtgtctggtgagggccactttcttgctgtatccttacatggtggagagagagatcacctcttctttttgtaagggcaattatattaccacaaggttcctacccttgtaacctaatctaaccctaactgtctcccaaaggccgcgcttcctggtaccatcacattgaggaatagaacttcaacatacgaattttagggggacacaaacattcagtccatagcacaaatataaatatacatatatttgaatgcctgaataaataactcttaaaagttttatttttatatatatatatatatatatatatatacacacacacacacacacggggtgtgtgtgtgtgtgtgtgtgtgtttgtcaactatacatttatctatcaaccaaaaaaattataggagcagtttttcatcttttgtgaagatcatcttacacttgggcaactatagctgtaatagttgtacataatattagttgaatctgagtagaagtggaattgtatacttaaaaatgtatgagtaaaccttaaaatcatgttagaattaacatgattttagcaagtctaaacataaatatctttactctaaaacttaaataacattatctaatacattttacaacatttgttacaccctcccatgcatggtccaatactcttcatcccctttgcatgttttatatttccattcatgcatataccacttaaaaaaactatagaactattcatgtagtttgtttaaaaatctgcctttctccaccaaaatttgagcattaggaaacacacatgttctgctcattagtttacccccagttttagtgcatattcagcaaattcttaaattaatgcataaaatgaccacagaggaggaaaaaaattggctgcccagacaaaggaactgaaattcctataactgtgagagaactatgttcatcaaacctgagaagtctggatacttagtgaagaaaaaattggtcagctttttttgtggttaaagtataaatatgaacaaaaaaacaaggaagatttctacctttacagggaaggccagagagattcaaacaattctcattttcacactccttttccaagatttcatgagagaaagtaagcactcaataaaaatgtattgaatgaataaaataaatgaaatttacttgaactgatgaacaaattacatgtgatacttattctcactaagaacacaacaaatgtcaaaaaaatagaaagcatagtcaatgtaaatattttatctaaagggtactacgttttattctatcaaatatatggaatataaccaaggtacacttccattcagaaaacttctaaaacacatcttgtgagtgaaagctaatgacatctacttaggagttacctaaatgatgcagttacatctgtgagcattctaaaaatgcaagcaaaagaaattatttatatgttccttaagtaatacatatgatttacaacataaaaatatttttttctgaaaaaaatgttatattgttagctctacagctcatttttaaagtcctggatattattaataaaataggcaaatatgaatctagaacagagagatacttaaaaactccttagacctcccagaaatgaaaaaaatatatatacatacatatatttatgtgtttgtgttgtatttacatcaatgccaaaagcaaattattaaaccatcttgtttgcacagatttatatagcagttgttaaataatgtcacttctttagcaatgtataatggaaatcatgtttcaaaacctgcaataagcatttgctttggattatattgtttagccctttcaaaacttctgtgagctggttgtgttatttcactctcgtttccagatggagaaactaaagcttagaaaatgaagtaattttctcccaatcacattgagaaaataggaaaactggacattgaatccagacatgatctaaaccagttgctgcacagtatggtaaccactagctacatgtcattattcagtacttgaaatgtgactggtgtgacaggggaaatttattttaattgtgtttaatttaaatcaatttaaatttaaaaatgaaagaagtataaaataatttaattcaataaacacaacgttgttgtattggtagcactatatttagcttcaaacattgattgttttatatattattgtcttcttggagtatgatatggtttggcttgtgcccccacccaaatctcatgttgaaattataattcccaattaaaattacaattgggggagggacctagtagaagatgactggatcatgggggcagatttccctcttgctgttgtcatgatagcaagtgagttctcacaagatctgggtgtttaaaggtgtatagcacttccccctttcctctctgtctcctgctggccatgtgaagatgtgtttgctttccctttgccttctgccatgattgtaagtttactgaggcctccccagccttgcttcctgcacagcctgcggaactgtgagccaattaaacctcttttctttataaattacccagtctcaggtagttctttatagcaatatgagaacagactaataccgagtatgcatattaagtgtctaaactgtttctagtattccacataaaaacatcacaaatctagttaatgtcaatggatggatattttgcacaatgtaagcaccaatataatattgtaatgtgtttatttggatattatatgcaaatagcacaatacctaaatgaattgtaagtggaaattaagttgaaacacttattaaattgtaatacaactaaattatttctctagcttaaaaacaagtgtagaaaatttctggatttaaaacaaagaaatactacatatgcagaatcaagtgaaaatgcaaaagctgtactgcacacatagtagtgtttttaaaaataggaaactttttttttgagatgtagtcttgctctgttgctcaggctggagtgcagtggcatgatctcagctaactgcaacctccacctcccaggttcaagctattttcctgcctcagcctcccaagtagctgggattacaggcgtatgccaccacgcttagctaatttttgtatatttagtacagaccaggtttcaccataatgattaggctggtctcgataaaaatagaaaacttttttaaaggaaacttacaatcatggcagaaggcaaaggggagtatgttggagtatgatatggagagaaaaagagaaactgttagaaggtatgtagcaaatttctcaatgattaatgatggcaatttcgtgccacatagcaaaatagaaaaaaagcatactgtataatgcttctaaagaagcatctctgggatggtcgtggatggggcagagatagtcaaaactcatagaggcagtcaagcatcagtgataagagtagtagctctggattcaatttcatgccacatagcaaaataaaaaggctatgtagcaaatttctcaatgattgatgatggcaattttgtgccacatagcaaaataaaaaagctgctcggttaaaaaatatatatagtaaagttgataatattaaagatattttagcaaaaagtaaatttgataagcaatttcctctcaatagtaaaaaaaaaatctgtgaatatagtcccctgaaatcagaaaaaaataccaaaataatcccacaaattttaaaaaataatttgggattgcctctaagtttgtacgtttgaccaactatgattctggcacaaggtactggcgaagcaaatcaaatgttccatgacgtatttacttctcatctcacaggatccctttatttaattggaaaacaacaagtcataactctcagaagtagtcattacatcccaagtaggcttcaagtttttcatctgaaaagtactcaagagtctctggagagactgccaaaatcataggcaagtaggtgggtggtttaattgtgtagtaaaagaagaattaagtaaacttttccctaaagtgcctgagaacctaccagatgtctgctgaggaaacagagcgggggcaaattctgggcccagctaagatggaatgggaaatggattggttctctaggacctggaggcagctacagcttcagctcatgcaagattggcaatctagaaagagggcaggaactaaagagaacagcaaacattcttctagccattggcagtatccacataaaagaaaagagtttgtctttccagtctttgcttctgagccataatatcctttctcataatgcgtattggttgttgcaagcaattatttgccttaacattaaaagtttatactcttgaaaagaactgaaagactttaattttacattctgtattatataccagactgaggcttgctagatgtaatctgaattaaagaaaacagtggagatggtgggatacaacctacttataaatatagaaagtattcagacttaaaattttgaaatcaaacatgtgcagcttcaacatgggtaggctgctgtggactagcttatatatacccactgctctgtggggaatgaagttctgaagtccaggcaaaaggtacaaggtgatgtttacacacacattgaggagagggttttattacaaagtttacaggtttctgtaaaatttgcctctagaaattcaattttcattggtcttgtttttaacacttttactgtatatagtgtctgttttatttttataatatgtataatgcttctaaacaagcatctttgggatggtggtgggatgagacagagatggtcaaaactcatagaggcagtcaagtaccagtgacaagagtagctctggattcagacagaccaggttttataccctacttcagccctctagagctataggactttgagcttgttccctagcctctataacactatattttatcaagtataaggaaggggtataatagtaataatttgcagataaattaggacatatcaagaaacttgcacagggtttacatacattgatttattttgtttatctcatatgctaaaatacacattttgtgcttcaaaggacacatcaatttacactgggacacatgtaaaagtgatgacactataaacttaagtatttattacttcaatatctaagcactgacaagtgacttcagtctttttttttttttttttttttgagacggagtctcgctctgtcgcccaggctggagtgcagtggcgagatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccgtgacttcagtcttaatgaaatttccttgtctagcaatgggatgctaatggattcaaagaaatggaaacatttataagtattcaaatatcatttcactgaaaataaacaattttttacaagtagtgactgaatagttttaagcagaaaaaaaaggaacatttaaggactttaaattgactctattttattttagatggcatctttaagtaaagattatgtaacagcaactgaaaagctccatctgctggcttttgatttcactggaaatgcattatgatcatgttcttttctgatttgattcccctccccctaatagttaatgtacttataattgcttctttattgactaaaaacttagcactgatgttacacttttgcattttaaattcagtgctcatacattaattttaaaaatggctaagagaaaaaggcttgtaccatgaaataaacccatattttgaaccagttgcactcttgtaattaggtatgaaagcagtaaaattatttatgtcgatggaaaaagacattataatatataaatttccttaaatattcttaacaaaagtattttcttataatatttcctgaatgtcttcattatctttgaatatttgtctttgctatggtaaacataataataatttgacatataaaactcacttcattgaaatcatatgtttccaatggtcataaaaagttagacaagacagtgtatcattattatatcataaaaagttagataagccaatgtactgttattttatcacatggatttaaaaaataattaaaaacaaatataaccttaataacatcattggtcatcgaaaatttatacatgtgaaattgtaatttttaggcaactgagcatttatgacatttataggaaccatatcaatttgtaagctataaagcacaatttataatataaatcatatgggcagaaaacaatatccctgcctcattagcaataggaaatatagtcctaatgcaagcaaattttaatatttcattgaccaatttagcttatactcaatgttatttcctattttgcatgaacatgtctattaaggattagtccaatctcaaaagaaaaatgaggcagattttaataaatagatctataagctctgattggcctccatctatattaataagttattcacaagagtatgtatttctctaaatcatctgggaaaatagcatttgtagctaaagttgataaggatttatttgaagttgaacttgcattgaacatacaagtccagctggtcaaatattttgattcaaaaaaattactgaacacaaactctgtgttagaaattctgttaggtttggaagatacaaagataaataaactataactcacagattagacattagattatttgcccaagggaaaaagaagaaaaatacaatatcataataacagcaacagaagttggcattgagttatatatagaagagtcagaaaggaaaattgagaatatttccggttggggaacctccaagatcaaaagtaagtatattacatttgatcttcaaatgacactttctggtatacttctcagtaataaaaagtatctgcataaaaagtgagaccatttctccttaactagaaagtcaccatccttggtgccctgtaggtaacaagactattgcagtgtgaaacagcattatgtaatattttaatgaaaacttttaagcccgaggcaaattaaataagtaggcaaaacagctctttcccactcagtatttccaccctgttcccttttctcagttttgtgggatgcacctcttgtgtactcttgagattttgtctgtttgtttcagtggtaaaagataactgtccccactcaatatcacactttagtttgaaggagaaaagcagtaacttaatccagtgtgtttagaagaagaaactggattttcataagaacttcttcctccccatattcttcttgggatttagttaccctattcctgcctgacaaaaatggtaaaggcagtatttgcctctggaacccaagaagcctgaagtttgggagggtttaactttgaacaccaatgctgaggagataaaaatattgaatctgtattccttaaaaaatactgctcagcccagccagaatactgaccttctgctaccattttcctcacagataatttctgtaataaaaccctctcctcaatgtgtgtgtaaacatcaccttgtaccttttgcctggacttcagaacttcattaagttacattgactctcataaggttaagcctatactatatcacattgatcattgtgaaccagtatggtatggatcacaactcctgaagttcataagaaaattacacaaaataatttcttagatacgacaaaacatcaaaagcttctcttatttatagttaattgcttacacgcgtgtttgtatatttcaaagtcctttatcagatatgttttgtaaataatttctctcattccatggcttgtgctttaattcttttaatggtatctttcacagagtgtattagtttctggttgcagctgtagcaaattaccacaaagttgatagcttaaaacaataaaattctgctctttccctgttctggagaccagaaatttaacaccaatttgactaggatgtatttcagaagggccttgttcccggaggctctagtgaaggagttccctaactcttctagtttctggtggctgctggcttgctttcgtggctgcttcgccccaatgcctgtttccattttcacatcaccttctcctcttgtgtgagtctaattttcctccacctctcactaataagaactgaatttggataccactcagagaatccagggtaatctcttcatgttaagacgcttaacttaatcatatctacaaagatcttttttttcttacaagttcacattcacaggttccaagaattaggacctggtatctctgactatacattttcagcctactatatagatcagaatgtttttaattttaataatgtctaacttatcaattattgaatttcatggatttttctttggggattgtatctaaaagttattatcaaacctgaagttacacagattttctcctatgtgttctagaagtcttacagatttgtgtttcacatttagttctatgatcttttttgagttaatttctatgaaatatgtaaggtctatgtctaaatttatttttaatatggatgttcaattgtttcagcaacatttgttaaagaattcttatgtgtttttatgactataattgttctggagccattggcttacttatccttaccagagttggcttttaaaaagagctgttagagtgtgatgtagggcaatctcctaaaggaattagactaaattttttttttttttaaaaaggatctgatacagaaaatgtataaagcatggggacaggaacagggatggatgtaatcactctatgtatagttgaggagaatattattatcatactgctttacctttacatttgtattctttaagctatcatctttaaaaagaacacttgaaaagaaaaaaaatttgaatgtggaaatgaaatgctagcctaaaaatattttactaaaacatgtacttcgatttcaacaagttctagttttttgaaggaaaatagccaaattaaattctgacaatggacatatataaaaggattaaaaagaaaataaaatatttggatttaaatgaatctctaaacgataccagttatacttgaagatttcttgctgcagtaatttaagtgtgagtttttttccttattgttatatgttctccaaaatatacatgagatctaaaatttaccatgtcatggaaatttggaaaatgacacaattcaatgtaaggctttgttgtggctgcgttactcattctgtgctaaaactatatttctttaaaaagtattagcctagaaagataccaaaacatgttacatcacaaaaaaagattctgaattcaaatactattgagaagacttataaaaattaaaaggtttctggaccacaaatatcttaaagaatttagctatttactctgttatattcattttaaagtgagaatgtatagtacaccagattgatcaaacaaaccgtccttggaattcttttctttttcatggagcatcccttaatatctctcaggagaccaatgttctgtagaatacatttatgtgaaatgttgaactataacaatgcccaaggcaggtacctaatgagctttccttaaggaaaatgagcaagagtttatgacttttcatggaaattagagtgaaggtaagcagaaggaaattttaaataactcattttaacatggaagaaaaaaatcaaccaaaaaagctgaaaactaaactgctattaaggattcaaaagcatcagattcttgaatagatcaacagcttttgagaaaagttaccttaaacataactcataaaatagctatatctaaaataatatattttcatagttcaggagtaaaaataaaagtgttattacaataagttgaatttgcaaaccactcaaaggatgaaatgtataatcctttagagacagagctttatattaaaatttcagttttacctcattccatgtaactttggtcagaatgaaactcagaacttaaactaatatgttgtaacagcatcacaaaaaaatgatgtcttatgttgtatttttaaactaaaaatagattatgtacattttaattcaatatttataaatcatagacgttggctgagctgttgtcagtatcatacgatgatgttacaagataaatgatattcactgccagcaaacaaaaatcggacctgaacatgggtttctatctgacatatatgtgcctgtcccactgtgtctgtataggtgagttttgtcaataaaataatgagagtgtcgttctgttataatcatgagtctcaatgtatcagcatatttccatcaatccatataatctgtcatttttatatgtatcactttttaaacagtaactgaatttttcaagttgaatgcaacaacaaatgacccaaaaacccaccaaattatataattttccttataatttataacatatccagtttaatcaatacatttaaaaatatttagccaagaatacttttattcacatgctagacagttggcattttcaccataccaagtactcctaagactgcatctgtttcaccaaaaaaggtgggggcaagaatactctaggatttgatgccaaaatatatcagtattttaggcaacattaccctgcttgttgtccttgctgccccaggttttatttttattttgtattgtttgcttctatttttgcaggagacagaatctctttgtgcagatttctgcttccatacctcaccaaagagccctctgagggtttattcacagagatattctttataggacacaaggataaatctggaggagagacactgatttctaatacattcattttgcttctatagagtacctcaacgctcccccattaaatttccatgttgataaataaaaataccagaaatatcatgaggaaaaccaaaccaaataccttactaagaactgtatttgatttaaaaggttgttttatacaataattttaatttataatctgcaatagtgaaaacaagcatggccctccatcttccaacaccgccagtgatttaaaatgcaaattttcttcattttgtcttgtatcagaattgagaagagctaatcgttttatgcatatttgaatgcaattcttgtttccaaaatgatgtcttgagaaaactagaagtttgagcgtataccatgtgtgtttataacactgacaaaatcagtttgctcatttacatgatttacaatatagaagtaaagctggaaaatttttataaacttttctaaatgtaacctattgtatcttaatatcaactgtatcttgggataatgtgttaaccatgaacaaattatgcttgcacaatgattatacaagacaaaaactagagttacggaaatcattggtgttaaagatgttctcttttctctatagtatttaaatatacaacaaaatcatatttattgaaattaggttattccctttaaactaagtttttaaaacagctttcaaaatatgttgaaatgagtactttttttaaggttgagagcaaatattctagataaatgtgtgattgagtcaattaaatcagatttacaatatacttccggggaataattagtcaagttagtatttccctaaattgaatgaatgcttttggataatacctactattataaaatataattacttatgctatcaaatttccaacacatattcctgtttagaaacaacaggacattatccatgttttcttcattagctatacttatttcattcaacttgagttctggaataacatattcttttttataggtttaattttttcatgaagattttaaacctattatgaagaaagtaaaataaatccccatcagaattttgccaaatttacttcattttttaatattttaagtatttataagttataaatttatccattacattatttcaaagaccagatattgctttacaatgtcttgtacataaatttacctattataacttaaattacaattatgattcttccaaaattcagaagccgtcttactgaaattggaatattatctgaactctttaccatgatctaaaaagacatttcaaaatttggttcccacatatcttagtaacttcgttttacaccatacgccttcttgctctcttcttgcgtctggcttcctttatatttctcaaacaagccaagctcttccattcagggcctttgcacttgttattttctgtgtttggaacagtctaatctcctgaatgctgtatgactgtattttttcataattcaagcctcaacccaaaccatatttctttaaatagacttccctggcccaccacctctaaagtgtctttgcctcttccctggatgctgtctagtacagcccttgtttattttcttcatgataattgcaatctaaattattttatttatttatttacatgtgtgttgtctatttccacgaatgaagtggaaacatcatgggggctgagtcctattgctacctgctgatttgctactgactgcatcattatttggtacataaatatttgttgaataaagaatgaaaaaattaactacacttcctatttgtcctccttaggaagccaaatgaaaattttcttttctcacataattttggctcaaaatggcataattggccaactgccagactaccaaacttctaaagcaatactttccccttttgactaatactaactcaccttcccagctgtgttaccaaagaaccttttcatttggttgactcccatgcgatgtcaacctcaggagcgatgtctcaagttccaaagccagatggccatttccaggaatttaacagatatgctggctcttgtcatggataagtttgaattactagacttatcactggtcttcagtccccagaactttacacttagcaacacttaagcaatattacaatgtatatctctatgagtgtgtacgtcttctataaatgagaactttcttttgcagtaagtttcctagaggaatatggataaatatgtttctttatataaagatgttaatgtgttacctttccttatatatcacattatcttcctaaaaactcaagttcaacacaaaatccaagtgatcaaaatgtttaacccttttatccgcagttataaggttgagcagcaataacattggcaaagcaagtgatgccctgatgacacgtcaataatcttggcttttaaaactgtattatgaagaccgattctgtgtcctaacaactgaataatatttacatatcatttataattttctgtcaatgcacaccatatctaaattcatatctagtcctacttttattatcccttaatcttaggtattttccaatgaaggtaatgttttctggggaaaatatctgcaattgctgagaatagtgaagcattacagtgaatcaccaaggaacggtgggtttgtgtttctaaaaactaaccctcaaatagaaacaactgcattgaaatataatttaatgaaaagtgtccaataaaagttattcataaatataatttaatgtgtgcttaatggtggcaagtgaggcaaacaaaaggagaatactactcattttcattcctgagatcagcatatctttattatagtaaatctctatcaatttctcaccatatttttcagaaaaatgatgattcaggtagaaaataatttcacccacattttagttaatcaatgcacagcagtcccaaggactgtgtgatgataataataataaaataaaatttgaggatccaaattattagataaattcttactatctatatttatcttgaatctgtttttgttggcttgagaaaaaaagaactttctcctctgataagatatgacctcactcctgttagaatggctatcataaaaaagataaaagatgatttctggtaaggatgtgaaaaaaaaggaaactgttgtacattgttggtgtggacgtaagtcagtacaaatattatggaaaacagtatgaagtttcctcataaaattaaaattagaactactgtatgatctagcaatcccactgctgggtatatatcaaaatgaaattaaatcagtatgtcaaagagatatctgaattcccatatttaatgcagtgctattgacaatagccaagatatggaatcaacctaagtgtccatcaacagacaaatagataaagaaaatgtggtatatatacacaatggaatattattaagacactactaaagaatgaaatcctatcatttacaacaacatagatgaacatggaggacattatgttaagcgaaataagtcagtcacagaaagacaaatacaacattctctctctcacatgtagaatcaaaaaaagttaatctcatagaaatagagagtagaatggtgattactagaggctgaggcagtgacagtgggggattgggagatgttggtaaaaggatacaaaattacccttacataggaggaataacttcaagagatctattgtattgtacatgatgactatagtcaatgatgatatactgcattcttgaaaaatgctaaagagagtaaatgttctcatcacaaaactgctaactatatgaggtaatgtatatattaattagctaaatttcataattacacaatgtatatatacttcaaaatatcatgttgtacataataaatacatataatttcatatattaattaaaataaatatttaaataaatttaaaaaaacacataaaaggattgctcacaaaaggaaaaagatagctggcagagtaaaaaacaatgtttacacacagaatagcataacaaactagagtggcaagttgttgaatatgactggaacataaacttgtgatgtatcttccagccttttacttaaaagatagaatctaaatgaccttgtcaaattgtgattaggttttttttttttatcttgtagacaactgtaggatcaacgaattgttactgaagcttaacttcacaaaaaggcatattgtgaaagatcattacaaatcatttattgaatgcatgtataaattttctcaaaattaagccattcacaaacacattcatcctatctttcaagatatatcccctgcacccactctaggttattggttcattatatgcattcatttctcagttattttacttctctggcaattttactatttactattaaatgtttactattcatttctcagttattttacttctctggcaataaatctcttccatccctattgatattcttaccctattacaccaacatgccatgtttactgagctattctcaggtcttctctaattctccataaagtttatattttgcctgttaaaaaaaatctgcagctctgaagagtttggttgtatcatgaagttacatgcaataaagtcattgtaagattaataacaaattatctttattctagagatctgtctcagcgtaatctgtgggaggagaagagtaatttcaaatataaatgaaacaagcttggccatgaagttacaattgtcttaccttcgttataggtatgcggaacttaatcatattatactctctacttttgcatatatttgaaattgtccatagtttttgaagagtaattttcacaaaatgtatgttatttcacaatttagatgattttgaaatagatatgccatttttctattataatgagttgcttacatatttgtcttctcagtcgtattacttaactacttcctttttgaggataaagccagtattctattatttctaaatatttttaaaaaaacatttataaggtagctacttaataaactttaagtggaatattgggaatatcagtatgttttatacctttaatttttggtcatatatatttgtaaattacaaatagtaaatattaaatacatatgcaactgtgcagtacctgtacatatggcaggttctaagttgcctctgacaattccctgaatgacaacagaggtacaattattatacatttttgcttgttctctcaactttatattttatccaaattaagtttattcttattcatctttttattatttgcttttgcactgctcagatggcaattgccttggaactcggtgacagtgtttataatcttaatgtgagtcaataacagtggaaggttatcacaataaatcatagtgggatgcaggcaacgaatcacagatcaattacatctaagaattacagactgtgtctttaagcagggaagaatagtgtcagccactcaatttggaaagggaaataaacacactcagattcctaagagatctacaaacgcactaaacaactgtgaaataggctctgtgaagaatggttgagtgaatagtggtttttagcttgtaaagcaaaaagccaacaaggaacttaagacttttcacatatatgaacaggtattgctcatatgggagtatttcaatgagaacaatattatagcaagtagaatttaaaaaaaagattttagacttacatgagtattaggaaaatgctagtgatagcctacagttccacactagttaaaaaaaattaagttgaggtcaagattatttaatccattgattaactgttcactcaggatttgtgactctgcaaggccaggtgcaatttttatcttatattttaaatatttgggaggtcaattttttatatcagaaaacaagctagttccccaaggtattttgtaatttaaaaattgtatgaagtaccataacaatattattttgaaaaagttcatttcacatttgcacaaagtccatagttagtatcctttgttatcttattattcttaatggttaccatattaggttggtaaacttagttggccccaggtaattagatgattgaagctacaggggataaatatgagttttaatccattaatattttgggctttgatttctacatacataagatgagaagcggattggaggatcttaacttactcttctgctaaatttctagtgtttcctgagttttttatgtcctgattttgatgcaaatgaagcaggcatgcagccagtagggggagtcctgatcttatcccccaaattatacaacctcatataagttggcacacaactgtaagtaatctgattgctttattttataccattccaaaagcatagaaaagacacatttaggccgggcgcggtggctcacgcctgtaatcccagcactttgggaggccgaggcgggtggatcatgaggtcaggagatcgagaccatcctggctaacaaggtgaaaccccgtctctaactaaaaatacaaaaaattagccgggcgtggtggcgggcgcctgtagtcccagctactcgggaggctgaggcaggagaacggcgtgaacccgggaagcggagcttgcagtgagccgagattgcgccactgcagtccgcagtccggcctgggcgacagagcgagactccgtctcaaaaaaaaaaaaaaagaaagaaaagacacatttatacacagtttttaaaaagtaaaaaatttagaaatgtattatgctgtaaaatatatctatctaatggtataaaataatactgtttaaaattagcgttttcatttaatcttcaacgggattagctgctagtaccaacgccactctgaagcagaatccaattctctaatctgtaaacaacagtaaaggaaaaaattttggctaaaattagacacacacagatggtattcctatattctgtgctttcatatgtaacacctgcttcaatctgtactcaaaaccactcaggaaaaaataaaatctctgcatttatttactcgaaaaaataatttttctattgacttatttaaaaataaaataattggtgatgttatatttgattttatggacacacacacacaaagccttttttattttgatccctgttttactccactggtactacacaggctcgctcacaatatttttccattttaatttcatttatgtattaaaaattgcttaaatacgtatatgtatataaatgcacacagcccaacactttcagcttacattatatgtgtatatatatttatataaatacacatatatacatttacatatgaaataaagatgtttattaattaactttactggtattttgaaattttgtctacctttttgggttaataattttccttcaatgttactaacatgaaaaatgggaaaggaccttagaatttgtcacttttgagtcattaaaagatacaaaaacctagggtatttatcacatatttaaagcatcacatgaagttgctaaaagagctgaaactatgcctaggtcacctgactcacagactaattgatatgcactatgatatattgttccctgtaatctatactactcctttggggagagttgtccatattctttatatctcaatttcagtaaatgtatatgaaagaactacatgacatctcacttctgtgaagccacaatgggagttggtgaattaacatttaactgaatatctctctaaaattcaggtccaattaaatatttttctattaggaggaatatctccaaatttctctctctctctccacatatatctagctatataatatctagatatgggtgcatttaactcaatatcatatctatccatatttacattataatatacttatgtaaagtaaataatgcagagaacaatcatatatatacacactttggcatatgagtatagacacagaaacacatgtatttgaaaaacattacagtctgataattagattatgaaagatattaagaaaaatatacatggcaatgttaagatttaaaataaaaattttaaacctatatgaagaatacattggcatatattccttgcatgtttttgaaatattattttaacgaatgagacaagtttgaattcttattcagaccacagcactcttacccccagcttccttaaattttttctagagataagaaggttggtgctaggaaatactgaaaaatacagaagttcaaatttgtattcctcatctgtcaccctactttcacatacactaatatttaataaatgtgaataaacacattaaaagaaggcatatcagacaagtgaaatctagtgaaatacacatttttggagtaagacattttcacattgtttttcaaatccaacatcgatattacttataatattttgagctcagctgtggaggaattgagggcatttgaaagcattcctaatataactcagcaacagttgtcgctttaattatctaactctccttttgatcttactacttattcaattattctttgtgtacactgccatatgcaccttgttgttaaaaagtaaaaaaaaaaaaaaaaaaaaaaaaaaaaaccaataaaatgaacaccataataccatgaggatctagcatgagtgtaagattaatgctgcctatacctttatccgtggccaagcacttatcattgtaagtgtttgtttttacagttggaagacagcgttctacaagatggcatataaaacaactttttatttgaaagttgtgaccatcactttacccagtataacaaaagagtagaattttatgttatatacagaagtttaccaaaatttctctatggcttttcctcacctacaaaatcaatctcaagataatggtgaaaaacgatgtcattctaagaatggagcatcactgaataatgggacaacataacaggtattctgcctaaggaaatcctcatttgctccccaaatcattgctaatgtagctcacaaaatacagagttgttacaccagaaaagagacttaataacatataatgatgtccatattgctatcagtcagttaacaaacagataccgaatatctactttgtgctaatgtctgccaagagcatatgtctaataagtaaaattcgctttgagtttagactataatttagaagttatttctcccctttccactgaaacgagtaggcaaagttcagaggcagccagtagaaaacacttcaagatggattcaaagccaaagactatttaatacacacacacacacacacacacacacacacacgtgtcatgccgaggaaaataagaaactatcaatactttacgaacagcattgaaatatggaaccctccttaggaatgaagctaagagggaccgttgaaaaatgattattccccagaacaatttgctaattgctgaagagtcagcaattagtattagcgggatttgattttttaaaattctgccaacataaaatcggagtagcttatgtaagactaaaatatgagagaaatgaccgacataaaaattagaagaacagagaaatgaagtaagagcaagccaggataatttggaactagaataatggtttttataattacttaaagaaaacttaaaataagtatcagaagtcttatacaattaattttgtgtatgatattttaattttttaccaaaattttagtcaaaaatggtgctgtgttcttttaatgtcatactggagccctgtctaagacgctcactcaaggttgatttaattatctatatgaatgtaacttttattttgtcaattggcaaattcttatttaagatgaactcaagctcattgttttaatgagatgactcaatgtctttcatgaatctggacatttataaatttgttcatttgaacatagaagataaaatttaattacttttaaaggcaggatatatatatttaaaaagtaggttcctgaagtagacaaatacttccaaatagcctttgaggcataaaagttatttgattgatgtacaaatttctaataattattttttctttaatatgaaatgttaaaacatctttaataatttggtatgtttcttatatgagggtatttaaaagtaaatacatgttcaagaactgtttgtttagtaattcatattttgattcaaataataataacaaaaaatatattttgtagaaaatttgtcatttcattcaaaaactgggaggtgaggggttggaatgtacaagacacttaagagtaggtggcaaattctgtcttctgtcttttctgtattatttatgcgtttgttgtccaaaataaactaatatataaaaaaattgatatccaattttttttaatcctcatcaaaagaaagtttaccactctctctttccagacctggccaggcaggaggcgccatcatgggagttgacacccgccacaaggaccgaaaggttcggcgcaaggagcctaagagccaggatatctacctgaggctgtctgtcggtcaagctgtacaggtttccagcaaaggaaccaactccacattcaaccgggttgtgctgaagaggttgtttatgagtcgcaacaaccggccacctctgcccctttcccggatgatctggaagatgaagcttcctggccgggaaaacaaaacagccgtggttgtgggggccataacggatgacgtgcgggttcaggaggtgcccaaactaaaggtgtgtgcgctgcgcatgaccagccgggcccgcagccacatcttctagggagtggggtggggtgggggtggggcggagcggagcggggcgcggggcaagagcctcacttttcgccagctggcgctggactcccccaagggctgcggcgtcgtccggctctccggtcctccaaagggccgaggggtgtacgccccggaaaccctgcaaaccctacatccgctccaatggccggaagttcgagcgcgcgagagaccgaagggccagccgaggatacaaaaacaaaccgtggagcctaccctcttattaaaaatattttggatgctgaaataaagaagtttaccttcattaacatcattttctttttaaaatacagaaaagaataaattatttcagtatacacatgaagtattccagttgtaaaataatatctgaaagtgatttatctatttcttatcaatttttggagatgctgataagtcaaaagtgaaatctagagaactaacattacagtgcaaattgggagctttcctaggattttgtcttatgtgccagctatctgaaagctgagttttagttcatttgagctatatttttaatccaaagaaggtacacatttcaatttttctacgagtttgtgttagacggtatttataaaacttgcaaatatttatttttacaaacaatagaaactctaattttagcaaagcaccacacttggagttggaccatctgcaattcagttcaatcatgctaactggctttgagatctgtattggggttcaataccattaagcctaaaaataagctttcaacccaaaattattatagcagattgtgttgagtaatgatttatctgccaaaagttatttattcaatactttcaaagtagcacctggatgaaaaaatattaaaatatattttctaaaaaataaacgaggagcacgcctgaaaatggtgtgcttgcttttttggaagattttcaaaatggtcatataagtttggatttaaatggataaactactgagggaatacaataaatacacaaataaataaggctgatacaatgattacagctctttaaatagatttttctggcttctccaaaagttccattatgagattaataataataatataacatagacagaaaacatcattttctactataggcataacccttagaacggcatttattcttggtatgacaattttgctaagcacagtgagtcatttgtgaacttctgaatatggtgtaatgtgaagatcctgtattatgaataggaaattcaactcaaattagcattcacttactcaaaaaatacgtatccaatgcctcctcagtgtcagtcctgtgccaagacctgaatatacgataatgaaacaaacttatgcaaatggtgaaccaaactgacattccttgtttagagatatagtctagttgaggaggtaaatattatataagtaaacattttaattatatattgtggtaagttatataaagaaaagaatagtatttaatcctcagaggatagggtagatagtagttttacgttatagtggacaagaaaggcattttagaataagagatgtgtttttgaaatttatagaaagagaagaaggcagccatgcagcgaacctaaaaagagccttgtttgtagaggaaatttgtatgagaatgtctacgtgcaagaatgtttgctgctttaatgcagtggatttcagctaggggagatattgccactccccaccatgggaaatttggcaatggctgaaaacaattttgattgtcacactgaagtgtgtgtgtgtgtgtgtgtgtgtgtgtgattaatactggcatctagtggatagaggctagaaatactgctaaacattcttcagtgcagaagacagctcttcataagaagctaaacttgagaaaccctactttaaagaaattgaaagaagtgcaatgtgccccaaagcacaatgttacaaaatgaaattgaggaggtagaaagggatcatgaaggagcttgtagtccatgacaagaagtttggattccattctgtgaaaaactgtgtattatcattaggttttaagtgagatactaataacacttcatttacattttaaaaatcattactctgggaaatagtgggttaatgaaaaggggtcttttattttctacagtaggaatattttagtgtagtcaaaaggagaagtaaattataatgaacatgaacccatttgggtaaacaaaccatgctattattgtcttttgcatggaattttaaaaaaacttgcatattaactcttgctaaaaagggatttttctgagaattaaaaaaaacacacacacacattctgagtattttgtggataacataatagtataaaataaaactaaatacaacagttccagtaaggaagatataataatattccacaaggcatataaccattgcaaatttatttgttctaggaagaaggcaataaaaatgaagtgaactggttgaaacagacagtggaggcagaccatgaagactaagtgataggttggatgtgtagcctaagaagaaggactggtcagtaatacctcacagatttttagctctagcacctaagcagataaggtatcagtaataaaaatagaaagaaagtggctataaaagaatgtggctgcaatggatctcatatcttcagcttctccagccccctttgtaattcaattacattttattttacttggaaattaatctaataatataatatctgtgtactttttaatctttgaacaaagttgagatttattttatagctacaaaacagaaaacaatgactatatttcagtagccttatatatgcaggaaaatctataaatatgcatcattaaatagaaactatacattgtttttgcactagagtacacccttcctgtttatcagattcctgttttatgaaagctatcttacagctctgcaagttgtggaaaattgatagcaatgcaaactaattcctgtcttgtcacatgcaaatttgatcttgtccagtagatgtttatttaattcacttcccacctcactgttgaaaaaggcaaacttgcccccatttgcatattcatttcaatattcatgatccgtactgtgtctgctctttgaaaggttcttttttttaaccagctataacatccgtggggttccctcattaattaatgagtaaataaactgtttaacatgttcattttgatatttccattagagttgtaattttaccttttgttgaaaattttgctttcacaggtttatcttataacattctaatttaacaggacacttcttttcaattaacttcaagttgcttatcatcacatcatgaaatttttcaaactaaggtatgaataaaacaatagtcgaaaactccctatctctgaacgatattttcctgaatatattaccagaatatttacatataaaagctgcatgtgtgtttccttttttcaaatttagaaaaaaaagaaagaattagaaaaatatgaactactgtaaatgccctttattgaaatggatctgaatatagactaatgtttccacaacttgcagataaataaataactattgccactttcccaaagactgacaatgaacatcaaccacaatttactaacacatccaaactcaaaaccaaactgcttgaacaataaccttccataataacacaaaaatgactttaaactatgcctatattctgtttctcaagcaaatagatatttaaagcaattaatttttgacttatgtcgtcaccaaatgaaggttcccttttgcccaaggaatgctttatagtctcctgctgtctttgatatgtgccactcggagaccagatgcttttcagaatatgtgatgtggccagaaaaccatgtcctgatgtgctgcagtctgaaggaaaacaaataaaccaaaagaaaaaaaaatgaataaaaagaaaagaaagagaaaaaggcaaacctcagaagactgcttctcacttcttccctcaggccttttccaggcagtcagctctttcagctaggaatagatccaaatcccgtctccatatataaatgccaagctcgcacaatgtttcttgacttcaaaaatagatgtttctcttcaataaagttgtcgaattattttagaagatttttttctttatttgacaaaactggtatgaatttatcactacaggtaagctaaagtagtttcccaggtgcaagtggaaagagaaacacaaattaaatgattttcatagaataattaaagtgtgagggaaataatttatataacatatttggggattacaaggggttctgcaaaatgaagcatttatatatgaagaagaaattaatgaaaatgaagactatccaagaagcagaaacagatctaggtttttaaaggcctgaagtttattcttttggggatctaactctaagaaaaagaatgcaaaattgaaaaaagaagattactaatgtccattcagagtttttgaagggcttgagcaaatgcaaggctccaaagcttaaacttcattagaataaatctacctcttttgaagaaaaaaacctcattttaatgcgctgtccaattttttatttattaagcaaacattcaaaacactttaatgcccatggtatggtagtttctagggatacggtgatgaagaaaacaaaaggtacatgtcccttgcatggccttggagggtaagaaacacattaataagataatcaaatggccaattcaataaaggaggtaaaatatgattttataaaagaggccataagtaaaaaatttaggaaatacagtatacaaagcataaagaaaataactcataatcccaccatacagagataacctatgctactattttaaaatactcatttctattttagttttgcccattcacaaatagataactttggaattcttatgactatatcatgtattcagatttatatttgtttattttatttacattagcatctctaaaaattaatgtttaatatctaattacagttaattgaacaaaatttgtttaaatatctcaatattgcttgagaatttctgcttaaaacatttactcttatagatattaccataaaaaacattttgggctgcatatctgaacatctgcttagagtcctagatgtggaattgtttttacaaaattataattctttaaagtatataaagatattttgtatgcattgataaattattctttaaaaacgttgtgcttactaagattctaagaataattaagacaatgttaatttcacagcatcctcattagcattagttgttatgatttttaaatacttaaaacttgataatcaaaaatcttattacagttttgctttaccaacatttacttaatttgagttcacaataagtgatgagtcagtcttttttatttttagttttttgtacttctttagtagttatccattttagtcctttatcattttggtgggtgatttttctctttttcatttttgtaatacttttgtaaaaaataactaagtggattatagcataattaaggtactttaacttagtaattttcttctgaacattaataccatctaccaaaatgcagaatcagagagtaatcttgaatgaggaaatcctgtgagtctatattagaagtctcataaactttgtgattctattaagcatatggttactagtcacttccgcacaagaattttaaaacagttggccaggcgtggtggctcatgcctgtaatcccagcactttgggaggctgaggtgagaggatcacttgaggtcaggagttccacaccaggcctggacaacatgatgaaaccccgtctctactaaaaatacaaaaattagccagatgtggtggaccagtcctgtaatcccagctacttgggaggctgaggcaggagaatcccttgaacatggcaagtggaggttgcagtgagctgagatcgtgccactgcactccagcctgggaaacagaacaagactctgtctcaaaataaataaataaataaaagtaataaataaacagttgttaaacactctagaatttcacagaggatagatttttaaggaaatgagaaaatctgttaaagcatgggttaagatgaggaggaggaatggacactgcagagagggaatagcacttaggcacagagggagaaatgaaagaacgtaagtcttaaggagttcaagtagctgtgtactgcaaaagagtaggggaattaggaaagttgatgcataaaagtggagagatgggcagggatgggatcagtttaaataataagaggattaagcaaggtagttacctgtgcaaatctgtgctgtagaatgatatatttcatagtatcaaagagagttttaacaaagaaacataaagggacacacatatttctactaacatagtccttattacagctgtagactctaacacaggcatcactagtagaagtggaaatggagagatgcacatttgaaaaagacagttgaggagcctggttgagtggaaagaggcaaaaagcagacacatctggtctataaagataggagcacaattcagaaagataagggctctgagaatataaagtttggagagacacaatgaggttcattttgatgatgtcgattttcagtgcctgcagatcatccaggtagtaatatgcactaagtagtgattttagggttttcagaaaattggcttctggtaattgacttttgaattatttattacagttcagcaagcttctcgaaattaaattgtttgcaccacaggggcagtttttcacaggctgatcactcctgtgttttattatcagtaattctggatctgtatcctttttattccaactctggtttcctttattcaaatgctgcttgtctccaccagctgggtgaccacaccttctcacttggtccctctgatttcaagtgcaccccctaccaaaacattctccaactgtggctaaagcaacttatctaatgcatacgatttaagattaactacattattatttcttacggactttagaaaacaacctggaatacacaaatttatagggtgtgttcatcttacctcttaatattcatcttttaccccaaattcccaccatacttaaaaacctgtcttgatactttagctcatgtcccctccttaaagctgaaatacgaatcttttgtcatagtctataataattattgacttctctctcttctctactaactgaagtattctcaagaaaatatcttgtttatcttaacacttagaaaccctagcacctaactctgtgtctgacatttggagggcactcaaaatatgtttaataaatgaattctgtttcctctaagagaaagcactattcattattgaagaagatttctgatggaaatctatatagtgtatcagtcaggatccagacaggaagacaaaaaacatactaagtgtttcaatagaaagaacgtatgtttagaagctgctaaaggataaataaagtgaaacactgaggtgtcagataggaaataacagcagcttccatctctagagctggagaaacaaaggcaaacgtttgggtctatagaaggcataggttcgctgaaaggatcccaaagatctgagacccagttctcaaaaaacagggaatcactcatctcattgtagtacatctgagaaggcataaggaggctgttttgaaaagtgctacaagaatctggagaattgaataaaaatccacactggagcttcactgccagtaaaaacaaagcaagaatacaggaacacaggaaaatgccagggttttctctcctcctttttctttctgtctgctttctaccaccccttacttgtggaacccagtggaaagtcacctgacaaagaataaattgagtttgcagagtcccagcctgggcacccaaaacagagtctaaatttgttttgttttgttagtccctaaaatcaaaatagatggatacatttgaagtttagtgaatagcttaataaccagaatatgcataatgataatgcaatatgataatgaaagacaggagttatcagcctgtgaaaaactgctcatctggttcaaacaatttaattttgggaaacttgttgaactctaatacataattcaaaagtcaattaccaggagtcaattttctgaaaaccctaaaatcctaaaaccctaacatcactacttagtacatattcctgcctgaatgatctgcaggcactgaaagtagacatgatcaaaatgaacctcattgtgtctcttcaaactttgtattctcagagccttaaaactttaccctaataccctaataagaaaaataaatgagcattccggacaaataaaaaccacaatcattcacaataaaataaacacaaaaatgaaacgatttaccaatgtcctaaaacattaaagacagatcttgcttatgtctagtcattatgatgtaatgtgtcaaagaaaaatgagctcactgaatccatacatgcaccttgaatggtgtgccaggtctcaacactgattgggaatacattaccaagtagaggtgctgaataaaccttgcgctgatttcacataatggctttgactaacattttttggcattgactcttcttgtgggaacaaaagtgtcaaatataagtctgcaccccagggaatatgtcagagctggggattgaatttgtggattcttcaacatttatgtaaaactatggaagagggtaaaatctcctaagggaattcgtaagaaaagataaaatacccaaggtggtacttgagaagcaataatatttaaagtttatggcagggatggagagagaaaagaagaaattggaaaacactaagacacaattcagaaaagatgctatcacattgtggttttaatttgctttttattaaaattcaattgaacattttcctcatctttagaggtcatttttatatgaaaattatctatttacgtgcattaaattttatttggggacattcatgtttttcttttagacatttgtatgaaccattaaatataaagttgagatagtcaaatagtagaaaatctttagtgacatcattcttactgttcctctgaaacagccttgaattttagttgcagtttaagaaatattgtgccaaaaatacaaaatgttttggaaaagcccaaatatatggaaatgcaggagaagatgtgccagtgttctctttagctcttccctcccttgccttttttattttggtaggcagaatccaaatatagtgtttaagagtgggggtagtagatgtctgtaaagatgacttcctggatttcaatctcattttgaccatttacaagctgtgggctcctgagcaaattatgtgttttctctgtgactcactttccttttctctaaaatgaagacgaaaatatatgtcactaagtaaggtgattttgaatatgaattagttgatgcataaagacaatttagatcactacatgcacataggaaacatctaataaataagaacttttacatttagtcatccctgcactctttttgactagcacaatactggcatattctgttagaattgatctctctctctctctctgtcagtgtatttttaaaaaatcatatttcacaagcaagaaagccaaagcctaaagatactgatattttaacccccaaagcaacaaatggggactcaatggcaatcatagcaattagactacattcaccaatcttcttaaaaatgtgatccacagaccactacatcagaataaactgcagtggttattaaataagattactgagcctcacttagttttaccgaaaacaatcaatttggattaagcccaaaaatttcattgcaaactattacttcaaatgtttctcaagcacactaaatcagaaagtcattgtgccgaagaaaatatgatccaaaatttacacgaaagagtggcatgaaagaagagagcttcccgcaatggcaatataaagcatatacattataaagcatttcagatttttaaaactaaacctgggaaaatgatctttttgagcaagaaagccaaggaacattttgaattggcagtgttcctatatataagaccatcctgttgcctcttaaaaaagattaaaaacaaatgaaatgatggtttagattgtgaaattcaaattattttttaatcattaattgcatacatacttgctggtttcattgttaaggatccaacagtgttggaggaatgaagacagaaatttcttccatcattttagtatagttacatcacaataagtgacctcatatgaatgagactggaatgagataatgtctgtaaaactttttgtaaactgtaaaatgtaataggctgataaatgacttttacgaatacagcagtaattctatatcacttgtccaatttatacaagcctttaataatcagcatatacattaggaagctactgtctttcaagtaccacatgaggcaatgaaggaacaaagataaataagataaaatccatactttcgaagtattcataataaattttatgattgcagtgaagaacagaaacaaggggactttaaatcctcttagaggaagtaaaatatgtatgggaggttggagaggacctcaaaatgcaaatgtagacagactttaaaaggagaatccagaagaagcagaagaaggaatttaaaaggaggatccagaaagaaaaagaacatgacaatgattggcagaaaagggggatgaggaacaagaagggaaaaagaagaggaagtaaaaaggaagagaaagataatgaaacaaagcaaaagcatttggattagcaacaatatagatgcagctgctaacatgtagttcttactaagtgtggaaaactaatctaaatgtattactgtcattttctcatgttatccccacatctcatctaaatactcttaatttgacacctaatactgtagttgaacaattgaatgggaaactggacagaagaacagtatcagggagaagaaccagaagcatattatattgtggcatattcatctagtcctgttgaaccagatatcccgctatgttttggggagggttaaagataagcctgaataggccagaaagggatgcattaatttattcattccaccagtatttgattatctttatatgctatgctaaggtatataggtaacacagagctaaaatataagatttttcatagcggacatcccataatcagatttgtatttcatgtgcaggattaagatgaggcaagagacaaacataatagttcccatgaaaaatagtatcagcatgaagtaaaaagtggcaatggaatataatggagatataggatattaattaattcaagggagaaaatgaggaagagaaaccagatatttagagtagatgaatgaataatacattgtggtactatctcctgaaaaaaaaatttaaaacagaagataattaatttgctttttacctttgaccatctgatttgtcacgtagcccattaaattggagttatttagtaccttttttagccatttgattgaatttgaccaacatctttaatttttaaaaaatttttgtttgcagcaattaaaccaacgtctggcacttagttggtcaccacacatggtagttatattgaactgaatatttgtactatatttcttacaagagaccaccaagctaaaaaattcccataaaaaattcaatctaaagaaaaacatttacattgttacagttgctaaggttcttaatttaccagcatacattcctttaagaaaagatatcttcagctatttgaattgcgcttttcacaattttagctttactgatttctatttcaaaaatatttttagcaaacagatattagctactgagtcaaatttggtaatcaaataaaatacctgcttatcatgagcctctaaagcaccatgggaataattaaaacatgagtgtaagagcgctggaagtttttgagttacagatgcttttgaggacatagcaaatactctttctcttctctttttctacctctacctcattactgggtaatatttgtaaaaataagatgtaaaatgacatcttacaacaaagtttttaataaaatataaaatgtctactgggattcatagtcagtttgtgtgactcagtatgatgaaaatctactcacctgtggctaattcccactgttaacagcatggaatagaccaagaacacatattcaggacaaaaggaatattctcttgcactttaaattgaatactttaaacacaaactttattatttctcataaggaaatttatcctctttatgttcttcctaaattagtaaaattacaatccaatctctaaagctaaaaacaataaaaacaacaaaaacaaaaccacaaaaaacttgggccctcagtttgctctctttattccccaccatcagtttatcctcttatctttcccacaaaatattaatgtaaaaatagagcaattacaaaaaaagtggctaatgtattgaagacttttgatgtgccatatattgacctaagcatttctatgcatatcattttattgtcatcattaaaacaatctctggggtagaaatttacactgtctttactctgcccttgaagaaactaaattgtaaaaagtttatgtaacttgcccaaggacacacatgttttcaaagtcaaattgtctgaatttaaattcaggctgattcaccatatgctagctgtttgatcctggaagaattacttaatcaatttaagacctagagtgacaaactatctcagtttatacaggactgaggggtttccccaaacaggatttttaatgctaaaattgagatggtcctgggacaaatgattacccttccctctttgaaaagtgagcacagtaaaagtgcccacctttaaggattcttatgaatattaaatgatactatatagcatttagcatagtgactgactcagtatttaataactgaattctttctgacattattgctattattttctgtttcattttctttatcctagactccattgttatactgcattgtgtgtattattgcccaggttattttataaaacccagactgatagtgtcacacttgctaaaaatgtgatgactccacattgtcaatttaacaaagtatttactatggaatataagattctctccattctttccacttatagtgaacttttttgagacaatacatgaggtggacacagggcaagttccctgggcttatttatttctatcctctgaatcttacatctgctttttctttcaaatctgttactgtccccagcctgtacacccaacatatcaatgccaaaacaatctccatgcagtatttcactgacccaggagatttcctttctgtagaattttctctcctaacttcttaaattgaagaaatatttttatactttaggacccaggtatacatttcctctgtggaacattttctaaaatttgaaaataaatttactggacttcctgattatcttcattacagagtacatcacatttttaattaattaattaattagtttattctatttcttccatcactaggttgtgaactccttcagaagttttcatgatattttgtaattacagaaaatatcactcctctaaagatcagtaaaatcaatagattaacaagggaacgctttgtcttattatcttttatatttacagctgttcagccaagggtctaacacttaaaaaggaactgacaattcttcaagaataagtgactaaatgaaggaatgaatgatgtgtttaaataggcactgtattttggcattgttctctgatgagtttacacatttattctaatcatacttttatttctcaaaatgtatcatggaaagtatctggaacctatttcagaccctacatcttgaaaaccttagaagaaatcagcttatgcctgcaaaataacatttctaactgttatctcaatatgaaaacctcatatttggagaggcagaagaaagatgcttcatgttgtcaacagcactgggaaagcaccttgatttatcagaagtcgacaaggcactggagaaatagaaactgcaaatgggtgcaaagaatactggcaaagaaatgctggcaaactctcgcatatcccattagaattatatgaagtgaatttagtatgtacatggttacatagattcaccaaaaatatcttcaaatattaagattaagaaactaggtaggaaagatccatgttcaagtgaaacaaaagttgacctagatggaggaactaagaataggcactacttacacacatttcaagtagtcagatactctaagtgtttctcaaattggtttagtataataaaacattgtagtaattagaaaagcaaatcaaatatgtgtagatgctcctgttggtttcccatggtggtaacatgggataattagtttgtatatgagattttgaatacatttctaacaaagttccgtgggtttagaagtaattatttgtattagaacagcaatgtcataactgtgacaatgcatagcattaagaaattatggaaagttatacctagttttggggatgttttaattagtaaatagatctcttgattaaatctgaagttttatttaataaaaacataaaatactgcgtaatggtcctggaattataaaataaggacctactatgaatgtcagatgtgagaatgaatagagaattaaatatgtgtgagaagatgcaattgacagaactggatgtggagtttaagcaagagaaataatttaaaaggaggatctagaaagaaaaagaacatggcaatgattgctagaagaaggggatgaagaactagaggggctagaagggaaaaagaagaggaagtaaaaaggaagagaaagataatgaaacaaagcaaaagcattctgattagcagcaatatagatgcagctgctaacatgtagtgtgcttactaagtgtggaaagctagtctacatgcattactgtaattttctcatgttatccccacatctcacctaaatactcttaatttgacccttatagtagaaaatagactcagaggaatcacatgcttaatgattgacaaaaccagtactcaaagtctttcttgaaaccactgtaaaaacaacaaattatcattagttttgagagtaaattacaaagaatttttgtttaaggtgctgttggtccacattatagaataaagtattggatcctgatccacagacaatacataattgtataaattataattattaaataggtaaatgtttcttacaccaaatcaataaagtgtgctgatgcatttcccctctgttgcttaggagttgacaggagagtgggcacaggacaagaagaaggaatagacagatgtatgtgccctaaataattatggggaagtggctacgattcagacacaatttagcctgatgcctgtgcagtggctatgggagttctctctgataccacatatattaatttatttaatcttatcaaccactgtatcagatattcattactattatcttcactttatagatggggaaatgagcaaagaaagcctaaataacttaaccaaggtcaaagctaggagagaagatttggctctgaattcctcatcattaatctgaataatacactgattctagaataatatggatattagattctcaactattagagaatgagtacaaaacacattaattcaatcttatcactgtaatgatttattttttcaacaaatatttaggaaatgattcaagagtgatgaatctaatattttatgttataatttatgaagaactttcatatatattatcttcaatggtcatcactaagaaccaacagtcaaaagcaaggagacagcaactgaggaagaaaattgcttatagtttcatgaattgatgaggactttatactccttccaatgcacactaaatatactcttctctctgcatgtgtctatatatatatatatgtgtgtgtgtgtgtgtgtatatacatatgtatatatatatatacacatgtgtttttttacatatatataaaaccatgtatgtttgtatattttctgatttatggcacaatttactcttttgttgttataacatataatgctcacataagcatgcttcaaaactactcctctttcctttccatctagagtgagaaaaagcctcatgtcctatactttattactgtacaccataaaatataaagagaatgttatatttggtagatactgtggataatttgaaatttttggcaaccaacattttgaaagctaattagataaggtcttttgatctcctgtttactgcaaaacactcaagaagccattgaggctcaaaaactgcacagaaaatgaattctgaagatataaaagtaacttattagaaggaaacaaataaacattttttaaaaacttaacccactctttagactgaaagaagcacttaacctgaaaacaaaatggagctggagaagtcatgatgaacatatttcatgataaggtacctgccatttccacttcaatacagtggaaataaattgaagtgcagtcttctcaaagttacaatggacaaacggtgctactaacaaatcaccaattctcgttaagttactggagaaggaaaatgagaaaggtgcacactagtttcaccggtggtacaattttgtgtagttccaaggttaacaaacacaacttggaagcatgcatacattataacagataacaaaaatagttttatttgtgttaactcttctacacatggacattggaaggaactcatggttggagactcttcatggtcaggaaatctatcattttgctccttaattttattttttataaaaatcctgtaatataaaatttaacttttgggaagcctttttctctgtatctatgtgaaaaaaagagaagaatttataggatcccacatttgtaggataaaataaaataatatatctttaagtatgttataaaacacctatatgcttaattttataaagtgaggtttagtataatgatggatacttgcagcttaaagtagactgagaacgtatagagtctgcattctgaagtttattttgcccccaaatagcttgttggcaagtacaagtatagtctagcatttttataactgggtactaaaaaaactctaataatttgttgaattacacacacacacacacacacacacacacacacaaggggtttaatggtaaacatacttgggaaattctgagttaaagttaaacaggattactgtttccagtaatgtttggaatctctaatatatgtacatgcactgtgaatttccaaagagaagggaaatattatatcgaatgtttctaaaatatatttttcatagaaattcttttttactgaatacatattaactttctataccttagaacaaaatttagaaaataccaagtttgtcatttaacccatccaggttgattttatacattttaaatgaaaatatggcctgaaggggaaatttcctaaaaatgctggatcacataccaaagtatcttccactttaaaaaattctagtgctatatttctaaattttcatgaaaatttttacctcttcacaatgtgttttccattttagtgcatcaaaggaaaattataagacaattctacaaaatagtttataaaactttgatctttgatgcttttggactattcaagttaaggagcatttatttgcctaccaagtgaaaagaattttgctagatgacatcaacatgtacatgaaagacatagactctgcattcaagaaattgaatgtattgaaagaaaatttaaaaaaaaaatttaactatgttaagcactataatcaaggtgttaataaggtactaggaaggattttggggaggtttagcctaagatgtgattttgagttttgtcctagaggacgactgagaatttgaaggtgagaagaggaagtgttacaacaaatagagaaaaatcaagacccaagacataggggcatgaaatatcatggtattcttttaaaaatgccataaattacaaggtagtcatatacatttcctttgaatatatccaacgtgatactgttttagtgactatttttttttccagaaatcattatggcttatgcaaataaattaaatttgaaatctagtacaaacataaggaacagttagcattttaagagactaaccatttagtttatgaatctttttctttccacatttataattaataactttaatgaaacagtaatgcttccataatgagatagtgatgcttaggctatcaatgctagtttgactgcctaatctcaaaatttaaaaattggaaatctaaggccggacgcggtggctcacgcctgtaatcccagcactttgggaggctgaggcgggcggatcatgaggtcaggagattgagacccatcctggctaacacagtgaaaccccgtctctactaaaaaatgcaaaaaattagcggggcgtggtggcgggcgtctgtagtcccagctattcgggaggctgaggcaggataatggcgtgaacccgggaggcggagcttgcagtgagctgagatcgcgccactgcactccagcctgggtaaccgagtgagactccgtctcaaaaaaaaaaaaaaaaaaattggaaatctaaaatttgaaagcataaaatgatatatgaaggaaagtattttattgttttagcaactatttctgtgtaaccattatagatgttaaatttcctggcatttaactttctctaattacagagccttctgccatcgttgctgctccctgatcttgtacctttgctaaataaacgtttactttctgttgttttatttgaaattaccttaaattagtaattatttcttttaaccatgttctaatactatgaagatccttttcttttctaagaaaattcagtggtaactgattcctgagaaagaagccagctttgatatcatccattccttctctcctgccaacagtaacaattgattttcttcctcccaaattgaaatcagtgaggagaggagctccaaatgacaatcgatgtccatttcactaaccatgtcatagttaattaaattaactatgctatatttacttcctctaaaaaaactctctaaggaatgacttgagaaaggatttaattatgctttaaatgcacctcatagtgctcagattttgtagcaaaatatgattcccattggggatcatttattaagtaatgacataatattatgaagttcttaggtgaaccagaagacttgtattctacatgagaactgtggataatacatgtaactgagtggtaaactgtgtacaatgaaaacatacttaaccacttcagttagtatttctaagtgtcccaaagcaatctcaaagttttaataaggcatttactggagtacaactaataagggtaagtgtttctccatgttccaaggtaccagtcctattaaatgtagatttgagttttgacttccactctagtatagaggatgttaacttacattccatttattcagcaactttttgtcatctgaagtatataaaaattgactagtgaataaatttgggggtaatttgtcttttttttacatagactgaaaaatcctcaagtgctaagatattgtatgtctttatatctcagtacttttgagtaaatgttttaaacagttgattaattcgtaccaaagtagaatatccaaagaaatagtctctctttaagggagcaacacagaagattcctgtaactgtggtataaattgtctaacacataaaacataagttccataattcctgtataatcacagtttattcatttataacacatcactaccagatatattatttatttattacttatttattttctgcctatctctgcaacctaaaatacaagctatataacagggattttgtcttcttcactattttattcccagcacatagaacagtacctgacacataaaaggtactgttgaagttgaaagaatatttgttgaaatattttgaaagaatatttattttaagtataaacgaatgaatgttggaaagaagataatgcctattttaagtttctataggaactggaaaattttccctccaaaatgttaaattaatttatacccttgtcaatttggtatgataacacactatgccttacaaactagcctaatggtagattttaccaatttcgttaaattttgttaatctgaatggtaaaaggtatctccatctttaaatttgtttttttccagactgttaataaaatggagcaacttttcatgtgttatgtaaacatttacgtttcttctttatggtctctttaaattcattatctattttcctattgagctgttggtatttgtctaatgtttttgtcttaatcttattaatttataggaattccttctagcccacttgtgcgttacagtgttacaaaggttttccttcaatatggcttttaaaatttaatatatgttatattttgaatctctaatacttctggaaataaggtgttgggaaaagaacaaagactgtgggccgggcgcggtggctcaggctaatcccagcactttgggaggccgaggcgggggaacacgaggtcaggagatcaagaccatcctggctaacacggtgaaaccccgtctctagtaaaaatacaaaaaaaattagccggacatcgtggcgggctcctgtagtcccagctactcgggaggctgaggcaggagaatggcgtgaacccggtaggcggagcttgcagtgagctgagatcaccctactgcactccagcctggacgcgaaggagcgagagtccgtctcaaaaataaataaataaataaataaataaataaataaataaataaataaagaacacagactctggaaataaatagacagctgagttcaaacagcaggttttgcttgaatattatgtggccctaagcaagctagttaattgtgcctccattttttcatctgtataatgggaataattttagaactttcacaaataaagttgtgaacattaagtgagtttgagcagtgtaggtacatagtgaatgctcgatagcgttaaccattgttatctattaatccaggagttgatatattggaaactctccccatccccaagattgtaaaatgtttttctgtattttcttgtagtaattttatacttttattcttcacatttggcttattaatccatctgaaatttattttgcttaaggtatgaaataattatattaattttcttttcccaagtggatatccaattgtcccaaagctatttaatgacgtaccagtctttctccactgacaggaaatgacacctcacaggtgtatatctggattctctattctgtttcactgtcctatgtatcattattgcatcagtgacacagtttaattactgtaacactatagtgtaatatctggaaaagcaaatccctagtttatttttacttttcagaatattcctgccaacacatgaaagttgatcctccaaaagaattgtcgacatcccaaaaaatcccattgctatttttattgatatgccattacatttatagatgagttgggaagaaatggcacttttccactaatgttattttcatctaggacatcatgtactgcttcactcattctgcattactttactgttcttctaaaattgtgcttattattagcattgttcaatacagtaattttcagtatgcaaaccactaactttgtgtccctacagcacttcagatatgtgggaatatagaactcactattttccagccatgattgcttcagctgggtcaaatttagataaaaatattttctgatcctaaaagaattgcataaatttaagcttggaagccatgaagagtaagtggaaaaatggtgatgaaactgagtgatgctgggggatgagaggaagttgagggacaaggcctgtgtttgaaccttaaagatgatctcaaaaattgtcttgtgcatattcctctttgttgcaggaaaaaaaggaggaagttttgcatcattagtaattagggaaggtaaaatcaaaaccatacccacaaggatagttcatatatatatatatatatatatatatatacacacacacacacacactatatatgtgtgtgtatatatacagtaattttcatatatatatatacctatatataaaacaagtattggcaagaatgtggagggattattccccatgtttattgctaagaggaatgtaaattggtaaagccagtttgacaattcctcaaaaagttaatcataaagctactctatgacaaacaattcaactcctaactatagatcccagagaaataaaaatatacattcacagaaaacctcgtatgcaaacttcttaacagcactgttataacagccaaaaagtagaaccatccaaatgttcattaactgacaaatgtctaaataaatgttatttgccacaagaagatcccaaagtactgatatatgctgcaacatggttgaacctggaaaacggtttgctaaatgaaaaaaaaaaagttacaaaagattatatattttatgtgtctctacaaaaattttcagaatagacaacatatagagataaaaaaatagaatagcagcttcctggggctggaagagggtgaggggaggatcgtgagtgaattctaatagatacagagtttctttgatgtgtgtgttgtgggggagaatacaaaatgttttaaaattagattgtggagatgactgtacaacccctccatatactcagatactgaattgtgcattttaaaggtttgcattgaatggtatgtgaattatactttaatctgtttttttaaaattaaggattcatattttagatacaatgaaaagtgatttatactcctttccatatattgttgattatttgtattggctagaattatatttacctctattctgtgtatatatatatatatgtatacatatatatcacttttggttagattttaaataacaacttatgggaatgttatgaaaggcaatggtgacagagtcttagctttgtttaaaatttgcagcaatatccctatttagattagccaagtttgtatgcaatattaactttccagatttaaaaatgttcattagtaaataaattgcataaaaagtaaaagttttagccagttcattcacaaaaaatgaaatttcccatttcaaatggtatccagctataaagttgtgatctggctccttcatattacttgtaaatcccagaaaaacataaaattcacaaaaacaattctgatattgatgatcagcatctttaaatgttccagaatttaacagtctccacctccccctgccccatccctcgtggctaatactagggacgcagaataaatctgctaagctaaaaggaggacattacatttttcccccattgttttttgcactaatctaaaaaatggagtgattatatttaaaaactgctatgatacttttaatatattttggacactactttttaaagcagcctgagtgctacagacgttcttcaatgttttcaccatatatattttcagatttcagctacagggggaaaaaataattaacatggccaaaaagaagagatgtgaatggattggatagcaatagctatccaattatttcatgaggatattgtctctgtaagttaagcattgatatgagtacaaacatggaaataaatcaaatagaaggaaatgttgagttttagagctttaccacatatttaagcgtggtacaaacccaggaattacaggctcaaaatggttaaatagagctcccctaaacaattactttgtatatcctgaaaattgggtagagttatatcatcttttatttattggttggagagtatttataattattaagtttgattggaacaagtttaatcctacatgttctgtcagttaaaaggtaacaaatgttaacatatttcaagtaattgagagataaagaaactaaatagtgtaggctctatgtaacacattgtaaaacagtagaaatataatgttaccctaaccatttagagaagagcagacaatgaagataaaaagaaaaaatacatacaaacatcctgacatctcaattaagatagaagccaaggaacactgttagaaatattaacagaaggcatgcctgatttggatggagcattgaaataaacatctgcttagatctttttcaattctcaaatatcataattctatgaaaggtatttcctttataatacatggttaacaatttgggttgagcagattccaagagataaattaaagaaagaacagataactcgctataaaaataagtttattccaaagtgtccagtatttatttttgattaaacttttaaaatgtgttggttttatttaaattttatagtcattgatgataaaatttaggtaaagggcatttaaattgtacacgcttttagggaaaaaagagatttcccatcaatatacataagtgggtagttcgcctacatttcacatattgtcactatgttaagtgatccaaatgccaatgccaacttttttatagtttctgtatttaaaaataaaatttcaatctatgtatttttaagatatttacttttatgcttccaaagttctagtaaaataaaatttttagatgtagttaaagttaacatagacagcattttaaaatactttgttatacaatcatggactgcataacaatatttctatcaatgaccacatatatacctgtagtcacatgttattataatgtcatatttttctgtaccttttctatgtataaatatgtttagatacacaaatacttatgtgttacaattgcctgtagtgttcagtacatgctgtacaagtttttggcctagaaacagtaggctacaccacacagtatagatgtagagtataatatctaggtttgtgtaattatattccatgatgttcacacaatgaataaatcatcaaaaacacatttctctgaatgtgtccccatctttaaatggtgcatgactgtatatgtaaattcctgtaaaggtttttactaaacacatcacagaccattaggaaagaattgtctttgcttcagggagctagctccttgtgatttcatccctttataacatcttttgagtcactatcttaaatttttcttttatcttaaattttttatcttttatcttaaattttttcatttgacagctgttttcatcaccaaggattattaattttcatcatcaaatttgactcaaaatttactgccacagtaagatgatactaatttgagtttgactgtcttgagcattgagagactagtttctgaagcaacctgaatctcttggcaaaatatgttatactttgatttataaataaataaatcaaactactttctttaaaatgcagatcttcataacaccaaggtttatgtaccaagcaatgatgttgcacaaaaatccccaaagggtatatctgtaccttctgtgagtatggcaagttaggtgtttaggatataatgtccccgaatttaaaaatctattgaggaaatgcattaatacaagtgtaaacttctggcctaatcttatttaatatcatcatcatcatgattattattctcaatattgtcagttttctctcttataggggagcttaaaggaaatatatttttcaaagttttctcattttgactctgaaaagctttgacatctctcagatgcacacatgcattattaatattaaaatataagtaactttaaagaagaaaggtaagatattagtataaggagttaagcatattatttcaatagtaaataatttattaggaaacaaaataacaagagtatgccgtagtaaaatatttctcttaagtagatgatttattttttatagtgtacctttttcagggaacatgttttggttctgaacattaagttataaatcaagtgcactattggcttcaagacagaatagagtaactgtccaagcatcaaatacaattgcaccctctgaatgtaaagaccaatttttcagtccttactctgacaaaactatctttagaatcagtgggagttcctactaaactagaaatgaattggatttaataaatccacagctgtgtccgttttagcattactttttcctaggattcatcgtagttttttatatatattttaactaatgaaaaactgcttcatattacaaatatgatgaataattaaacaacaagtgactgattttgacaactgtatttctgaaactcctcttgaaaagataatattactatagcaatacagaacaagggtttgtttcaaaatctaatattttaaagtaggttttctttctgttcctgtggtaccattttatgagtgacttttggatgcaaataaaaagaacctctagtctaagaaatatatttcaactaaattgttgttaaaatgcagaaattttgaaaaggaaaatatatatagaaaatctgtcagtaacaccagggtgaggtttggactcttcccattttctcctcttcttccctttttagagtacattaaaaagaaaaagcagtaataaagcatgattgctttctgtgattatgaaattctaaagggaaagcaatttttgcattagtactgtgaaactccttataaaatatccagtaacagctgttttaaatccatccatagcaaatgtaaaagtaaatacttcttttgaaattatggtgataaaagttcatctcaccaatcaggctacatttcccttctgcaaacatttgtgtgtggctaaaattagaaggcctttttcaactctgcatgatagaatcacattggcttcgatacagagatgtaaaataaagtagttgatgtttcatgtatggccaaatcgtattttatgagtcactcaaatgtaaagttttagtttcactcaagaaggagtgaaaaattcaaccaccaaaatgattccaaaaaccaacttaacaaaatacatatgtggatttgaaacattaataacttccttgaaatgttactttttattaatttcctaattaaaaatgctttctgtagaatctctacagcgaatctggcatatagcacatttcttctgaaatgtaaaaaagtgggcttagaaaattgatctgccttttaaaaatccatagctctatttgtatgtactatatgaataataaaaagtaaaggctgaatacatacagtttattcctaataaaattaatgaaatgcataatatgatataaaataatgcattactgttcactatggcttgatgtataacaggaataaattagacatgctttaagttgtttaaaacaacttaataagcaaagaataaactaaattcataagcataaacatacaatgaataaatggtaggaattttatccagttacaagagaattcgactttaaattccttgaagttaggatatgtctttttctctctctgcctagcacctaattcagtgactaggattcagcaagtcctcaatccatatcttttgttatatagagagagattatatagaataaaaggggaacagctgtattataatataattttaaagtgaaaccctgatattgtctgagcaggatatatgttcattcactcatctattcagcaaacatttttttcttctacacacctgctcctacaaatgtgtgccatttatactatatgtacacagatgtacactcctgtgtatctgagaattaaaatatggcataaccattttaagggggaaaaagataaaggaacacaaaactggaatagcatggcatactactgatagccagagtataattcaattaagaaattattttcctactgcagattaaaaaccaaagaaacaaagtgacacttgtttcatcccttaaaaaatataaattatgtatgtgttatgtgcaagacatggaactactaggtcgtagttatataattaaaacaaaataattctaggtcaaattaagtctatgttgccaaagaggaacttaatttgtctagatatgctaggattttcagtgagtaaatgatcatcacttaatacatggatgaaaatttctttcattaacaatttcataaagctatgaaggaggctttctttgtgtttaatcccagtaactttgaaaggaatattgagtattgtcatatatgtatcctgattgctagaaaaatagtttgcataatattaaggctaaattatatgcttctgacatttgcaatcaaagatacaattttgtatcaggatatttttgagttttcacaagaggaaaaactagatttgaatgacatctctgtcatttgagaagtaggcagacatggacaaatttcctaacagtatgtcttatttgctaaccaataaaatgtgaatcataatgtctatcagcctaaatgatgtttgaaagtacttatatactgcaaagtgatgttttatgtcattttcattcattgtaataagtgaaataagggaggggtgattctatagaagtgttttaaaaacctggaaattataacaacaaattatagtaatgagaggaaaaaagaaaactaagtcagtttcacaggaagcatcacatgaaagtttacctgtaaacggagggaagaaagtaatttcaagagtgaagtgaaatgaaggtggcaaaacctgtgtgtatgatcaatatcatgcagatgaaaatgtaggatcacctatggatgagcaaattataagcaaaggagaaacaacaacaataaaatacttcttaaaagttatattcaaagctggcaaatgagaaaggaaattttcagcctatgatctagggtatatagtataatgtaaatgcatgcttccatattttttattagaaacattgtagaatattcatgattaaaaggaacttgaagttcagcagtaatgagaggattatttagaggatatcaagctgttttacgagttgcattgaactatgtcccttggtaatgtaacaacttgcagacatgatcttgcaatcattgtcatcacctgataaatcataaggataagaggtggtgtcagaagctgtatatgacaaaattgtcaaatttcaaaataaggaagaaaacagatttcagaaatactgtgaaaaaagtgttttacatataacagcgacacaattttagagcagacctattaattctggtttgcaaatatttattggacatctaccattataaagaattgtgttcagttctgatacttaatgataaaatgtgcacttttgaagtaccctggatcatggataatagacatgtgataagggctgtgatagatttgggggaaccatgagaggtaacactaattttatctagaaaagtgacagtagacatgatacaggagtaatttttaaatctgaatgttaatgagattagttagaattttagaggcagaggcataaaccctttggtgcatgtgaaaaaagaagtaagttactgcactaacaataggttactaagaacaaataatgtaaataatggcatagcaggaaaacgaacctggagtaaagcaatgtgggttgtagtctaaatagtaagctccaaaagttcaatctagttatttcatatgtgtgtatgtgcatacataatctagtttttctatatataaaatgagggtgtgcagagaattgttattttttctgtcatttttttctgatctattgtaatctatggggagaggagaactctacagagtatatgtcctaatttaaacaacaaatttattaattatgattatttgaaacaattgtagctgtcatttattaagagcttatatttagtaagctataatattttatcacagatgaataatttgtggatatatgcactgtagagtggagaactgcaagtgtttcaaaaactccatctactgtagtttattgttaaatttatggtagcctgcataatggtctctgatgtaacacaatactcttcttggttggtagtggcattaaacatatttagcaaatttgtatacagtaggacacatgttgtgtttaccaaattagtagactacaaaagttagaagaggtagctacataaaaatttagtaagaactatacaagctgaaatcatgagctgttactaaaaatcagatttgaaaataaggcaaatatgaagtcttccacttatgttagaaactataatcaataatgttttatataaataaactatggaagtttcatctgatcacaaaagaatttgatgttaaattcctcaaaggtaggaaatatgtcttttgctcactatgtaaaacttagttttcaaagactggcaagtaataagtcatcaacacatgtcttttgaactgtacttcactgaattttaagtgagccaccatgtacaataactttacagcatttcagttataacctgattaaactaaattggtacccatgatgaggtacataatgtctggacatctttgcactgcatagactcaatttgcagtatcaaggtagaattcaatgagctacatctaaaagattcattgacaatgactttaatattggagatacatacatacacacacacatatatatgtgtgtgtgtgtgtttgtgtgtgtatgaggttaggggggttgccctggtttgtagcacggccaatttgacagtgtgaacatttccactgtggaaatatcaatgtgaaaataccagttgactctctgaagcaggtacaagctggttctaagacaacacagaccatcgtaggtaggttatgatgacacagagtttatgctcaaaagatgcttattaaattaatcaatctgagattgtaaggaacattcaggatatattggtaactatcctagaaaagaagtaacatgtcagtaatttctaaattgctgcatgttttctcatggacaaacagttacatctattttaagtagctttttgaagtacgcctaggaccgtagtttaaagttatagaaaaaaaatctcaaactcagtatagaaatgtgtttttaaacaatcaaccagagctacttttttaaatagttaaaaatttttttaaacctttaaacaaacagaaaattaaccacctgtctttagaaatcccatagagattctatactgagtttaaagagttggattgtctaactctattttttttcaaatttcactgtgtaccagaatatgggcaacaacatttcctaacagttccccatgtggttctaatacataggaatcaaaatcattaagtgatgaagttgctctatgagtccatgttcactattgttataatgttacagttacagacaatcataatgaaaaaatacaatctacaaacttggaattgtttcaatgattggaaatcatggtaagacttttttcatgaatttgaaaattgaagaaataaaatttgcaacactaagtgaaggaaattggtgaatccaacagggttaatgaaaggctaaaacaaaaagagactaaggacgtttttcaattaagtaatataaatgcaattctaaacaagtggagctcgattctatagtttttgcataagtgaagatattgtctgatctaaaaagaaaataaaggtattgactaagatataaataataaaaaggtgcaggcaaagaagcatgcgcacagttacaatagttacatttccacgtgacaaggagttttttttttttttttgaaacagagtcttgctcgctctgttgttcaggttggcgtgcaggggcgaaatcttggctcactgcaacctctccctcctgggttcaaggttcaagcgattcttctgtctcagcctcccgagtagctgggactacaggcgtgtgccaccacacccaactaatttttgtatttttagtagagatggcatctcgccatgttgaccaggctgctctcgaactcctgacctcaaattatccacctggctttgatctcccaaagtgctccgtataggccgggcttgatggctaatgcccagcctatacagaaaatttttataataaaatttcaagagtttctcggcccatagccaacagtgctttatttctgaaaccattcccacaataagactttttcttcttcttcttcttcttttttttttttttttttttttgagatggagtctcactctgtctctcagcctggagtgcagtggtgggatctcagctcactgcaacctccgcctccgggttcaagcaattctcttgcctcagcttcctgagtagctgggattacaggtgcataccagcatgcctggctaatttttgtatttttttagtagagacagggtttcaccatgttggtcagggtggtctcgaactcctgacctcgtgaagcacccctctcggcctcccaaagtgctgggattacaggcctgagccaccgcgcccggccaataagacattttactacattgtcaaggtttctttagttcctatctcttttcactttaggcatgcctttattctccatgaagcttgactgcaaggagagacgcattgtaaactccacaatggtatgccttgaccggcactgtatattcatgcctagcacagctccagcaaataacacaaatgtaaatagatttattttaatcaaggaatgattaaacagatagcggcatttctggattttcattacactcttaattctcaatgggaattattcggttgaagttcttttatcagccttaatattgacggcagttacttaagccatttggtcacttccgctaacagagaagctgtgcaaagttacacattatattgacctatttgtgttctggatcattgaatgcatctgctgaggaagatactgactggctacaacaaaaagaatgctttggattctttggtatgtgcattcatatactccattaaagtaaaacagctttgtagaaaaaaaaaaaaagtgactctctagacctgggtggagggaccagatacaaccaggcttatccccaagtaaacactttgagtttttatatctaaaataattatgcttattttgtttttccatagacgaataccttttatttattcatttacttactgccttatattcactgtcatcacagatgatattttcttctagtccatgtatgataaataaattatctctcacacaaacagatataaacactcatacttgtaagtttgtttttgtttgtttgttgtgtgtgtgttttattttgtaattaatattatgtatttaagatatattctaactaccagacctcgggcaattcctgtcctatttacccctccaacagtcatattgtagactcattaagaagactgtgtgtctaccttttcttatcacctactatctccttaattccttgctaattgatttatgcttccactattctactgagacagctcattaaagagttatttatccaggaccaaaatccaataatcttttctaagtcctatttttcctttaacttttaatgcctttggtgttgtacatcttcccctcctgcttgaatatgcttgtcttctatacagtgaactcccatggttctcttccaacttccatcaattgttctttctctgtttctttaattagattcccatctacttgccacttttagaaatgagtggtccccaagttctatctttggaactttactattattttcatgttttttatacacctgtaatcccagcactttggtaggctgaggtgggaggattgcttgagcacaggagttccaaataagccttagtgagacctcatctgtactggaaaaaaaaaaaaaaaatgccaggcaggctggcatgtgcctgtagactcagctactatgggaggcttaggtggaggatcgcttaagttttgtaagttgaggctacagtgaactatgatcatgctactgtactccagccttgtgacagagcaaaaccctgtgaaagaaagaaagaaagaaagaaagaaagaaagaaagaaagaaagaaagaaagagaagggagggagggaggaagaaaggaaggaaggaaaagaaagaaagaaagaaaagaaagaaaaataaagaaagaaaaagagaaagaagaggagaaagataggaaggaaggaaggaaggatggaaggaaggaagagagggagaccaaaatgctgtgaaggggaaagaaagctatttgtcaaatagcctctcattgaacagttacacgtgtaatcattttttgtcaggaaaatattatgtgagcttatgagatatcactgattatcaagcagaggatagtgctttctggctgcctctccatatacctagagtcagttagtattctaccaaagcctcaacctccagagacactaaggccaatgtaactttagttaggaaactcttaagttaggacttcagttactccactaaatactccatgctgcaaattcttttctgacttgtgttcccgttcaaacaactggatcttctttaaaatggaaacaccctcatttgaaaagaaaattgtatgtttcttgaactcagtaaataaaaatacatattattacatgtattcattctgggttatgatgacattctttcaaagctgcaaacttcaataagttttttggtttataagattgactcagttgagctagattttctcaaaatgaggacccaatccttattaaatccattaaagtctaaaagtagattttcatttcatgtgcttacagaatttatagcactctaaaacaaaagaaatgcaaaacccatatatccaaattagccacattactttaaatatgaaagatgatattgggttgctgaactaattcttcattggcaatgggaatatgctacctacagttttagtgaaaaactcttttagcacatcatggtagtttcatgatggaaaaatcttctttttaaaaaaaattccaacaactgcaaaattttcttatcttcagcacagtagttaagaatatgggttttagaagccaaaatacgtgagttgaaatcttgtttctcacagttactagctgtgtacccaggcaggacggttaatgtctttttgctctagttttttacttataaaatgggatgataatacatacacaacagtgtcgctatcatgattaaatgagcttatagaagtaaaacctgtagagtgtttgatgttattacagctttatacaagagaggagaaatcacttggccggaaatgtttattaagtcaatctctgtacatttttcactagccaggagtcattaaggaaaaacaactgtgagtcatatcaatcatatgcaagcagaaactaagacattactatcttttggcagtgtctataaataagatgggatcattcctcagagttgtgtgtcttcaattttgtcttgtcttctctacatgggactcgtattacttgaactgggtggacttgcagagtaaagaagttgagaaaaccaaggttaattgaatttccccccaaaaacaacaacacgtaggcaaggctgcttttataaaatgcaataaactctttatgtgaaactgttaatctgttgatgacctggactttttataaattgaaacatccaagctcaagggtaagccaatgaatgataaaagatgatatatcaacttcatgttgaaatatatgtgctggggagggttattctttctaatagaaggctgctgtatttttcacctgattccactgaaaactatagtataaaagcatttcataatattgtatcaatctccatacctatcctgttttccttcgttgcactgaagtattgtgttagcagacatttttgcctgcatgaacgattgtttttaatccttaccccaatctagaagacaatgttacaggtaaaaaaaaacaaaccaaagcacggatgcattaaatatcttataaagccagggaatctgaaacaagacctccatgcctggccaggttatctcccaaatacacacataatcatgcacacggacactagagtaatcacaaatacgagtgaagaaacagcagttcctattagatatatatataattaacaggacatgataaattagctatctccaaataaataatctgtatctatcttgcaactatatttattcaattggtatctaatgttcgtttaattacaaatagatctttggccaactttcagtttagaaattaagttttaatgatactacaataactttccattatatagcaaggtcactggcttgaaaatacattttaaattgcttcataaggattatattttagttgaaattatttctcttttaaaattaacataatataaattaactatgtttttattgtattattttaaatggtctcatttaacattttacctaacacagattgatttcattctatacaaataacttgagaaaagtcactggatctagtggctgctatgatggaaaatcttttattattgtattctaactattgcaaatttgtttaaactgcagcataaagaaagtcaaggtatttaaaatccatggttacactgtcaactaagcttcactgtgaatttactttgttccagatctaatgggaaacctgggattttattacaaacagaaaaattaacacagtccccaccctcacagaactcagggttttgtgaaatgatgattatccgaaatgactataaattaaataatactatacaaaagaaggcaaagagtaatgtgggagtatggataattagttctcaacctgtgggatgtattatattttgaagaaaacatacttgctatgcattttgtatagtgacaatgaaatacaagttaactttttttccagtgaaaaactggtaagtgatgtaacatgtacagggaagtaatggaagattttttattcactctttcttccaaaagtttttatttaccttcttgtatgaatattgatcgaaagtgttcgaatgtcctcagaaggttatttggaaactgaatgtttttcaagtgaaaggagaatgaaaatgatttttaccctttaaagatcttacctttaaaagaaatgtgcttgaaaataggaaacagaagacgaaataggagacagtaacaaaagccacatgaacatatagaatcaagacattggagctgaggacggaagtgagagcattgctttgggaaatatttaggatggatagataactgagaggataagatctagctgtgctttccaatatggtagccactggccacatgtagctattgagtatgtaaaatgtggtgtggcttttatgactgaggaattgaattgttaattctgtttaatgttaataatttaactttagactatatttaaaaacaaatattctttctgttaaatacaactttattattttggtaagaatagctttcactttgctttatcatataagatactattgttatatcatagtacacttctcaagtgttcacatcacttctagcaccatggataaacttatgattgatctagtcattctcaatggaacgatacagcctgaattatttttctcctatgcacccttataacattttaatgtatttatttgaacattttagtaggcagaaagtacaaataacagtggtgctcatgaaaactctctttggtgtaataaaattgaaatacttattatttgaacatattatattttttcttctcacttatagatatgagcacattttcaaatgtgcccaaatacaaaaaaaaaaaaaaaaaaaaaagtactgggagggcacagtggctcatgcctgtaatcccagaactttgggagaccaaggtaggtggacagcttgagctcaggcattcaagaccagcctgagcaacatggtgaaactctttctctacaaataatacaaaacaaataattagctgggcgtggtggcatgcacttgtagtccagctacttgggaggctgaggcaggagaatcacttcagcccaggaggcagaggttggagtcagctgagattgtgccactgcgctccagcctgggtgacagaggcagtatgtaaaaaaacaaaaaacgaaaaacaaaaaataacaacaacaaaatcctactgattactgatgtactcatgcagaattaactagtgaaaagtaagttaatacgactttggaaattaaaaaaataccgaagaagctatgttgcaatttggatcatgaaggcaattgtaatttgctgcctctgagcaaaatagagaaaatacggcagattctggatgcaggtaggtagaaataaaatgttaccctcagtgttcattgagtttcaaatgtcttaaggacagtttattgaactggaaatatgtatgtatggaactcaaaagaaacattgtaaacaaagacaaaagtctggtcctcctcagtgagtagaactgcacagctgagagaagagaagagaggtagaatgaaattcagaataatctacaaaagttaaagaccaggcctgtacaaagaaggctatgatgaacactaaaaagaataaagcatcaacgtagaaaaaaacgcaaagcagatttctccctaaaaggtaaaatcttccacgactatgaacagagtgtttaatttttatttaaagttaggttttcagatgctgtaaaaataaatgacagacttttagaattttctacagattattaaaaatttggtggatgttggcataattttcctagcaaaattttgaccttaacagggaaggtatattagaaatataacacatttctattttaaaataatgcttagtattgaaagacagaatgatccctaattctccaaaacccattaaacaattttattttcactttgggtagggttgtcatatgcagcagctgcttctctatgaacaaattttctccataattttaacatatgacattgaatatgtagtgagaatattaataatagtaaactctttaagctgccaaataacataatcaaatcagttttcaatattaatgtatatatggcctaccgtatttacattaactgctatatgctatacactcttcatgtttgccagtatatacatgtatcctagaatagcagatgtatgttcctatcacatttcacaggattttaaaaattaaaatgtaaatcaatacataggatttgtttgaatattttttcttttctatgtccttagcatagcctttgttatcctggaacttcaagtgtgatgcataaatttaaatcatcagaatatttcaatttttataattaaataaatcttactatgtcaattttcaggtattaaagcaaagtgacaatctgggattttaaaataggatagactactgtgtgaaaaattttctcttctcccttttgttgttggtcgtagttgttctacaaaactacagaattttgcttcctatgtgtcataattcttatagctatattatcttgcttgccaataacattacaatgtaacagcagttttcactaggtagtcttacacaatctattaaatttttaaagtcgaaaacttggcattggaaattattgcctctctaaaacagaatgtcagattcatccatgatgtggaaactattacaattccatttatataaaggatgccagttttggaaataatcacccacctgttacctccatgcaggtattgaatactagttttagaatcttaacattcccagtgctcttgaagcaacaggagtagaatacatttgctggagtgtaccatttctatcaccttctgcgtccttcccacttaaccaagaagtaagtcaaagcaaggcaagtgaagaatgttctactaaattattagtgaattataaagctttcacttggttgtggtcctattatttttactaaagactacttttatggcaaaagagtcaggttaaaaaacataactaaaaatatattttggttaatttcctctttagcaatctttgattcaagagtagagaggaaagccgtcataaactgacatagatatcaaacaggcaaaactgatgtttactgtatgaatactgtgaggaagggaatgattgttttaatagttggctctttctaaacatatgcctcaacatataaatataagaacataatataaaataataaacttctttgataataattaattattggatgcctagagacaaaaataaaatattagtgaagaaactttagacagatatcaaagtaagtaacaggcaatggtgcctctaagagtaaagcatgtcgcactataactagtcctccaaaagaatctcatgcccaagaaaaaagatttaaagaagaaatataaaaacatccttacatatgtaaagttgaagagaacaattcatgcaataaatattgcaaccaggaaggaacaatttttgagtcaaacaatgatgtagaaaagctagttcccaaaatgcatgggatttaaatatatgctccaactctcacaatttaaatataatacaatagagacaaaggagaaaataaaactagtacaaaagttatgatggtaaaaaacaaagtctgtttttgtgaaagataattttatatagtaaaaaattattatattaatattttggaagcaaacctcaatgatatcttgaacacttctcattgttttatgccccgaagaaaactgtgagtttgtgaagataggagtttatgtatgaattgtggtgacataccttgaggaggtgaaaatgcttaggagaaataaatgtaacagaattgtacactataggctgtcttatttttttcttcctttttgaaagtaagagacctgaaacaatgcatccatgaattttcagaaatacaagcaagtcttcaagatacatttcaaattctaagacagattttaaaaggacaagctaaaggaaattagaacattaacataggacaggtttaatgccacaaaattaaatcaaatgataaattggagaatatcatgggagaactagaactcaatgtattataagaaaagattacaggaggataaaaaagagataaaatttaagacattaatgatttacctaataaaaataaaataatataccaaataatgttttaaatgtgagaaaatattaggtcaattaatattctattgtaaatccatctaatttaaaacagccaacatttattaagtttctacccctagaatgcactacataagattcaacggagatatagaattgctaagaacacagacattgacctttcatatttctctgttacatgagggagatcgaatatgcataaattacttgaatacaaagcaggttatgtcaagaattataattcatatacaaatgaaatttaatgtaggtgtgaggaagggagagtttaattttaactagagagcatttagattatctagagaggagaggtagtatttttgcaagatgaatattctgcacatatcttttaaactaggaacagtttagtgcaaaccaatgaatatttgagaaatgtaaggaatcttctaataagactgagccgtgatttttgcagcgtggcagtaaaatatatagttggagtgggtagtaagagtccaactgtgacgtgtattgaataccagaaagatgtggttaagtcaaaaaagaacctaaagtctatttcaggaatagcataaatagaataagaaagcaaaataaacgggcatacacatacatgcaataacaatgataaaaatacgggagatgaaaaatacccacattctatcataacttataaattctaatgtgttcagaatcactggttcctccacatgctgtctgtactactgagccactacgtagtctaagattatatatcggaagcagtttcctctgcagactaacatcagcccccagaaattattagcagatttagacttgtttcaagaacaataacaggagtgaaacagaggtaaaaatgtatcaatggtcaaagaagaatgacagtaattttaaatagaacttttcggttaatattaaatacatctgaaactttccaacaggggacaaacttaactggagaaatttagccaattctagacttacagagaatcacagtagtaccatagcttctgcacctgcaagagatttggggccatcgtgataaatatggagttcattggatgggaggtaaaacagaatttatgtatattaatacataatatttgtacatatttaaagggtatatgtgatatttgtatacacttgttttttttggtttgtttttttttttttttgacagggtctcactgtcgccaaggctggagtgcagtggcgtgatcttggctcactgcaaactccgcctcctggattcaattgattctcctgcctcagcctctgagtagatgggattacaggcactcaccaccacgcctggataatttttgtatttttagtagagacaggctttcaccatgtcggccaagctggtctcaaactcctggcctcaggtaatctacctgccttggcctcccaaagtgctgggattacaggcgtgaaccactgtgcccggcctacacttgtctttttagtttactacacggaggcataatatatatttactccaacatcatctggtgatttttgaaggactagtctgcataaaaagctctgcttggtgttgggggcagatttagaaagggctattgataaaaagatggtgcatattagagtccttgggtctggagtgcagcttttcctcatgctctcaattctttacttgggaagcaccagtacactattcaaatcataattttatcaggaattcaatctattctttctcagagaagttcaccattgttgtctaattcccatagtgccttttatctcctttataatagtgtttatgagaatatattagaattatttttttgccaacttttttttttaaccattagaatgaattctgaattctttgatggcatgtagagatcatcatttaactatttataactcattcaatcacactaatctaatggtagccttaaaaagcagaggctctttaaatggttattgaagtaaaaatgtcacaaatatctaattaaaacttaaaatttacattcttatatttcaaacaacatccaaagaaagtaatttgaaactaacaaaagcagtagtgattaagaagtaaagtataaattgaagatctcaaataatattatgaaacataaaatacaaaaattatcaagacaggagtttgcaacaaatgggcaatattaaaatagctctcaacttacataaacattttttaaaaacatttacatactgggtgatgtagatatacttagtaaatgaaaagccttgccccacatcatatcaaacaaaacacaatgttttcaaattagaaataacaaaaaatatataattgtcaaataaaatgaattctcatatgcacttactaaatgaaggaggagattcagaaccaaaacaaaaatgattatataatttttcaacatgctgaattaataatattttctcaatgagtacttaaaaaaaatgttatacatacgatagtaagacagataaaaaaatacaaacacagtggaatgcccctccttaaattttggaaggcagcaaaggaaacaaaatagaagtagtaaaactaaatagaaataaaattagaaaaaatgcttaatatttatgtctacaattttattcctagaaaaaacattaaaataattcttagactatgggttaaaacaaaaataaaatacgtctatatacatatatgtatatgtaatataaagtaagaaatattaattaggccaggcggggtggctcatgcctgtaatcccagcatttcgggaggcggaggcggatggatcacctgaggtcaggagttgaggaccaccctggccaacatggtgaaacctcatctctactaaaaaataaaaaaattagcagggcttggtgtcaggcacctgcaattacagctgcttgggaggctgagacagggagaagttcctgaacccagcaggcggaggttgtagtagctgagatcgccccattgcactccaatgagattccgtttaaaaaaaaaaaagaaatgtaaattataatacgatgatgacttgtataaatattagcaaatcattcaaagaaatactactgatagaaataaatataactgacattataaaacctaaacctgatgcagaaaataattagaaaaaaacacgaagaatacataagaagataatttaaacaaatatgcttttcatattccaaatttctgagaccaaaaggaaaaaaaattacaatgaatccagagttaaaatgatcaaaatattggcaaatagaacacaatcacatatgaaaggaattgccaaccagggttaagcagggtttgtcccaagataattgcactgtgattggggtgacaatgaatattagtttcttttcctgccctgaagatgagcaaagaaatgaagaagcagacaaattaaaaatgcctaatgacttttcttatggacaaaagtgttttcacaagctctttgaagaaaaattaactataataaaagttgaaacaatagatagggcacagattttataaattagaaatatctgtgcttaaaaatccaactaataagaatgcatatacttcatgtttacattgtatttattcactttataaaattttgtcaactgtgtttttttgggactcagaaaacgataccctgaaagtttggcactttggtatactgaatactttgaactgaaataggtaggcctcagaaataggattcggaaccaaggtctccttctgcccttcccatcctcctcttcccctagccatcctctatttttcaccaagcacaaggaaggactttttctggaattttcttatctgactaataaaatttctttccaaaaggaatgcaactgatgtaatacccaggaaacagccaggaaagatctatcaaataccatggaaagattaaccactaatgaagacaagagaataaaaaccacactctgatagaattttatccatttgcccaaggacaggtttgagtgattactgggaaacattatctgaataataagacaactttattttacagcaaagttctgtccctcaccttgctaccacctccccaagagctcagaggaaatttctcccaggtcattgtattctggaactcacttatctccccctgtaaatcgtttactaatcctaaaattaactactgccactgtcccccttctcatttccctgtcctctatgaagagggtatttaagcctcaaccatctggcttttctttgagtctctttttgtggtgcttccttcatgtccatatgcacagtagaaaattctacgcgtttttcctctgttaatctctttattgacagtcatttcagagcaccttcaaagaggaaggaagaaaagctttccctctgctcctacacattaaatttggggtttaaaaagtacatgatgcatgtgtagcaaatctgccgcttttatctcaacattcttcttagagagcttgctgatctcgcaaagatcacttgattcaaacttgacctcatttgtttgtatcttacagttatttaagtgaaagtcaatcaatatggtattcctctgtaagtctgaaataaaacaaacagagactgtgtgttgcagtaaagttttggggccatgtagaatttcatggaaaggtagtaccatggaggcaacacaatatcaccctcaagttaaggtagtgatggggtagaaacaagaccctatcctagggagctggcttgtagatgtgaaagacgaaaacatgcaaaacaaacaaagaaacaaacaacaaaaccactggaaaagtgacagtgtgacccacagagtgtaagagagagacgaaaaaaaatgttttttggcttcttaggctattttttcaccttaaattgagtttttaattatttgttttaaacttgacagataacattgtatttaggtatcagctacaacatgatactttaaagtgtagattatcccttattcaaactgcttggaatgagaagtgttttagatctcaaattttttaaaaaattttgaatatgtgcatatacacaatgaaatatcttggggaaggaacccaagtctaaacaaaaaatgtacttatgtttcatatacataatatataaatagcctgaatataattgtttaatatatatagcctgaatgtaattttatatatgtttttaataatttggtttatgaaaataatttttgactgcatttcgactgtaattcatcacataaggtcagatatgaaattttccacttgtggaatcatgtcagacctcaaaaagtgtcacattcttgagtattttgaatttcaaattttcacagggttgctcaacctgatatacacattacagaatgatgaaatctaactaattaacaattgcctaacctcacatattatcattcttggctggtgtacctcttatagatagcttctctgagattctcttttgtgctaacagtaaacaagctgacttgacagcctctccactgcattttaggcaagcagtccatgttatgatattgctgttatatgtaaattgtcagtgatactttgaaattgagttgtaatttaaggaggaaaaacaaagtgagttgaaaggcagcacagagatatattgtttatggttgtttctttgtataatatagctttgtcaagtgtaaaaagaccactttcttctttgttatgtcaaatacataaaaaaagaagaatcttaaatgctgatgttgggatattgatgaaaccaaatcagcatgtaatgcaaattacctcacatgaattagtataagatttaaataggtcgtctttatgttatgtgttatggagattgttgaaaattcaccctgaaacacttggaagtgctttcctttagttgtataaagttaagtaaatcaatgcatgttactcaaagccattttttctccagcttcaaaatgtactaatttcattgaaattatcaaagcagaaaaaatagaaattcacatagatatggaagtgcatagttctgatcttacattaacagtcaagattttgagatttagtaataggaaaaaaacctttactatttgttgtgttaatagacattaaatctggtttcttacacaataagtaattattagctcaccaagaaatgtgacttacagaatgtgaaagggaataaggaggtacttttgtagttctgaagtaatctgttggtacaaatatcagaataacatgaatcatcaaaataatatacttggcaggaatgagaaaaatgtgaaatacgtgatgatatttgatgactttccaaactttgtaaggatagatcattctaccaaactcctatgtagcaaaattagcattgatgaaatgacagtattttccccattatgtcttcatttatgactcttaacctcacagattaaaatcataacaaaacataatgtacttattgaaaaactatacttcatcaacacacatctccagtaaagataacaataacaaatggaaaaaattactaaatctgttatatttatatttagctaattttcttgctttttttaggtgttgaccttgataagttagctcagtcttctttcatgtgaatcatgaaataagggacagagatttgaatttaaattgaaagtattaagaagccaaggaggagttctgagacaagagcaaacattaaaaaaaaaagtgtaagagcacagtttggtgatcacaaatgattatattattgtacaaacactattaaagaaatacatgtgggatcttcattaatactggataaactagttaatatcagttggctgaacagatgggagtcaataaacattttaattggaaattacaagagaaaattacattaggttaaattgcaaaaatgatgcctttcattggaaagttacaaacagcatctgtagaatgttatatttacctgtgataaggtaatgatacaatatatatgatatataaataaaggtggtgtcaactacactgatatttacacgggaagaaaatcccattgaagagctaaacaattttacaataatcagattattttggtattatatacacagaaagcctgcttcaaatagatgatgacttcctgtaggataggcactagagcttcatccctatattctcaaagtctaggcaagagtctgatacatactggttctcaataaataattgatagctgaaggaatgtctcaaagagttctagaactgataagtaacccactggttgttttgcagaaataaaacttactgatcactgtatccttcacaacttaaattatgtcaatcccataatattcacttcaaaataatactattctaatacataaagcataatattctaaattttactttaatcaaaagaaaattatataaaaaattaatttgatatttacatgaaatagcaaatgataaacttaatatgtctaacatcttccaatttctttttaggcctttgtgaaattgcttttgaaagcattacataattagaatataaagtctttctaaaataggaaatttttaataatttttgtgaagatggggaaaataggtagtaatcttcaaattattgaaaaatggctaatttctaagaactcacaaattggcaatatataaaaaataaggtcaaaatgtcatttctgatatctacttgttaatatattaatgaagaccctcaagctaacacagatattaaaggttttctagcacttttctagaaaatggatcttaaaagtttctgtctgacctcctttaaaaagattaaacaaataaaagagtactcaagtactagcaggatttaaagacgaaagttttttaaaaggctgtaaaaagagcgttgaacatgaattcaatacaggtaattatgagcctgtcagcatttctattacaaacttcatttagaggttttatcatttccataatcttaaaaactaggaagccgaaagttggcacacaaattagcagcctggatgcaaatttatttacacaaaacatttgaatcagttcagctgttttgatttatgcatcagccaaaatatcttaactccagatttctccatatatgtgaacactgagtaaatattttgtctagagtacatagttaggtcacttagagtatggaatcaataaattcaaggtagagtatgtatcgtctccaaaagagtcagctgtattttttttgccagtttttctaactttgatcccttatcttgcatatgcagcctttagcaacacagagttcaatattagaaaatgcaggtagctcagcataaattcattactaacatttagttgagattaaaattatacttctgataatggattcagagaagccatttctgcataatgaaaatatagtttaaagatgaaaactaaatcacttctaaaaattacaaattagcttaatttaaagcttatatttttaaaattattgactaagtggataaacttcattgtgggtgtatccattatgtggtacattatgtgttattttaagagaaaataaaataagaatatattttcctcaaatatccttcaaataagataactcccataatgtaaacaagcaaaaaagataagaagattaaaaaaacaaaacagccccatagaaagctaaaatatatatttgagaaattataataatatcaaataacaaaacacagctgtaagttttattaagtagctatcaaagaagaaacaaatggctaataggaatgtgaactagtttgggaaaagttgttttgattatctacctctccctaagatcatgaaaatgaaatgtcaagtgaatttgtgattttaaatctcaataaaatcaaataaatactaacaacaattggatgcattctaaaatggaaaacctggctgatggctgatcataagttttcaacaataaataaaattttggaatgaacaattgtagaaaacagacttggagacaaatcgtaaatgtacctttatctgggacttgaccaaccttggagaaatctacatctacctgttgtaagatcatatatcaaaactatttaaaataagaatggcctatgaagaagtattaaatgcaataagtatatcctatgactaatacaaatgaggacattattaggataacttatctttaaaattaaaaagacaggttaaaataaaatttctgaaaatataacaacaaataaagctttaataatgcatgtagaaaaaggctagtttatattgggagagtctataaagtttagaaatgacaaaagtaatatagttacatatgaaaatatattttatcatatacacaagaaaatgtaatgctaaatttgagcacttaagtataatttaataaaaacattttttctttcatagactgatgtatatctatattccccccagttaatccttaagttaatctttagattgcatgtgaagtttcccatttgcctatattaatatactcatgtatctgtgtctccttacacaattacttcaaaaagtctagtcttaattctgatcaggattttggggtaggcacagtggtctctccattcaatgagctttactctcataaaccaattatgtctaaaaaaaaaaaaaagaggctcataaaatagtatcaaatacaagaaaagtacactggacaggtaaagactggttttcactctctagcttggcaagtcatttcatttctctggcctgtcccctcttttatgtgaagatacacagctacccctgtatttttaactaaaggacacttatggactgaaatagactttgtgaatggaacttggatatgcatattttaattttgaaaaatatgtatttgcccctacaaataaatctaatgcacatttcctgcctagtaaacactagattggggacactctgagaacttccatatcctttaaattctgtagagctgagtggaaggttaagataccaagtaaaacaattttatttttcaatgcttatgatacaattttatcattttatatgtgaagttcataaatttatctgcattcacaaattttaaattttactcaagagcctccattaggagctaagggttataatgtttacctctgttttatcttacttaatgtgctagttttatattttatagtgtcatatttaacatatgtattacctgtgcatttactttgcttactatcgcttataaaagtagaaagtatcttttatatctattgtacagaccatttagagaacaaaattagtcaagttaagtgaaagatgttgaaaattacaaaaccaattaagttatgtgttactccaactgtgggatatctatctatctatctatctatctatctatctatctatctatctatctatctatctttctgtctaatcacgactattgatcttaagctttcttctaaattaaattttcagggcctcaatgtttctcttaaaaatgaagaggtttaattggtaacttagtcatttacatttttcttttagattttggtaagtctatggcttatgaatctattatcctttcagatttcacttaaccactagctaactgtatgatcctggcaaatcattgaactctggactcagaaaaatgtgtattactcgaaaatggagataacaatctctatataggagttaatagctatctcaaagatacttattagaattcaatacaggaagaaaagggagaaaagaactgtttgagatgtaaaggacactttagttaagggcttatcataaagcatcacacatgaaaagacacaacaaagaattttatcccggtaccatttcccaaaacataagaatgtctcgtatcctctctacatagtaaataactctgatcattctggagtcaatcagataaacttgtataacagaaaactatggcaaaagcccttgcttttttagttatttgggataaaataagtctacttttatagagtctgtttccatttacaaacttcctctcaaagtggtatttaatcatattttttaatgtcatagttaaaaaatcctccctattattttaaactcatgatcattaacattcctttaaaaattgctaacatcaagcaaagaaaatcttcataatcttaaacattatgaacttagctttttaagggaatcactcatgactatttatatatttcaatcattttctgaacatttcaactcctcaaagagtagaatttcttaactttgcaaattttactcccatatcataaaatgactttaaaacatttcaactatcactaaaattgataacgtatggatgttcttataccattaatatttataaaatgtattattgtttcttatagaattttgaataattgtcttatatatatatatcatgtgaaaaaatatgcagatgaaaatgtaactagagagaatacataaatctcatgtaaatatgacttaaacataataaaacccatgaaaaaaagaaacatttctctagatttaaaagcttttaagtaagaaattgtctacagattataagaaataaataaaaatttgatgttaagtactgcccctcaatgctcttttgagacatgaaaaagtcaacacactgattttatttacagacttgtaatgtcaagaaataaactttactgaagatacaattagtttatttgaagtacacattatatcagaaaagtttttcactccataattatctccttttgtcttctaccaaataagtaattatcatttttaaaattttaccacaagcatataattactaatactaattgatatatagtactgaaatattaatttttctgattgactatcttcattggtgccatctgagctaactttctaataaaattgataaggtaaagtagaaaaagaattgaacatgagcttgaatgccctgtcatctagtctgagttctggaattaatggtctttgaaaactaccaaaaattacttatcctttcttggcatttgcgcttattgtaaaatacatgagcagtgaactagctgatatttaaggacctatgaatgtcatgatttgtgacaagatgaatgaacaaattcatgttagtacattaatcaatccctattaaaagaaatcaatatcagaatgcaggggatgaaatcagcacaggaggagaggtagcatttttttctttttagctgtgagtctgccccttattcatatagccagcaccagaagtgaatgtgtaaaagtgataagcagcagtttcacagtgtttctcagctgtataatggcctgggaacttagccaaagtgaaataatagctagtgagaagaggctacactttttatttactgctatggaaaagtgaaggtggtggtgttagagataaagtgcgagttcatacaggctttgcatgtgcatgtttatttgaataatattggcaatagctactagtgccaagcactgggctaggtacgtaatttatgtcatctccctataaacccccgatattgtcatgtatttttttttttacagataataaaactgaagcttaggaaagttgaattgctagtccaaagataattgttgccaaaaatcattatttgaccttcagtggctccagagcccttgctctttccactttactgtagggtcgctcaaattttagagtgcaatctggacttacctggatgacttgtttaaaccatcagtgtctgtgcccaactcccaaagcatctgattcaacagaccttatctgggaaactgaggtatttttattgctaaaaagtttttagaggatgctggtactacttgttggagaacactttgaaaatcactgtagtccaaacatttaagggcctgaactgaataatgtgatgatatctaatgccacataatcaccattgttattttccgtccaagcacaggtatataatacatatgttaatgtaaatttagacattttaaagatttcaaattaggttgccggcaacgaattatcactatatagaaaatattaatcattaggattccttaaccagcaccaaacaacagcttagcaaagcaacttaagacatgaaatatatttgatggctgcaagtctggggccttaagagaaggaaaggtgatcatcagcattgtggctgtgaataccagcaggtcttcaacaaattgatttttctctgtgatacttttaaaagcgatgtccctgaagagaataagagcctcacaaggggcccaattctgagaaaaccttgcaggcatggaggtaggtatacctggaaataccgtgaatcacccacctgctcactctgagagcagaaagatgaatttggcaaccgcagtgtctgtaatggcaccattctcatactcatccaaagtccaaatcaatatttccactgtattctaaattatatactcctttggatgatgagtaaagggaacagaagaaagagatagggaaaaatagctaaagctatgttttaatgtacatgtaaataaactaaagtgttcttagattttacttgtatcttacacattttttcttaatctgtcatttacaaccattttatttctaatttcccaaatcttggaattcaaagtacaagatggcgtattttctcaaaaggtcatgttgcctaaaggtactggtgccttaccaggcgtatgcttggtgctttaaaatagacaaaatattgaaggtattttatatccttaagccatttcggaagcccctgataagtaagtagaagagaaacaccctttggaacacatgaagaagtatatttggaggctaaggaagtaaactttagttccctccacttttttgcatttgagatcttagaaaagcgttttaaggtcagagtttttttttttccgcacatgagtacaaaggcattattaactgcacacctctcctactttttttgtttatcagctttcacttatgatagagttttactgtacttagaatcatgcacagatgacatttggtgtctatttgttatttcactgttttgtagacaccaaattttgtgtttagggaaaagacgcgtatactccaaattaattcagctaccctacaaatagaaatgctaattaatatcatgaagggtaataactactggaacgaagcctttgctcctggagtacttaatttattgagtaattctactctttttctccttgaaggatctcaagggagctggcatcaggttttcaagatgccgaaaccttctccttaattatttctgctcacatactcttccaatgagggcgtgatgcagcacccgcctcctccccaaccagatgattccggaaagtacggtgctgcaaaaggacatttcagagcgctttcaacaagctaactgtccagtgaagttcagctccgaattctggtaaccgttcaagccctgtcagtccggtaaattgggttaacttagcaactcggtggtgcaaagcctccccaaagacaagaccgcattcagggagaagagaaccagcctcatgcctgagccgatctttcttcctttggttgtcctccttcattattattctgcaatgcgcagcaatccctgtgcgtgcccctgtgtcagccccttagctggtcactccagcggggctgggagaagaccactttggctactcagatggcactatgctgtttaatttcttctgctctctccctcagagtctaactaagcccttgcagcacttgagccgggggctgccctcctgctggcctttccgtcgtcgttgaacggatctgggggacggggacgttgcagaggagccacaatccccactcgttgtttccccaatgtgctttccgaactccccgagtgcgtcttagataagttatttgagtgaggacagcgctgcggtccgcctggagaaagggagcttcctccgcacttctacttcatcgtgacagcagtggtcgcagcgccactggccatctggagtcctgggaacattaaagcgctgttacccgccaggcgtttccgcctaggacacactcacacccaccctcggagactcctaaaggtttctccgtgtcaattcatgtgtcctcctcccagcagcacacacgcacacacgcacatcaacagccaagtcagccacccagtttcaacttcgggttgtccatgaaaattcagggaggctgatcttcttgaagaaattaatgagtattcccacaggaaatagatgtaagggaggggcgcctgtccaaactacagcaggagggggccctgactcaaatacaaaggttacctttcagtgggtttctcagtcttgctagtgttgggggaagggttttgataatggttttgtctaggtgggtttttgtttgctgttattattttgaaaagacattgatttcccttccctcagccccctttgtaaagctctctcaagctgagacagatattttcctgatgtgttgggaaagactgtcgccttatgggcgaggactgtgggtgtcagtccccgggacacacgcggggctgaaagctccggacatggccacctgggcgggcgtctgtaaaaggtgctaatgagtgcctctggcagctcttccccctcataagacacccgcgcccctctccagtagcaactaactgcgggagaggatgcgatttccacttttccaaaagacctctgtggcaggagtagtatctccttggagtctcagagcacgcagaaacgtggatccttcgcgaagtcgctctggcgagaatccctggaaagacgctctggcgtggggtgcgcgacgccgcacccggtctcccacctgctgcctacccagagatctgtgccttcgcggtaccttcgctgcacggtgtgtgttcccctgggatccactgacaagcagcgtgggaaaacatcccatggatgtctctttacatgggcgggacgcttaagcacgacttggagattcacagtttctatctgggtgagacctaaacagacacgctgcagctggaggcatttcagaaacctctgcctgtgtgtgtgtgtgcgtgtgtacctgtgtggggggtgcgggggaggggagttcagtttgaaataggcatggatcaagtctaggcagcacctgccctgtcccacgcctcagtttggtgctctccacagccttttatttcacatgacagtggaaatgaaatgccaaggaaaggttgttttccttttcagccccacccgagtggttcaggcctacctaagaccactttatcttacactccgaggcgtttcctcccactaagcctctttgtcattgctgttgaacgcaaaggtgagatggtggagggatgaaaactgtaggcagatggtgtaattctcgtggctagagctgttcacgtggaaaactgcctgcctcggacttcctggaccctcacgctagtctagattagaacctgcaaaatccttacaacggctccccagtctgaggtttttcatggacctcacattccagaagaaagtgtagaagacaaaagcgagcatagacattggggcaaacaatgtttaaggcattgcatcaatcttggctttaggaaagccttgagacaggtgaaattaaaataaaatgaggaaagggagagtaaaaagcaactatcaaaattggcatcattcggagattgacagcaggtctaaaacataaaacctatgcaaatttctcagaatttggggacagtattccaagtcgtaaaatgtaggagatgccttccaagtgcccgatgagtgacaataactttattgacattgaaaaaaaatgttttttacgtatagtctgtagaatattgattttgcacaggatcaaagaaggctatgacatactcttccttctcaatatctccaaagctaaaccgattatatcagtccaaagtaaattaacgcgcctttcctttctatcggcgcatctcattcggaaaatacggtaggtgcgggcagccggggctctaattgcaggcggcgcggatcagcgttagtcaggctgtaatgctcgccccgcttcggagacttccctccccctcatctgcccccgaatgtgttttggctcaacaggtatcacatgaaaactcgcacttaaaccctggtcatcttctcacaggagccacccttacatttttctgccagggctgctgctggctattcgcgcctcccccacgcgaagcgcgcgtctagcaggcagccccagggccatccattaaccaccaactcccagtggcaggcgaactaagcataaatgtgtggctcctcacccgtcgagccagcgacaaagaaaccttgtaagcaacctgagccgtgctttgtacatttggcagtgtagttgtgccacttaggacaagcttttcggctcagagctgctctgaggccccagagagaaaagaaaaatcaagcttcaaggagcaggttgggattacaaggcagttgctgccacagagaccggggcgactgacttcctggcattttgggatgtaaattaaaattctagacatgccacccatcattggttatagtagagggaaaggtaacctctccagctccctcctcccaaaacatgaattatcatttccactgaatgcaaatgagctgccttccgtggggggacagccagctgcaagctggacaataaactgtttcatagagacgcggcccgattgcagttcagagaggcactcctttacaaaggaagaagcgtccagtttgtgttgacagccctggcgcgcctgggccaaaacagcaccccctttcccgcgatcccccgcccccccgcgacacacagacacccgggatttgaaactagcttcactgaaagcggcatccatagcgtctattcgagctgccatgagtatggagaggtgattgttcaaaaaatgatggcatgagtcataaacacctcctgagtattctttgcagcaattaatgggcagcagggtgccggagaagttgtggaagagagctatggatctattttctccctaaggacagctctttttcccatgatcctgactgtcccttgccttcctgcttgggaatacatttttacatcccacctaccccctcccctatctgtgcatgtgacactcactctacctgtctgaacgctgagacttgctggggattttcttttggtcgtcagctaatgactttcctcctacctcattcatcccttaaggtggttctttacacttcatggcatttcagacccttcgaaagcctcattttttgccaaacctctaccacaggtcctagggaagctcccctacatttaacattgcatagaagcccaatttacatacatatgcatgcagacattcatgttgatgtggcagtgcttggaagatccctgtgccctaatgcatttaaaatcaacacattcctagcacgtcgataactttcttccctgaaagggttaaaaagcatttagaccagcgtctttaatatatatattccacccaaagcctcaagccctagtgatctgacaagaaatcaaggtaatcctcaccactaagaaaagtcttgcagaggaattctgcctggatatccactagttagaggctatactaaccaactcacgtattcgtttgagcatactgcaagaatatttattgagcacaagctcaatcaccgcattgaacgccaaatctggcaagcaaaatgcatttcctatctgagggggggagaacgagctgtgaatcaactcctttagtattatcagattattttatcggtgcaaattgcaaagtaagctgccagcctctctccatctacaagtcagcccacctccatccaaagcggaggggacccccaaagcagacctacctttcacacaagacaccgtcaataaaaagacgaggttccaaaacgtaaatccacttttaatccccattttcttcatcaggatgaagtctaggcggccacatttagcgcatcttcgcttgccaggctcccagggtttggattcctttgctcggctttcccctttgcggatccctttcatattattcgcgagctcctaattcctgctcctcagcccggcgcagtggagttgttgctgttgttggtgcgcggtcacagctcggagtgaatggtgtttctgggataccacagcaaccttgacgaggactcaaccatctctccaacgggggcacaaagtctc

SEQ ID NO: 886 - DNA, 1214086 bp, Homo sapiens; identical to SEQ ID NO: 885

SEQ ID NO: 887 - DNA, 1154226 bp, Homo sapiens
ttttacaaaagcaattatccatttttattttgtttacattgcactgaaaatttacatcatacttttacaaagtttcttttcataaaaatatacttctttacaaaagtgtatgcattaatataagaggagtagccagttgcagaagaaacattgtttaaacaagatcttaaatgtattagccttaacattaatgaatgaatcattgttattgcagtcatttgaataaacaagaataaataactgatggcataaaatttaaaactgcatcctgccagtagagtaccatgttgagaaaattgtatgaatttccaaaacaatgtatctcaaagtggtttacaagaaattcattaaatgttgtagagatagagccaagcagcgctcccaggtgcaagggtttctcttaggcactctgtctcatgatacaaaaagtcaagactgttcacagagttatccatatttgaaagggacaacaacaaagagttaacactgggtacatgatcgtattcaatgaagtaaaacagctataaaaggaagacgatgacctattaaataaaaatgctggcattactgtatgatacagtttaaatgagccaccaataacttacaaatacatatcttaatttgacaatgaaagaaacctcttgtatgtgaaacttggtgtttaacaataaaggtacagaaatttaaaaatatataaaaatatgataagtccacaattgtaggcaataaatttatattggtgatttataataataatttttttcagtcattatgtttagtggctagaccaaaatatttttctaatccattgttaaatgaaaattaaaagtgtcaaaataatgctaaatttgaagactcagctggaaggaaatgtagatataaatagagtagattattaggacattttatttggtcgatcaaaaatattgtaaaataaaggatggtaagtttggtgtctcagataactgcaaaataataatttttctagataatttctgccagccaaatggtttttgggtgaggaaacatactgaagctactatcacatttgggattaaaaaataataaaaataaataggaaaaaaccatattgaagcaaggagtgaaacactaccccatagctcactgaataatactggttactccataatgggggaattgggagggtagcacaatgaacttgccctttgcagaaactatgacaaccagtctaaaagaagaagagcaatatgatgctaaagaaatagaaagattcaaattggaatgggaaaccttatgtcttccgaggcataaactagctcataaacatttaaagtcataactcaatcttaaataaagaaaacaatgcctcatttaacaagaatgaatggcagatagagtggtatgaaagacagatttgtgggcgtgatgtagctcaggacagttaaagagaagtcagtgatctattgactcttgtaagtatagctcttatttctaccctatatctttttttttaaacccagtccctctaatatagtttataaagcacagaaatactgatagtggatgctcctccaatatatgcaaataagtttatattttagaataatctcctttttaaaaaaagcaaataaactgtgagtaagcactctcagagtgcagccaaatttctgtaaaactctccatggtaaacatgaagaattatggtccagtttatgaaaaaacactcttctgtatcattcctcaggaaaaggtgacccagcaagtcctgaaaagtgtgctttaatttgtttagcagtgaactaaatgtgcactgttttgtgtgtcgatttccaagcttctgaagaaggcaaaggttgcctcgttataccattgtgcaaaccgtgttcaagttgggatcaaatcgtaccgccttcccttccactgactttgcgttggtgtcatacatgggattttcaaaagctgcttggccattgttattttcatgaactgaacatcctgtatactgtgttttaggtgcagtcctgttgatgagaacattgattagctatgtgttaactttcttccagaaacagcagactacagctcaaacataatgtacatcgttagcagataatgtaacttaaaaatattaattgagacatcataaacacactaagtcaacttgaacaatttccttgttactttaaaaacctgagtgacttttaattttacatatattacatatttatgtacagcatcaatattagtaacataaatataaataaattatatgatggctataataaattttcttacaaaattagaaattattatgacttatcatttatagtataaataataatgatgatggatttaagtctcatcactatttatttgttcaccaaatatttactgaacatctattatgcgccagtcatgattctaggcattgggtatatcatttttttaaaaaaagactagtctttactttcagggagttcacattgtagtgatagaaaacaagaataaattaaaataaataaaaccaaaaatagtaggtaatgagaattgttatgatgaaaaggaaaatggttaatatgaaaagtaactggaagccactttaggagaggtaatagaacaaagcatcttttaggaggtaacatttaatctgaaacctgaattataagtcggttccgcacaaaaagagaaggagattccctgaagagtacacaattaatgctgaggcctaatttggaaaggtactttggagtatcccaaaacatgaatgctcaattttattttttaaatggtatacattaaagcatgcaaattcaaaaattcaaagaagaaatggctactctcatactcaagtcatgaaaataatttctaaaggactactaacaattagttaaccagacacatgaattctgggttggctggtagaggatgctggtcttgaaattctgattcatttgtttatttcttccacctttgactaatgctaatctagtttatctttcccacgaagcatgtataacttgctcacatttgtaatggaaaaaaggcagacttgctgctatctgtttctggggcctaattcctaaaagggatatatcttaaaataaatttgtttctcaactctattgtttatactgaacaatcgaatttcaactattaattttattataatttgtaattgccattatattattttattatcactaatgcatttttctgaatttatctatatttcaaaaatattaggtgatttctacgataataattgtaaaagaaactatcttaggtttattgggagaaagctaataacttgctcttactaagtgtgtctaatactataactctactggatcatattttttttccaaactagatttaaaataaaaaccaaagcaacatcattgccttctaattaggtaataatcatgaagatacaaaataattgccccttcttaatattcaacaacttgaaggaaaatattaccaagttttaaaaattcacaccatgaataaaatttaactcaaaatgaatcatagccctaaacacaagagccaaattcataaaactcttaggaaaaacacatggccttgaatttggcaatggtttcttggatttgacatcaaaagtacaagtaagaggaaaaaaaataaatttaacttcatcaaatggaaacttttgtacatcaaagaacactctcaagacagtgaaaatacaacccacggaaagggagaaaatatttgcaaaacatatatctaataagggcctagtgtctaaaatatatagagaactcttacaaccaaataagacaaacaacctaatttagatatgaacaaagtatttgaataggcatttcaacaaaaatggacaaagggccaacaagcacataaaaggatgcttaacatcacctataattatgaaaatggaaatcaaaaccacagtgagatacagcttcacatgcactaggatggctttaataaaaaacaaaagacaaagccccccaaacctggaaaataacaagtgttggttaggctttggacaaagcagaacctttatccattgccgataggaatggaaaatgctgctgctgctgtacagaacaccttgatggttactcagtaaattaaacatagaattgccacatattccagtaatttcattcctgggtatatactgaaaagaactgaaaatgagtgttcaaacaaaaacttatacacaaatgtgtacagtagcactattcacagtagttaaaaggtagaaacaactcaaatgtccatcaattgatgaatggacacattcatccatacaatggaatattatttagccatataagagaatgaagtactgatgcatgctataacatggataaaatttgaaaacattttgctaagtttaagaagccagatacaaaatgtcacatattgtatgattccatttacgtaaaaaatatgcagaataagcaaacagatttgcagttacctgcagctggatgaggggagtgaggagtgacaacttaataagtacagtttccctttggcatttttggggttccaaaatattttggaaatatacagtagtgatggttgcatggcactctgaatgtactaaatgccactgaatcgtagtctttaaaatggttaaaatgataaggtttatatcatatctattttaccacaatttttaaaaagttgacttaggttgtcctataaataaatttagtgatgattattctttatctattaataaaatctgatattgactagacctaagtagctggtaattcacactcagtacacatttatataatattaaataaatcattcttagatgttgcagattgaccccaaatgaaaatatcaattttgcggtggctcacacctgtaatcccagcactttgggacgccgaggcgggcggatcacgaggtcaggagatcgagaccatcctggctaacacggtgaaaccccgtctctactaaaaatacaaaaaattagccgggcatgatggcgggtacctgtagtcccatctacttgggaggctgaagcaggagagtggcgtgaacctgggaggcagatgttacagtgagccgagattgtgccactgcactccatcctgagcgacagagcaagactccgtctcaaaaaatatatatatatatcaattttggaggaaaggcatttaggttatagtcatttaattatctggctacccacatattttttcttgataagggattgtcccaaatagtgggatatagtaaagcactcaccaggatttgtaatggactgagagaacaggatctactaataatatgtacagctatatattagatctatcacaaatatattaattgcaattcatcaaaaagcaacagaagatgaatgagaagattagaggattttgccatctgtctgcctgggtaaaatcagttagtatttttgtgtgaactaagaggtttggacacaagctccttcttagttttctaaacatatctggcagcagatattacctctccaatttaaactttaacctagattttctatctctaaagtctcattatagataatgtagaaataacttttacaattaggtccatgccaggaaattgacaggcaaaagaaaggttaaactgaatgcttgtgcaatttaacagagcacttttgttatgttgtatgtaatgttgcaggggtggttaggggaaataaatttttcagtgtctatgacaatagttagcacacagacatttcaacaactcagaagaaaatttgaaattaagatttgagctagagcagtagaaataacatgaaaaacagatttgggaaacattttgtagttaaaaatcaatgagcttacctttgtttataaagataaaatccaaatcctgcaaatataagtgcaaaaaaaggcacaagaatagcaatggctacagaactactatttgtaccatgaggttgatttgaagaatttgaaccttctgacatattcagtcctacaaaataaaaaataaattataaatacacaactcttttatcataattaatttctactcccatgaatcaattaatttcttctattctcaagatatctacctggaaatcacatagtaaacaaaaataattcatgaaactccttcaactcatttcacatatgtttgcacagtgcctcttagaagatatttttccaggaaagggtacagacaaaaaaataggcagagccccgaactaaggagtttatacaatagtgggaagacatatggagtatataataagtgtgtatatcaagcatgaataaatggtcaatgtgctttagaaaggaaaggagtaattctggaggatatacaacataggcttggcttgaaaaatcatcatgaggctagaaatgggaaggtaagtggcttaggtagtggatgtgacaagcactgacatgaaataggagtgggaggttaaaagaataaactatggctagactctaaaagggaataaatatcattctgacgaactcaaacttttttttttctttttcttttctttttttcttttttcttgagacagggtctcactttgtcacccaggctgcagtgcagtggagtggtcgtggctgactgcagcctccacctccccggctcaagcgatcttcctgcctcagcctcccaagtagctgggactgcaggcacatgcaaccacacctggctaacttttgtattttttgtggagacagggtttcaccatgttgcccatgctggtcttgaactcctgaactcacgtgatccacatgcctaagcttcccaaaatgctgggattacaggcatgagtgatggcacccagccagagttactatccacctcagtgaggaacaactgaaggtgtttagaaataaaagacccagtgatatgacatgagatttagaacatagcggtagtaggatggacttcagggaatacagactggaatcaggtgtagttagaagattgtagtgacagccgagattaaaaaaaaaaaaaaaggaattaaaatttaaactagagaaataggaagtgcatgggacaatagatttgaggaagatttcataatgaaaattagcagaacttgtttatgtggatgtaagaggcaagaagacacaggattacaagtattctacttgaagctcagtaaatgccgatggcattcgcagagttaggaaataagaaaagccaagcttgtcgacacatttgcacaggaatgagggaaaaagaaataccagttctttcttaaaaggaaatagttccttttttgtgggttctgcttcagacttgtagtgtttgagacactttggagaatattacatgaaaatattcagcactaaattatacaactgtgtaaatgcactatgttaatgagtgtttttacctgtttttaagacaaacacaggtaggatgtgatgtaaatggcatcttattacttttcatgtagagaaagctaatttctctttttgacaaacagttacatttaactaaacctcatctttgtccaggttaaagaaaattagtatcttattttttaccttatttttcctgtgacttagtactgctatgtaaaagttcaaaattttttaaaaagttcatttttggctgggcatggtggctcacacctgtaatcccagcacttggggaggccaaggcgggcggatcacctgaggtcaggagtttgggacccacctggccaacatggtgaagccctgtctctactagaaatacatagccaggcatggtagctaattccagctaccatggtagtgtgcatggtggtctgtaatcccagctactcgggaggctgagacaggagaatcccttgaacctgggaggaggagtttgcagtgagccaagactgtgccattgcactccagcctgggtgacaagagcatgactctgtctcaaaaaagaaaaaaaaaaagttcatttcttaaaagataaatgtcaaataataatttttagagcctgaatttattctttgtgtatccctgtcacagtataataatgggagacagtggatcataggagaattatacaccaaaagctatgtgtataaacacattcttgccagaccattaaaggtttatatacatatagaagagttggaaataaaaatgacaaaattctttgcttcccactgcagaaaatttacatatttgaagagaaccaagtccccaaaaggggcccattcctcaaagttattttctctttccagactctgtgagtttctcagagtgtcactacattttcagaagaatgaaaactgcgacaatattcaaactgaagaaaagtagtacagttctcatgagatacaataaactaatttacagtttaatattttcttttttatctatatcactttttctcctttttatgtgcttaaaggcaagccagtttgtcatatttattagaaataccatgaaaatctaaacactgtacagagttggtacataaagatccagtattttgaagaatgtgattatttaaaagggctatcaaaggtatcaatgcatagttctggcagtacagaatttataatgcagtaagtgtacctaatgtacagaatccacagtcttttttttatgatgtctgggataataacagaagttcgtgaaaatcaaaatgaatacattacccagtctttgtaggccaaattgtccataatctttgccttgaataaatccttgaaatacataagtagctccatcaggctcagcagaaacctaaaaatatttaaacagccaaatatacttgaatactggccatagctatattttcccagccttaataaatacacaattttattctgaaagaaatattatcacaagttcctttcttctatatttttctcctttgcaaaatatagcacattgtgaaaattttccatcattaaaagcaaaagtaaattttctaatttgaaataattatgatatacaaaacagagattggttattaatgtatgatatagacatctgctgtcaataaaaagcaatgacatgaggaaatacagtgatcaattaaaaattaaaacataaaaatactgtacttagtaaattctattactgttccacatccccactctcccaaccttcatgagaagagtttactccctatctcatttagttgggcttggtcctgtgacttgcttgggcctatggagtgtggggattgggattgacaatagttaagttgcaagcctaggccttaagagccatacttcccatcacaccaagtggaagaagccagccacaaaaggccacatactatatgattccattcatatgaaagtcagaacagggaaatctatacagacagaaaataggttagtggttactcagagctgatttgagaatgtaaggcaggggttgatagctaaaggctgtggagtttctttacaacatgaagaaagtattgtagtctaggtgaggtggctcacgcctgtaattccaacactttggaaggccaaggagggcaaatcacttgaggtcaggaatatgagaccagcctagccaacatggtaaaacccccgtctctactaaaattacaaaaattagccaggggtggtggcatgtagctgtaatcccagctattcaggaggctgaggcaggagaatcgcttgaacctgggaggtagaggttgtagtgagctgagatcatgccactgcactccagcctgggcaacagagtgagactctgctcaaaaaaaatgaaagtattttataatcagctatgatgagggttacatatatgtgcacatatattaaaaaccactgaattggacatttttaaatgggtgaattgtaggatacgtgacttgtatctacattgagctgcaagaaaaaggcataggtcaatggatttgagcttatttgagaatcacagcttatttcagaaccacttgcccctctgagagttttggacttctgacaagagaagtacatgctctaggcagcaagtgccctttcagactctgccccaaaatgagatgatgagacatgaagacctggacttaataccacagcctcaagtagtgcctccacagctaacccattacaaatgagaaataactaaatacttattattgtttgacccagaggcttcatggctatgtctaatgttgccaatgctaaatactacatgcaccttacatttgtatacaatattatatttaaaaaatactttatatgcataatgtaatttgatcttataagtaaaataggaaatgttacatttcagcaattcctactactaagtagtaaagtgatatatcctgaagtttgtgttaattaatggcaattagttacctaagtcatgaacattatcataaaagttgtaagaatcttgagtcctcactctaaaaagcaaaggataccaaaccacccatgcaagtctgacatttcacaacaactgatttattctttattatcagacattatactctgggtatggccaccctaaaaaataaagtacttctaagaagaagctcaaactccatcattttaatgaatcaattcactttgtttcctacataaaataatacaattaaacaatctgagtgcattgaagatttgactcagttcccaactccatgaatacagaatgcagaaataggataaacactttttttcctcaggaaccaaacttattgaagcctactagatggtaggcttcttgaacttattgaaggcttattgaaacttatcgaaggctactacatagcagcctatgatccactacagtatcttctttcccattaagttttccttatgaaaaaaaggcttggtacttgagaggatacagtcagatctctcatgctgactcttcagcaaagactcctggcccttgtgttttccactgtcagtcttaacactccactcacataaatcacttaataggagtgactccatggtgaagctacagtaactatctccccataggaagcagctcacataagttccttttcatggactttatatataaaatagtctaaattcatgcttcaatataatgggagtatttaattttctgatgtactttgtaaatatgttgcatattccttaagtagtagtggttccaaagattgaattatattttatccagatttatttatcatagtgctgattgtagatggaatatatttgatgaaatcagtgaaaaactaaatgcagatcagcacacacacacacacatacacacacccacatccacccataccctcccccacacacacgtacaccccaccaccacacacacacacacacgacaaaagtaagcaaaacacatcagaatccagtattcctaggcttgtactttagaatactaaatatttatatttactaatatatatgtatgtgtatgtattcataattagctaaatttagaaaactctcctttcctggacaagctacaaatttatcattaaaatcagcagcagatgttaaaataactatacttacaaagccatccattgcccaattttcttccttcattttcttcacagaagcatgagcaggtactttaataagatatatgcgtaacattaggcgagcttcctggcttttatatacccctgtaaaatgcaaggacattttagtctacttaactttgtaaatagttatacttcattttattatctatcattccttaaatagattatgtaagatatgtaattaaaaaaagaaataaaacaagggcaagtcaaggatggcttaacctataatgctctttgcaaatcctgtaatatacattgatttatctgtcttctgaaatcctcaacttatttcttagttgtggggtttaaattacctatgctatcacaattaagcactagtgttcttaataacatcattccatgatattgaaaacaaaatgatttcttcccacaatcagattctaaaattttcaagcatacaaatccagtgttaaaattcctgatattttccttaataacaaattagttgccaactcagtgaaaaacagtattctaggtgctgcttgagccacaaagatgaatatatattgttcctgtttttaataatttccaacaaagtaggaggtataagtaaggtacacagctaaatcaaacacatgagagaatgtgataaattaaaagccagagagagatcatttcacactagaatgatcaaggaatagttatcaaggaaaagcactggagggccaagcatggtggctcatacctgtaatcccagcactttgggaagccaaggcggacagatggtctgaatccaaaagtatgagtttaggagttccagaccagcctaagcaacatggcaaaaccccatctttacaaaaaatactttaaaaaattagccagccatggtggcacgcacctgtagtcccagctgctcaggaggctgaggtgggaggatggcttgagcccaggagccggaggttgcagtgagccgagatggcaccactgcactccagactgggtgacagagcaagactctgcctcaaaaaaaacaaaaaacaaaaaacaaaaacaaaacaacaacaacaacaacaaaaaacagcatttgaactggttcttaaaaataaagtagaatttttagtttgggaaggtaaatacaagcaatgacataaggaagagaagcaaaaatatatacaatgatttttacatggtaagtgttctaagggtagctgtaagctggagggaaaaaattgtttagggaaataacagaaaataggatctaagaaaaaatctgattaactgttgtttaaaacttgactgtattcattcattctaacttaattgttcacctatgtaatagggcaccataatatgcaggaaatgaaaagataatgagacataggtgctaaggtaaattataatcaataggaggaagatataaaagtaatcgataatattgctgaaaaattgctacaattggtttatatggagacagtaagtgaaagcgaattaatctaattctttgtctttccatatatatagaaaactcttgagtttatctagattagaataagtatacatttattttgggctcttttatagaaaataaagaaaaactttgttaacacatcaaagttaaataaagcattagtcacaatttaaatgtatttgtctcattcatttaaagtttctttcgattaatataaggtaattatatgtatttttaaaattatactacatattaacttctaatatttttactttgtgtttaacggaggatcattcaataataagaatgacactcaaaattcattctaaaatttataaaatcaatgaatataattttattttcaattttttacagcacaaattatttcattattaatatttatatgggttatatctatacagacaagaattttacagtttatatttcatatttgcaatatcaaatatcatagtgtctcattttaaaaaatgagagcaattataattcaaatgcattaatttgaaaatatttattgaggcctattttgtttcagatgttctgctagcctctgggaatacaatattaagttggaaggcaaagagctttcttagaatttattttatattgttagaatatagacacataatgaataataaatataacaaatataatttcaaatattgtaaagaaaaaaacagggtaaggctgcctaaaactaagaatatgtctgacagcatttgtaatacaaagtttcctttaggtcaggtcattgggagtattgcttgaggaggtgacttgtgagagaatatctgagtgttaggaaaaccagtgcaatcaaagataatgagagatgtgtgtactggacacagaaaacagaaacttaagaagattgaccaggttttggttcccttatgcctatttaaacaagtgtagctctatctttatttgtcttaaatattggatgtccatctataaacatggtcatttgaagaaatagctttgtggccacagaatagttgagaaatcaatgatttggtctccgtggttttatgagaatagagaaagatttagttgtattcatacctaaattaaatgttatgatctaatatatgacatctaattctagctaccaaaaattatttaaataacttattttaaaactagttttatatttctgtagtaatattcattcatcaatccaaaaaccagaaaaccttggttctgagtgaatatgaatgtcatcaaaagcaaatgtatcaaaataaacatttcaccatataaaaagcattactaaaaatgatgaaatcataatagaaataaagtcatgaaggtatatttcgctgctgtttttattgcgatacctgaaagtagcagctccatgttgctattgctcagtgttgcgttaactctcccagtggaagcattgaaactagtaactgttaaggtcatgggttgtttccttcctttgaaattgtaagagcctttccatatataattttgggcaaatacatcatcaggaactgtgaatagattaaatataccacacattaattttacaatgccatataaatataagcattaaatagagtattagtttattgaataatgatgtattgctaatacacaataatgttgaatgtgtgttacaaaattaattcttcatataaaaatgtttccattttttagaataaatccacattgtaataatctagatttgttcatatgttatcgagaagagagaaatagaaaacaccagttaaagatattaggtttatttttagaacccaggtaaatataaacttcacttatctttggtcttttatgcaatatatttctttctgaaggaaaataaaatgatttcacagcaccatggcagtaaaactatacccaagtcccaagaggcctgctttttttccagcagtgggaatagatttttaagaggaatagcaaagagaaaggtcctgcaaaattatcatgagacagtgcttctgtgttcccccttacagaatactgagtttagttcttctaataacaggtgctcctgaagaagaacagggctgcaccatattgatagctttgaggtatacaggtatttttagaaattgtcactagtattgttggactctcaaggatgagagatgaattgtggtagaatcaaagaacattctaaagcttataaaattttcatctaaagaaaaaacactattttagatactagccaaaaagacttattgtatttatataaattatttatgtaatttaaagttatataaattggttatgtcaaagtctacacagctcctgggcagcagctgagagaagctgaggtataggattaatcctatacctcacagcacagcacatccctagaaatcagctattcaaggtacccaaccctctttggatgaatgactgaatgaagtggatttaggaaaaagtccttttttttaatttgtctaacaagttattgatgatttttcatctgatatatgcatgtatcacacttcttaccagtcagatcacagggattgccatgacaagctgtgtattccctgaattctattaaaccaagaaagcaaaaccactgtggcagatcagcataaaaataccctaagagttgagtttttactgaatatttcagtaacaactaaaatttctatttccatgataatttataagcaatatagctccttactttgataccactgccaacttccattcttatcactttggagtaatgtaatcactgtgtctcattcatgattttaaatgaaatactgctgaatgttttctcatataacatgctatttgccatataatttttataaataattttactaaaatttagagtttgttaagaatttttaaaaattataaatttttaaatttataatttaaaaattataagtgttgaatttgatcaaatactttctttgcaaatattgcaattatcataattttttgcactttaatctcttaatgtgatacattacttttaaggattatttaaaactaaaacatccctgcatagctatgaagaatccagattggttctgatgggtgttaaagcaaactaaatatggcctgagaaggactccatagttctatatttgagtccttgtaatgaacttcaatctaacttaataggtagacaagattgaaaacctaattcaggagtatgcacctgtaacaatagctgagccttggccaatcccagcagctgtacttctactactcgtacactgctgagtgttcaaaatgtgttcaaataaggcaaacacagaactgtaaccaatctagttgtttctgtctctcccttctgatttctgtacgtcacttccctttctttgtgtataaatttgttctgaccatgaggcatccctggagtctctctgaatctgctgtgattctggggtctgcttgattcacaaattgttcattgttcaattaaactcctttaaatttaattcagctaaacttttccttttcgcatgggttatctttactacaatgttgaatttgatttgctaagattttatgtaagattttctcatttataatcctgagtcaaatgggcctgaaatttttctccctttataatatctttatccgagttattagagctatgttgagcctagagaatgaattttattgtccagaagagtttttataaaacttgaaagatccattctgttcctttaaaatgtggtggaacttaccagtagggccacatagacctcattttctttgtggaaataattttaaccagttctttatttgctataaaattattcacattttcttttattagttctagtaagatgtagtgttctagtaatttgtctgctctgtgtaaatgtttttaaatgttgataattattgatagttttcccttaacatattttgaatttcattaatctactctctatgtagttatgctcacattttctttgttatcttatttttaccagaaatttttctactttgtttctgaaaagaacgacatttggttctgttgagattcttctactgttttgggcggttgcctgtttttattattacattgatttctgccctgctactctgttacagtcttaatattctcttaatagggacacaactaattaattctgaggcttttcttttcaataatgtaaggatttaaggctacaaatttccctcttaactttccttttcttatagccctcaagctttgatatttcaatttttcaaaataactacattctaatatatttctgtgttgatgtcttctttaattcatgagttatttattattactaattttgctctgaatttccaaacatacaggaatgttttaaattacatatttcctcattgaactttaatcacatcctagtcagatatgagctatgaagactaactttgcgttttaaaatttgtttaatttaatttattatttaatatatgagcaatttttttacagatttgatgtgctggagctattattcagagtttccacctggtcccaaatcaagcatttcccttggaaaatttggggcattgatggacaattatggttttctgactccattgcaaacaaactctgccttacttttatgtattctttgattgcctcaatggcattcagcatgttttcgacaagtgttgaatgtatcagtataagtcacagagcttggtggtccctccacttttatagcatgtacatggagcacttctaaacctcactaaaattagatcctaatgtagttcttggcccaatacaactgagagaaatctgtttccaaggtgaagatcagatattatgctcttattggcagcttttaaatagtatcacataaacaaaatactaatactgaataagcatgatatggtttggctctgtgtccccacccaaatctcaacttgaattgtactcccataattcccacatgttgtaggaggaatctggtgggagataattgaatcatggatactgttctcttggtagtaaataagtctcacaagatctggtggttttatcaggggcttctgcttttgcatcttcctcattatctctttgcccgctcgcatccatgtaagacaggacttgctcctacttgtcttcctccatgatagtgaggcttccccagccatgtggaactgtaagtccacttaaacctctttctttttaaattgcctagtcttgggtatatctttatcaggagtgtgaaaacgaactaatacaaagcaattcatatattgagcccttactatgggctacgcactctgcacttcatttgcatgaagcttattatataattatttaattattatttcttttggatagaaaaagatatggagattcagatatataaaataatttttccaaggtcacaagtcagagagtatataaaatgagatacatcaaggttgtagggctttaaagtttatgtttttattgattgtgctaggttttctaatttgctttttaaatcaaataactgaaaataaactagtcaatttctagaagttaccgatctttattctcataccaagtgtatttggatccttttaaaaacatatacatttaaaaatgttaaataagacctcatttttattttaatattttaaatgacagtattgccattatgctatagtcatttacagatactcttcaagggaaattttaatatttttagcagacggaactatgaacaatacttttggaatactaacatgtcactgtattacattgctttaaattcaacatcttgtgaattatcaaattcaagacagtcatagttttttatacttaaatatattttttaaatacacagttactatgccaagaaaatagtagaccatttttagaaataatgaactctagaaaaacaaatgacattactaaccacttagctttgggctgggtgttcccagtgcaggtctaggatctttcaccaatattttagaaccagctatgaaaagaaataaaggtgtttacaaaagttgatgcaattaattacatacacatgcgcacacacacacacgcacacacacacacagtgtgatgcactgtccattttattctctgacatttcacatagatagttttctctaaaatgttccgttcatcacaacatctcagtcccctactcagcactcgttatgcaactaatgatttcaataattattcccattacagtctattggcacaaggggcagatttgtgttgctttatcatcttgggatgtcatttcttattttagaggcataagccaaagtggagacagttgcctccaacatggaagctgagagctgagagttgtttttgttgacagaaagcaaaaactatttgggtagggtttacatttaaaaatcaaagtttgttgagataattaaagatgtcaccagaaattggatagacttaaaggtgaaatcttccaggttttaaaccaaaaccaaaggtagtccaaaaccaaataaatcatgtaggatgtagaagtgactggaatattataggagctatgacatgaatgccttgtaaactatgtatcctaagaacaatgtaatgtcttaaaagactgtaaagggatgtgatttcggcaaatgttgctctggctgcaaaaccaagaaaactttggaaagcagcaagtacggatatggctagagaagttgagagacactgcagtagtcccagtagagataatactgagttagagtatgatagcagtgacaataaaccaaaaaggggaacagacgaaaaagctattgaaattgtggtgacttggagggataggaaaatatctaaggagattactagatctcatgtgtaactataggatggtaatatcactgagatagggaataccaaagggaaactatatagataaaagaaatgtatgagtttagttttgcatgtattgagtactgaaatgccactgaagaatttcactagagatatcaagcaaacaattgaatatgtaagtgtgaagctaaaataagataaataagccagaaatattagtttgtaagtaatctacataaggacagctgttgaagccactggtttgaatgacatcacctaaaagtgaatacgagatgaaaacaagagatggctaagtactgcatctttagaaaatcataagtagaaaacaatcagtgtataaaggaaatggagaatggatacttagaattaggagggagtaaaacatttactcattcaacaaatatttattgaatgcttttcacatgtaaggtactgatttgtgttaaaattacagttgtaaacactttgagtgaagtctctcatgagattatattctagttgaagaggggtagataggaggacaggagagtggaagcagataattacaagcaaacaaaccaaagaataagatcttctcatactacagcgatttcaatcataaaaaaaaaatagaaagaaaaatagcagaggaatgttctgataaagaaaatgaaaacatttcaagtaaaagaaagtaattgtcatttatgacagctgcattagataaaacattaggtcttacaaataggttttttggatataaggaaatggattttgttgatgaccttaccaaaaacactagaaaaagttcctttactccttcttctggcattataacccttttccaaatggaaattgtcctgaccgagcagcaatcggtggacacttcacccagatctggtccaaatattaataccatatcaccctggctgagtaatggatttggagatgggatccattcaaaattgtggcaaatagaatcccagatagtgctttcctgaccaaaactttgggaaggactctttctactagggttactctggcagagtaatctaggcattagggtagcaattctccgtactctaatgaatagtgtacccacataatttatgttcacctggtacctctatgaccttatttggaaagaaggtctttgcaaatgtaattaactagagatcttgggataaaacaatcctgattttaggctgaaccccaaatacaaggactggtatcctcataagaagaggagaggccacacaaagatacacagaaaagaaggccatattgaaatggggtagaaattggagtaaggctaggagccaatgaatacccagggttgtcagaagctatgagaagataggaagaggcaaagaatggtttctgcttagagcttacagagggcacaaggtcctgctgacaccttaattttggacttctggacttcagaattgtgaaggaataaattcctattatgttaagccgcccagcctatggtactttgttataaaagccctagaaaaataatatacctacctgaagagagaatttgaagatagaattaaggcaagaagtaacattctcatgggaaaaaagctatgaatagactcataaaatttatatgcctctggatccagaagtgtttacattactcctagacttggagttagccaacaaatttcccttgttcctatgctaatttgagttgagtttttgtctggagcaaaggaaagcaatagtgcaatctcttgtgttaaaaagattctatagagaaaacttaccttcacaaatgggaacttttccagtccaggtgttatcggatctacacactctatgttctgttccacctgctaagaagaagccaggctgacaggtataaatcagtgtatacccatgagatggaaggtccatccctacgacatttgcatgagcaggagtttctggctgtttacagctgtgggctatattaagaaaagagaacaatgtaaattttctatagatatgttaagaaaaatttgagacaggagtcacaatatatttcagatatacttcaatgcctttatatacatatatcttagaataattattctaataaatcacaaaaatgtttcaatgcaaatatacttattgatttcatactttagcatttcctaatccaccatttgtggaacactagtagatgttaatagatgttaaataaattgagaaaaaaaaagacattgtcaacaactaagctcagaaatgtatgctttaccattttagagagtcacacattccagagagtcacaaaaaccagcattttaaaggatctgtgaagttctgtggtaagataccttttaatgtttgtcaagctcaggttttctatatgagtttagaaaatattattttataaattttaaatgtattatatttattttaaattaaaaatctattttctattgttaaataaaaccacagctaattatattgctctggtattaatacttcccaataaaagtacattttaataatttttttacatatggaattttcaggccatatttggatccatatgctagaagtatcattttgttcacctaactctctctccttttctccatgtttccttccactcctaattctctaccttgattacaccatatcttccccttatttcatcggttttatgtcttataaagaccattcctttctccgtcagagataaatgctacaagaaatttttcccctgaaacagatagcattttttaattatttgttcatagatatacatccataaaagtgatctctgaaaaaagtgttctgtggataaataaaaaaaaacaatatttttcatttgtttcttaatggaggtccataacagtataaataatagctaacatttttttactccgtgtgctaaacattgtgttaaatggttttttgtttttgattttgttgtttttgagataagagtttcactccgctgcccaggctggagcacagtgtcataatctcagttcactgcagcctccacctccggggttcaagcgattctcctgcctcagactcctgaggagctgggactacaggcacctgccaccacacccagctaattttttatatttttaatagagatgggtttcgccatggtgaccaggctggtctcgaactcctgacctcaagtgatctgcccacctcggcctcccaaagtgctaggattataggcgtgagccaccgtgcctggcctaaatggtttatatttaatatattgcagttagtgaaatgtaatcctcatgcagtaagtattgataaggaaaactacagtctgtctctactgccatcttaagccctatgttatggacacattagaaactttgagatgcttcacagtgacagacgctgtttaactttatttaaactatcatatcccaactagaggacatcaaagaacaatggtttactgtgaaatacctagttacagcccgcacagctgttttaaagtacacattctgaggaattctcctttaaggaattttccatatttaaatataagccaacaaggcacataacatggcatctctgtggagtgttctcctgctttaaagtaagctgctggtccctaggtgcccccacaatcatttggatggttctgaacagggatagagtaaattcacagggcttgtgtatgcttcagcaaatcctaaaagctagataccatcctaataagtgtttccactccagcttacttttttccatttttcaccaagaaacacaattgaaaagataagggaagagatttttttaaaaggcaactggagagaaagaaaagccaaatagctgaccagctagaattcatttctaattgtatgtcagaaaaagttatttagtggccccaggctttgttcttatttaatctgtatagcaagtgctctccactgaggatcagagaacatataaaggaaattctaaaattgttctcaaatttttggccaagtgcccatgaatatttcctttcatagatgttgttagtttccccagattctcagataatattttcacaagcgatttttaaaaattagaagctgttagattggttcctcgggtattttagattacttcagactgatagatgcagatctataaactaaaacctaatcattacctaaaattaccaggtggcaaaactaaacataaggtctttacaaaaagaacaaaattgtgccttgtgctttctgacttacttagagagtgcttcccaatggccatgggtttatgatacagtaataaaattatatgcatataatatgttttataatctaaaagtcaatttgatacacatatagatgtaaatgtatttgaatacttgggagaaaaaatgcatataaattcttacccatgatagcattatttcttatccataatacttacgtatgcattcaggctgaatcccactccacgtaagatcagggaggcaggtgcgtgttgtagacccttggagaaggtgtccttttttgcaatggaactgtacaacacttcctacctatagcaaattaaagagaggaaaaaaatattcccctacaacttcaaatatggcaacaaacagagcttgagtgagaaaatgttatcaagtgaaattccgtatggtaaagttggaagaaaaaaataattgaaatctgatttaaaataaaatgggaaaaattcaaaactaaaaaataaaatcctggctttatttgtttacatatcatcatcaaatagttgggtccttagtacatacatagaaaccaagcttttttgccatgggaatttgaagaaaatatttaagacaccaaaaaatccaacaagctacatatgaatacaagatagagagatagatagttagataaagataaataaatgaagcttgataaaaatatatatggaaataaatatagctaaccacataagaaacaaataaatattgaaggtgaaaaatgcaatatgagattagagacaaaggtggttactgaaggtggtggtgataacggaaatatacaatggaagatatactgtttgtactagcttttaagggtatagtaattaggagaatatctaggacaatggctttcaaagtgtagtctctaggccagtaatatcaatgtctcctaggaatttgttaaaaatgtcagttctgaggccttaccccagacacactgaatcagaaactgttaggttagaaaaaccaataatctgttttaacaagccctttgggtggtggtaataaacactaaagtttgcaaaagacttacagaaaaatggaaaagataataacatgatgagaaatgtatgttggttacaatatatatcatttgctttaggggaaaacagtatattagattgattggcatttattgtttacaaagtgagcagggtaggtagaggtttgggataagtgggaagcaggggtatatagtaaacaagaaaacaaatcaccagagtaatgtacatgtagttttaattctggatctcactttacttgaataagtcatatctcctatctcctctttgagacctaatttatcatttataaataatgatgataatattatttgtattgaaatctgttttaaggattaaatgaaatagaatttatactccactccaccccaggatgacactcaagttttaaataaattataggcatgatgactaaattggagacataagtaagaattagtttccgaagggtctcaaatggcaggatatggtatttagaagaatagtagtaattctaattatgaggctggcactgccattttacatttgagtggataaaaactgtactaacttgtggcagtaagcctggggaaaaaagtcatttcctcaaaacaatcacaagaaaaaaatcaacaagatttattggatgattagaggtggaggatgagataagggatatttagggtctgccactttgtacttctccagcaattgcagtctgagaaggctcaatcacagttttaggacttatcactcagatccttttttctgccttccccttaattcctaccccctcttgagcggacaataagaagctaagcttaagatgatataatttgataccaagattccatttgaaacttcagactctgaattccaccatttttcatattgttattattacccagaactatactaggccagaaatactaaattccaaaattctttatctgacaacaaccttttttctttatgttatctcatgctgtgtcttccatgaaccctcacctttgcctctagaagatctcttatccctggatgccccattttctctaggctgttacatggattgattccaagaagcaccatttgcattttattccttaaaaccagagtcccctgacttgtgctccagagcacgcctttcacattctttctgaagttgtgcaaaatggtggtacaggttttgatttttcagtatgggctagattatgttatatacagtttgcagttctattcttcagtcaaaccagttctacaaaatccatcatctctatcaatccagcaatccttcttaaggttagaacccagttaatagtgtcacttgtcactaataaattttcccttcattcacttcaccaccaaaactggcaattttaccttctaaatccttttcaaagtatcgtcttccttttttctccagtttacatccagttttactccccaatatcttttccataggctttggttctcactttagcagacatcacaatcaccaaaaggactttatgaaaacagtgatagctgagtacccccctccagagtttcgtactcagtggatctggggtaggtccatgaatctatatttccaacaagttcccaggtgaaactgctgctgccggttaggcgctacactttgagaactacacaatagacaattataataatcttctaatttgtctccatttctcacttcatgatccactatatttattttctgccttaaagtcagagtgatctatgcaacacgaaagtttgaccttattattcacccattaggataaagttacattgagctaacatgacaaaggcctccataactgagaatctatctagcatcatcattaacagcttactttactcaaattctgttcaattaacattgaacttttgtatcctgaaatgcatgcatattttcatgctattcctactgcatggaatgcctctcccaactttcctttcctagctcttacactaaaagaattagctcagccatcatctgtagaaacccttccctgcagcaagaaattagaaaaaccatctctgttagaaatgttagcctttctaggccggagactgtgtgtactcatccttgtgcaccttgagcttaaaaatgtgatttgaaaatgttggagcaatggaaggaatggggacaaaataatataaaattacttgattacttaactttagaatatttaacgtctatcagttcttaaaatgcagtgatatcatctctatactttagataatgtaaggttagatcattctgtttttttctttgaagggtatatttgggttatttcatcaaacctttatattggtcaggtataagaaatatgttggactacatacactttgtttttacttgtaagacatttttcttcaatcctgtaagcttttcaaaatcattataacaactgctttaaatattaaccaaatattatagaattaaaataaaatctgttttaatatttttctgtgtatcaccaacacatctaataagatttttgtcaaattcacaaatacttatacctaatatctaataaatatttatagatttaataattggttaaattgtttatccagaacttgttatagtcaaatcaacaaaattttctctaaatatcagtgcattaataaataattttgtcagtgatgaacccacttaatagtgtattttaaatagttctttatcctttcccaatttgatatatccttctgactgaacaacttccaacatgcatagtataatttgcttatttgtagaaaaataggcaacaacattctaaaaatttatattatcaaattcaaaaaattcttggaaaaataacttatgtacaattttttcaccaatatttacgaataaaaagtattatttgtatatcaaacattgcaataattaatattgaaagtttttataacaagaattaaaaacaatccatatcaaattttaattgcaaccaatgtttaaataaaaatcactttaaattgatttaaagtaccatgttgtgtataaatgcattatagaattttaagacatgtttaatcagtaaacatcacttatgttctttaacaccttattctcctattttaaatgttatatcttagttcctaaatcataaaatttatatagcaaataatataatagacattttgtatacattttgaacattctcagtaagctctattttcccttccatgagatttcatggcaaataacacttggcatgctagaattttcatcaatgcatttatttgaatctgacttctaatatcacatgtttgtttaactggagtatccagcatgggtcttaagaactttcaaaatttatttattattaaggtctcaaaaacgtatatgcttcttttgcaatatatatttttaaaaataaatttacgtttttcattatgtatttatacaaaacattttactcaagaaaaattgaggtagcttctaataaaagatatatgtaaattaaaataaataaaattgacacagaaaggcaagatcataaaaaatgaaggtataacagatgtgcttcagatgcaagtaatttatgctgactgagcattaactttggtcctaggcttcctggttcaagaaaagtttaattattattatttatattcaaaacaagaagattttaattgaaagtaatttttttttactttcagaattcatgccactgtatttatcatttaaggtaataaaacactatgaaacatatatttacctcattcaatatactaagatactaatttcaattacaaactgaaaatcatatataatcactatggttagtttggtagggttaaatattttatggttaaatatcttgaggctaaatatctaaagagccggattaaaaacttttcatatttataataactttatgtaacaagccctaaatccaaataatgtactttccattgcccagagctcagtttaacaagtgatacagcagtgtgtatgtgtgcttgtcatttactccatggttaatcctgatgttgcatcaattattttgacagctattctcttcactatcaatttttagtaaaattattccaatttacaatattttaatacaaagacaaattatgttgaatacttttttcaatgatagagttttcatcatctctagcaatgagtaatatattttgtatgttaataattattgatgtcccaaaatctactatataaatctataaagaaaaagagagtgaacaaatgaacacattaaagagaaaattaagaaaatgatctgagtgcctctgtagttcataactttctcttgctcttcccaaaaatgggcttcctaacagctgtgattttgcgtcataactcactaccggccacctaatgaaaccaacataaatacgaaagttgggacattctgattctccttggaaatctggaattgagattgagatgatcactttctgtatgtagctgagatgtaaatagaaatgattcactcttggccatatggccaatctgcggagagaaaatatgaagtagataaacagaaagtagtataaaaaactgagtacttgaagccagtacctacactctgggtttgatgagtctcacatggattctttctttgggagtctggacatacctgcacagtaatgcctttaggctttaagtagctccaaacagtttttttgttacttgcaagcaatcgtttttctcaatggctcaagatgccttttgcatataaaaccatattcatttggaattcatcaataaattagtattaattagaattatataactatttattgtgttagatctatacagatttagttaacagatttagtatgtgtgtgtgtatatatatatatatatatatatatatatacacattcatacctgccatatgcatgtaagaaagccaatctccctaatgtaagacacaaaatacatttaattttaatagatagttatataattgtatataagtagactttaccatatttggaatctagtctatttatatttattcatatagaatataatgatttaatacctgtttattaccccaaataacataaattcagggttaggttaactttgttacagcatttttcaatgattataatagaatccttagaaagcagagttagtgattctcttcattttgttggatgactgttttaaactccacgttaatcattctcatttccaatatctcaaataatatttactaaaaaaactcatattctttagaaaatcagcctgatttagtacaccgacactaacatcacaattttgtattctgttagaatatgtcaccaacttgatctgcgaacaaagcaagtcacattctgtttcagtttctttgtacatatgatgaggactagtgctgtgcagctagttgcccatttttcaggatttagatcaattgataaaaccttttatggagatattaatctaaagttctctaaaaacaccaatataatggagacagactcatttttacacttttgtattatctggaacaggactgaaggaaatcagaagaattggaaatgctatcaaatcaatgttcatactgtgcctgaactgtagataaatggaaactatttttaataacaaaatatggccctttagatgagcccttcctttagaaatggatggtcttcaggttcacgctgaatttcacacagaatagcacaatttacaaaacccggcaacacagggcaattgggtaatgtgtaaattggctacttctgtttggaatcagtatgcactttggctccccttggatcttttgtaactgaaaagttgctgaatctctacctaaaatctaaattggaaaaagagagaacaagaaagtcagccacacatgactgggcatgccaaagaattctaatgtaacaattcaactatgtgttgtatagcaacaggttctggttatttttcagcaatttcccaccattttaaacactgacagcaaggtcatatatacaattagtgctttattgaataacccgcatttttatatatttgctgtttgtctcagaagtctctcctttaaactcttttatctttacttttcttcactgtccccatatcttcctgtagagtttactcatttactccctcactcttactgtcttatatataactctctaatgcttatggatttttcctatgctcactgctattttttgctttttgttttaatttatttttatgttccagttaggaaattttattaaaaaaatttttttttctaatttcctttacttccactcttttgctgtctgttaccctttttatgtgtttataaatgcagatagaacatgactttttgttatgtcaacaagattatatgcatatgaaccaaagacgcattctgacctagtatgatgctaaatggacatagctaaagtacccacttgaaatccgaatgtattgttctgagatccatgccgaggcacacctgggttttcacaagaggtttgggtaggctctaaaatgaagattaaaaagatattagtcctttaaaatttacaatagatatagttctctcacagaaaacaattttaaataatctggggtttggtacaaaggatctaggaaataataaataatgtaaatgtaataacatctctccatggacagaagcctgttaatcttgaagcaagaaagtcaggtagactccatttgatatgaattatgaaattcttgaactttgaacccttccgatataaaagcacttgacattcaactagctctgtggatgtaaaattaaggaaagataaaggatatgaaagcagtgtacatgcatataacatttgtccaaagaccttgctaaactatgatttggggtagggtaatatttctttgaagaaataacagttttttcccagaaacaggacttgataatttggattttactgacacccataggatattcaggcataataatggtaggtagatgtgtcggtttatttgaatgacagattatttggttagtttaccaaatatggcattaattttaggattacagaaatatagttacaatcattttgaaatcaatataacttttagatatttttggagcaaatctaatttcatatgaagattctttattaactataaaaatctaagtaaaatgttagtacttaataatgtcactacctgaaagtatttttatttttcattttactgatatacaacaaaattctttcaagtgtttcttctggaagtttaaagtgctaaaattaatgttgtattttctaccaatattcatttccagtgccttctaattgcttctatattttacacttgtttttatattaagccaactataggttataggataaagaaaaccattaaatgtcacccctattaattacacagttactgtgcataatcagcctttaattaatattacctatgcagtgaggtgatgaaccactccaagtgccatctgcttgacatattctggtgcttgatcccactaatatgaaaggaaaattgcagctgaatgaaacctctgactggtatataaagcttttgccttctctttttccttgggcaggtataccagggtcaccacaaaactttgctggaaatgaaaagaaagacgcttatatcaaagatttagtatacagcagagtacacagtttggaaaaatggtgacaatcaatttgaatattgtactaaagagatatattattcatgataaagctatcccaatgaaaaaatttattttttagcttatgtgcagataaatactgaattgaaaactcagtataatatttaaaaattagctcgatttcgatgttttccacttagtaagctaccttaataaagaaagaatttttgtacttttgtcgttttgtattgaccaaaatcaaaccacatatttggacttgttggctgccaaggtggagtatagccttgaaaaagtaggtgactcataggtgtccctgtcaaaaagaagcaacccataatgttccaggctgcacgctacagattgcagtgcccttttacatgtatataaaaagctctggttatttgttttattgtaccctgtatactttgaatactcgaagcacatatcccagaaacttattgccttcctctccaaaatactgtcggtatttttaaagcattttttaaaagaaaagaaggccatcagaatctaaatctacgcaaaactatggaatgtcaatgttctacaacaagcactggaaagatcaacgtgacaggctttctaaaaattttgattagattattccattcaacttacatttattaattactaaagaaaaacattattctaggtggtttggggcacttgaacatgtcagtaaacaaatactgtaggaaatctgcttttatagggtttatgcatttgtgagggaagtgaacaaacaataaacataattagcaagtttaagaaaaggtagtatgtgaaaaagtggtaagtcccgtgggaaaaaaaaaatcattcagacaaaagagatcaagcctgtatgtatgtgtggtggtgtgtgttaggaggtgggagaagatcttaaataaggtggcaaaggtgtctctcactgagaaaagattcagggaaacaaaatacttagccatgatgaagtcctaaggaagggcattctaggtagagtaaacagcactgccaaagccttctgctggggcatggctagctttctagaggaagattaggaggcctgtgtggctggagcagagtgagcatgaagaagtgtaatggggaatgaaagcaaatgatttcaaatatatcagacaacacaggcaaatgcacctttatcaaatgctttcaatgtttttattgtggcaaagaaaatacataacatataatttataaatttaacgattttcaaatgtactcgattttcaaatgttcagattaagcacctgaaagcttacttccctctgaagcaaacaaacagcaacaacaaaatggttttaagtataaatgttgccttaggaggattataggttgggtgtccataaaatgcatcatccaaactgagaaacttttgagagtgaaaggggatcctaaatgtacaagagatcgaccacaacaatgggaataaacttggcatgcccgagccatctggaacgcatgtataccttaattatagactaccataatcttggccttaatgtccaaataaaaccttccctgaaattcaagactacacgataaacttggatttttaaacctccttttagtagcatttaaaacttttaaaaaataattaaaatgaaaagtaatcattaacagctatttataacaaacccacagccaatatcatactgaatgggcaaaaactggaagcattccctttgaaaactggcacaagacaaggatgctctctctcaccactcccattcaaccaaatgctggctaaatataaaaacaagtattggaagttctgtccagagtgatcaggcaagataaataaataagggtattcaaataggaagacaggaagtcaaattgtctctgtttgcagatgatgtgattgtatatttagaaaaccccaccatctcagcccaaaatctccttaagctgataagcaacttcagcaaagtctcaggatacaaaatcaatgtgtaagaatcacaaggattcctatacaccaatgatagacaaacagagagtcaaataatgagtgaactcccattcacaattgctacaaagacaacataatacctaggaatagaacttacaagggatgtgaaggacctcttcaagaagaactacaaaccactgctcaaggaaatcagagaggacacaaataaatggaaaaacatttcatgctcatggataggaagaattaatattgtaaaaatggccatacttcccaaagtaatttacagattcaatgctatccccatcaagctaccactgactttcttcacagaattggaaaaactactttaaacttcaaatgaaattagaaaagagcctgcatagccaagataatcctaagcaagaagaacaaaactggaggcatcacgctacctgacttcaaactatactacaaggctacagtaaccaaaacagcatgttactgctaccaaaacagatatatagaccaatggaacagaacagaggcctcagaaataacaccacacatctacaaccatccaatctttgacaaacctgacaaaaacaagcaatagggaaaggattcgctatttaataaacggtgttgggaaaactggtgagccatacgcagaaaactgaaactgtaccccttccttataccttatacaaaaattaacttgagatacattaaagatttaaatgtaagacctaaaacataaaaatcctacaagaaaacctagacaataccaatcaggacataggcatcggcaaagacttcatgtctaaaacaccaaaagcaatggcaacaaaagccaaatttgacaaatgggatctaattaaactgaaaagcttctgcacagtaaaataaactatcatcagagtgaacagacaacctagagaatgggagaaaatttttgcaatctattcatatgacaaagggctaatatccagaatctacaaataacttaaacaaatttacaagaaaaaaccaaccccatcaaaaagtggacaaaggatatgaacatatacttttccaaagaagacatttatgcagccaacaaacacacggagaaaagctcatcatcactggtcattagagaaatgcaactcaaaaccacaatgagataccatctcatgccagttagaatggtgatcattaaaaagtcaggaaacaatagatgccggagaggatgtggagaaataggaacgcttttacactgttggtgggaatgtaaattagttcaaccactgtggaagacagtgtggcgattcctcaagcatctagaactagaaataccatttgatggcctggcacagtggctcacgcctgtaatcccagcactttgggaggccaaggcgggcggatcacaacgtcaggagatcgagaccatcctggctgacacggtgaaaccccatctctactaaaaatacaaaaacttagctgggtgtggtggcgggtgcctgtagtcccagctactcagaaggccgaggcaggagaatggcgagaacccgggaggcggagcttgcagtgagccgagatcgtgccactgcactccagcctgggctacagagcgagaatctatctcccaaaaaaaaaagaaaaaaagaaatatcatttgacccagcaatcccattactgggtatatacccaaaggattataaatcattctactataaagacacaggcagacggatgtgaatagcactattcacaacagtaaagacttggaaccaacccaaatgtctatcaatgatagactggattaagaaaatgtggcatatatacaccatggaatactatgcagccataaaaaaggatgagttattgtcctttgcagggacatggatgaagttggaaaccaccattctcagcaaactaacacaagaacagaaaaccaaacacagcatattctcactcataagtgggagtagaacaatgagaacacagggacacagggaggggaacatcacacactggggcctgtcagggggtgagggtctaggggaggcacagcattaggaaaaatacctaacgtaggtgacaggttgatgagtgcagcaaaccaccatggcatgtgtatacctatgtaacaaaactgcacgttcttcacctgtaccccagaacttaaagtataataataaataaataaatattaaaatgaaatcggaaaccagagtaaagtaacacaagtataataatagcacaaaaaacattggtttactgtgtttaaattttcactatctcttggatattgtaaaactttgggctagttgacattcaagtccttctggcaatgctgtataatatcaaacccaaaagccagggacactgtcttattaatctttgtatattcagtacattttgaattaatacatgcttcccagtgaacatcatcaatgggcacttcagctgaagcaattgtttctataactaacttattgcctaacctacttctgaagtgttcctcttatgcatattcaaataaaggagggagacttaaccacctaaactcctcaatcccccagtaccctctctgtgtgtcattccatctatttctatccgtgaattttcatgtataaaccaaacaacctattgatatcaggtttagagacttaagacacagaatttcttgtcaaatggctttaattcataaagacataaacttttaagatgagaaaacatactttaagcaaaattaaagagaaaaaagcattcctctttataaagtccctaacattaatggatttgcatacccaatggataaggccatcatttcttaagtataccttctctgaacttcaatccatactctgccattttctagcggtatgaccttaggccttatgacaatgtagctgcttccctaaatgatggcagagtaacactgtgcccttgcaatttgattttcccttctgagtttaagtgtcattgtctattaaaatgtcatgactaatcctacgtacccaggagctctattatgtgtagtagaaatgatatacgtaaagcaactgagacaaagatagcgttattacatttgaaatgtaaatacatattttattactatttgtatttcaatagaaccaaaaacaaaacaccatatcaagataacttcttgattgtaatttttttttcagttatatcaaacaaacaagcaaacctgccatatactcatctttgtaaaacctacttgaccctatctgtcctggagaagacctggagtatctagtactattcagaacatagtgatgtttgctaagatgacctcctccatgagtcagaattttaagggcgaattacgtgacaaaaacattgaggcactggaacagacttcctccaaaattagagactcaggtagaagggtgggaggagtagtgagggatgagaaattacttaatgagaacagtatatactatttgggtgatagttacactaaaagcctggacttctccactactcaatatatctatggaataaaactacacttgtaccccttaaatttataaagttatttttaaaaatcatattacagtacctagaaggagctcctttggatgttatatgaactgcagtctagaccactactgtaataataagttagttttatctctcatgctcaatctaacttgttaatatctctctgaagcaaatgtactattagtgacctgatgagcaagcaaaatagccatatgcatgcccagtatttgccatcacttaataggaagcttctcaagtaaataatgccaaagtgcacctaatagtttgtcttcagttagtcatcataattctatgtctataaaatatatatttattttatactaacatatatctgtttcatttttaaaataggtctataaaatacataacttgcattaaattataaaatgactatccatgaacctaacactcaactttaacaattgataattgccaatactgttgcaaatctttgtaggcatcacccagaaagcatcccttttcttaggcccagggtagcatactttgtgtcatcctaaattctgggtttctcatttctatacatttattggtaatttacattcacgtgtatgcatgtgtgtgtgtgtgtgcatatggcatatatgtatgtgtgtgtgtgtaaatataggcactattattttactgctaaaaagaatgctgacaacaatattcttgaacatgtctcctcgtgcacatatatgaaaattccagtagggcatatacttaaaaataaaatttcttggcaatagactctgcaagtctttaactttactaaataataccaactagttttgcaagtggctgtgtcaatttacccacccatcatgagtctatagaagtttatggtactccatatcctcactaatacttgatattgtgtaatatttttttcaatctcctgagaggaaatagctgtccaggtattttgaccatttttcttgtattgccttttttattttagaaaaaaaaatacatatatatattctaaatattgtcattgttttcacacatattgattacattgtacaagtctgtgattggtctctgataatgagaaattttcatattttaacatagctgatattttttcactttttcatttgtgggttataccatttgaatcttgcttaagaaattccttctaaacctgaggtcatttagatagattctaaatgtttaaaacttttatatttaaatctctgataaatctagcactgatttatttgttgtgggtgtgtgtatgtgtgtgaactaattgccttgcagacttaattaaaatgtccattctttccctactgacttgttctataatatatcacatatgtataaatggttctgtgttctccataacattgttttactttctatacctacatcaataccatactgttttaattactatagcaatatagtttttatatctgccaaggactatgctatattccagggacagagcagtgaataaaacaaaaaaaattctctgctttcagggagtatacatttgagtagaggacatagttcaaataaacaagataagtaaaatgtatagtatgtcttaggaaaaaatcagaagtgaaagggaagtgttaaggagaataaataaagcctggaagggaagtgttatatgtcagtgatgaaattcaaataaggtgaccagagaaggcaatactgaaaaaagaaattttttgtaaaaagctgaaggaataaaaggaaatttccaggtaaagtgaatagtgaacataaaagccctcttgcaaaagcacagctgagtgctcaaagaaaagtaagaaggcctgtgtttctggagcagagtggatgaaggggtgagtagtaagatatgatgaaatcagaggaatacaagaaaaaaagtcctatgagcatgtaggggatttagtttccactttgaatgaggtgagaaaaccctggagggtcctaagcaactgagacagttagctctgcataatgtcaaggtcatgagacaggtagagtcctcctctatcccatgctgggaaaggaaaaagaactaggaacaggataatgctagacaactctctgaatgactatactgtccagataatgttctagaatcatttatgtaaaactgcaagaggagtttgttttgttttgtgttcttccaaattaatcttgaagtaacacttgctaggtatatagtatacagcaacctctgtaaaaaaaaaaaaaaaaaggcaaaacaaacaaacaagaaacccttttatctctatgcttaccctggtaattttagatgtaaaatcccaatcattatcatgacaaatgccatcataagaactttatttgaataaacatgtagaagtgacatggatttattgccgaaaaagatttgggaacaaatttcagagtattcggctaagacaaaaaggacataaataaaaataattttccagcagtagaataaatttaaggctgtctctaatttgagaaataattttgaaaaattagaaaagtttataaactaaaaccgtttagtgtaaaattttgaatcagagaaggagaaacataatgacttaattacatgaaaagtagctacattggtaaatactgatttttctttgaaccctaattaggcattgaaggaagcttaacaatctcatatttggtctagaaaaatttgaaaattttaagtaacagttgttagtagaaatcatacttacgtaagcactgcggtacttcaccactccaggtaccattccctacacaggtcaaaacagcagggaaggatagctcatagcctggagaacagatgtagctaatactaaagccccagtcgaaatttgttccttccagccttccattagagatctggggaggagttgggcaggtaacagctgcaattacattaaaagtgattagacacagctgttgaaatatcctgagccttaaagatataaataaatatcattagaagaagcacatgtgctaatttaaccttttcgaggacaatatgttgtgacatatcttattctcctggtagtgttcctgagtcattcctggaattaatccctgcaggatgcaactttttcttggcaacataatggctactggttgtcagagattctcttacaaaatagcaagctgcctgacatctcagagaaggcaaacagagggtgaccttcaatctagtatactgtaagtgataaattattggttttatataaaattattttccaatgacctttagacagacaagacttgggttgtttaactatatatagtatcagcatcttaatcatggaatttgaaagtagttctgtgacatttttgaaaacacaggtcatatgtctgagtataatatccaagttagttcccttaaccacttagattcatatgttaaaccttattattatagggtttataaatgcatttttaatttttttaaaaaatgtattttgtttaaattgttttcagttatctttaagcaaagacaggttggataagatagagatgaaaggatgaggaagggtatcaacttcaaaatctaaacatgaggaatgactgtattatgagaactaaaaacatatctgaatagctttttacagttgagtaatatctaattcatatcagtatgaattaataagtgtatagaataacatctaaaacataaaatgtctgctcatgtattttcatttactaactgtatatttatagtgatctgatacagaagcttaataatcaagaaggaaagacaaacacattgaaattattaattttgttagattataagtcagtaagatattaaactattaattcacatttaaatagaaacgtaaacgaaaaatcttaaatattaaaaatctaattattataaaacaatttgtctgacattgcatgtacagtattctacaagtaatcataaaaattggccaaaaaatttataaaaatatttccagtggaaaaacaaacagcataaagtagcaaatttatggctgtattgactaacaggttaattctagattgtattatatgaaaaacaagtttttcccattatttaagaaaaattacggttctataattcaggccggctcttcccaaattatagaaagaatttttccccacccttgaattacttgacccaagtggatcagcaaattacagttataattcatcaaggttatattcttttgaaaatattcatcaatttatataaataacaatggtgaatatggacataatattttacttatttttgttacattaaagcttattgtcattactcacaataagatataatgtttttgtcaaaatattattttaaattctatatattaaaataaaatttttaagaaacagccatttttagtactagaaaaataaatgcaacctggaactaaaaaattttatttaagtatactttaaatttgtatataaaaataagaaaatatgtactggttaccatttttaaatgttgaagaaatcattatcatacctctacaagttggcattactccactccatgtgccattaattgtacaagtcctgattctggagccattcaattccatcgtgtagcctggctggcacatgtaagaaacattttgtccaaccacataatcatctccatatctcagtccattggctggtatacctgggtctccacaactgattactgtcagtattggattagaagagcagatggttaatgaggcatgtatttaatggagaggagtagtaagcatatggcatacttaatatataagcaggaaaattagttatcgtgttcatttttaatcataaaacataaacatatttaaaccacatactggcaattcctgattatgatcaggtatgcttattacagattctacacatatggctcagaaactgtcacttagcccctgaaaaggctaggttaatatgccattatgttgtagtgaatttgatgcagtaacctcttctaaccttcactataagaccacagagaaaacaatctgcagaatcagatttctaacataatatttgaaattcatattcctatatatggctactgaagtatctaatttatcaggcatgctggatggagagcatattttctgcagtgtcactcagaaagacaacccccaagaaattgcaaccttcactctggaatgtgcttgttataagaaatgcagatgtatgaggggccatcccatccaagtccttgaccaatacatgatgatgtttccagcccaaaatagggactgtcactgctctgttctgccccaagactccattaatatatccaactctgacgatcctcacgtttgcatccaacccctaaaaggaggtaggacaatagtgcaatgtgaacctctctttactgatgacacaatggatgagctgggtggagggtgtcacgttttgcagagcagggatggaaatggggaggccatgcagggccaggggcaacaggttgtcaggagcaaaaggtctagacccatcccaaggacacaagaaagaaggcaacaaggcagactgcacatgagcagaagctccaagccctcagaatatgctgcactgttccagtggacttcaattacaaaatgttaatttgaagataaaattattaagaattttgagatggctatcacagagcattaaactctaagcacaagactcttctgagcatgagatcctatgagttgcactgatctcatgcccatgagtgtaagtgcacacataatattatcgtttctttataatgccagccaaaatgtttcagaaagacttgagacagcttagaaacacaaataacaatttcattaaaaatgtattttgattaaatacaaacataagattcaaacactacaaagattatatatgtcacacaagtgataactgttttgaggcacaggatttaagcttaatttgggcagcgaattggctaaaaaactttctaccagctaagaaaacgaaaactacaagttacactttattttctggagataaaaaacatgtagtatacttaacatgccttttagtctgctaaatcttttggttcataaaagggtaatttctccaggtaaatctgggttattttttttctctctctctctgtctactcctctttctgtcttttttaaattcacttttcccaatattttggagattcaggattaaagattaagaatgaattaaggcatggaagaccttaagaacaccttagttacattgtatttattatgttatcattaagaatgattaatgtcaagattcctttcatattctattctgttgattctaagaagttttaggattatgaataatggcatttaaattaaacaacatcattcagagcattcaacctcataacttttggagcccttaaaacagttcgatgaaattaaactgtttgagtgtttctttctcaataataatagagttttatattcaggactgctttccttcctatgattattggggagtaaaaagattttttttaatgatacaactgagttggatagaaaatcaaataattctactcatgtaccgacaatacgtcatctctttttatagtttaaaaatttacaagaatgtaaaaatgagtataagccttcaatttattattttattttattttatatttataaccaagatttttaattaggaagaggaaattaaagagaacacctataaagtgttgttgttttctgggcagtgctttccagactgcattagaatcttggcaaggagaaatagccagcctggtcacagggcacatgagctgagatgcggccaccaaaagagaggacagagcgtttattttacagatgcacgaagaaagagttctgcacatcatggcaccaccatgaatgaaatgcgtgacaacaaaagctttagaagggtttgtttggtgacttcctaatgaagcaaaggctagtcaaagaggcagtttccaagagcaacagtctttgtaaacagcacctgctctgcaagtcaattcattcactaccagcttgttttcagagacaaccaaaaaaaaaaaggcttttggttttttcaggaaaaaaaccttagaatagtagctctttagtgcttcaccctaaaattcagcgatatcattgtatgacaacaaattcagaaataccattgcataataagaagatcattgaccttcttaaatacccatctctctcacacaaacacaccaataaactccataaaggcagatactttgactcttgtatgctattttcttaagagtctcatctagtgtatgactcatcataagagattaaatatttgtttgaaggataaataaatgaatgagtacataaaggaatcattaagttgtcagctcaaattctcaaaaacacataaattatttgaaaggtctgaatttgttttgtgggaggcttctcaatatgtaattgatgcccatctggcatcatttatgataaatctaagtaaataacctctatgctacaaataaaacataattgtggtaattctagtcaatctatgccgctttaaaactactttctcttttaacttcttatacaagcattgtaaatgtgcattttaaaataaaataaagtcacattacttttttcacaggattcacttttttattcaatatctaatggatatttttgcatgtaactattaatatacatagacatgcataacatttttaatggcatattaatcccatgcaatataatttatgcaaccaaagacctatggactggtgtttgagttattccactgcttttctgttacagacaatgcagcaacgaaaatgcttgcttgagcatcattacatatgtatgtgctctgccatacttctagcttcaagcccagaacagagttctactgtagcaaaatgaagttccagaaagaatggctaaaccattcctctcataatgcttctgattttacacaatctccacattcaaaaagttggtttcttctttagatctcaaaaggcagggtttctctaccttaagcttgaccctattgacattttcagtcaaacaattcttcgttgtgaggggctgctctgtgcattgtagaatgttctgcaatatatctctggcatctgcctgctagatccaaaagcaccccctgcccctgcactgtgacaatcaaaaagtatcttcaaacatttccaaatgtcccctgggaagcaaaatcctctctagttgagaaccactgtgctgaggaatagctctcactccttgaggagatttagattattttttatctgcgctcagttttatgctgggatatccccagccctctcttttgtaagactaaccccatcttcctgatctgtcctctgttagaaaaacatctttgagaattttcagatttgtgacaaaaattcagtcaggggcatttcgataggtggctatttggaaaaggaagccttagattcatttatcacctggacctgattaaagatggtgtccttagcccaaaggaacaagacttcccagatgcaggatgttgggggttggtccttttggacgcagaagtccagtcagttttctaaaaatatcatccaagaaaatgaataagcacatgtcttttcagaccagaaagctaattcttactctacttggcaagccctgtctcagcactgtttgtgtcttcttcccaaaacaccatatgcactctgtgtatgatgggctctaggtaacagaggtggtactgcctgttagacattgaaagctaaggatccccttataattaatatcccaaaacattttgtactgacaaaaaaatgtaattttgaaagagtaattacatgtacttattatatcttctctctctgtctgaacatcatagaaaataacttcactacattttaaatcaaggaattgatttgagcgatctggtattatgccaaatatctttttcttctagtttggttagctctgtgcatgtttcttcacacttataatccctctgtcaaagtgtgcataacattttaatgcatgatcttgatttcaagatacaatattttacccacccaggaggcaactagttattctgaggaaacttctccttccaccactggtagtgggcttaatgaggacatgtctggagttagaaacaatgagtgttgggaaaagggaaaagattttgcttatgaggcatacttttagagatagattaattagacttgcaattttccaactcacgtatagtctgaagccggttgaataacagcaggtagaatttagatgagtaaaagtttatgcttttaccaacatctctactatggccaagcataggggattggagaccttaccattattattaaatcacatttattccaaagatgtttctaaaatcattgaaatgaacaaggcaaatcacagctgacacatttccacatataattgaactagaatttctaaaaaacagaggggtgagtgtgtgtgtgtgtgtgtgtgtgtgtgtgtgtgtgtgtgtgtgtgtgtgtgtgttactgctggacaatagagcaaatgaaaaggtatagttgcaaataactccagtgggaaattctcaaaggtaaaattctcaaaggaaattctcaaaggtcaaaaatgcttggaattccaaagttacttcactgatctgtgaaatattagggagcagataccttaccgactgaactctgtcttctcagttcctagcaaagtgcccaatgatagtaggttttgtttaaatgattttttattaactgaatctataaaaaatccagttccattgtatactcacagttatgtttctactttgtttttaaaggtttttgtaagaaaacatgctctaatataagttaaagatttttgaaaagctaaaaattggattattcctctgatttgtcattactcaggaggaactaagtgcccaaagataactagccaaggtaaaaaacaaaaacctcttaaagtgaccaaaatcttataattaaaaagtaaaaagaaatccaaataaaattgaagtctttatattttgtctttaccacatagtttaactatattttaagggtattattaattttctcaagggcctctattcattctttcattctcaaatcaccctacattgaaatatctatcatataatcaatcttgctgattttctttctttgaactgacattgtcataaatctactagatcctctttgtcaatgattatgtacaagattcaacgagcactcttgttcacttgctttgactcatcacattaaaatatctcatctcttgtgaaacctgcagacttatttattgacttacattatatttgctttgtacatctgacaaaaatatcattgataacaaataaataggaaattgtaatgttaaactggaagtattgtttagcaaaaacaaattttacaaatggtcgtttcattaagaaatgatataattttgcagaattcaaattggtaaatgcagagaaaacagaaattaaaaattttttagagaaataggtcataaattaatgagacattttcatatgccttatcaccaatgttctacttattatagtatgtcatatacatttgaccattgtagtgaagacagagaataaagcaagaaaactaaatggagaaaagtacagaagaagagataaaagtatactaaagaacatggattcttgagtgaaatagactagggtttaaatcttacattctacagttactagctatgttaccatggaaaagaaagttgtttcctctctaagaaaccatttatttgaatgtgaaataaaaaggataacagtatatatctcatagatttgttgtaataattgagataattatgtaaatcagcacaaatccgaacaaatggtaaacactcaataacagatactattatttatgagaagaaatagtaataattagcatgaaaagaataaaggctttgtttctttagtgctatggttttaatatctcttcaaaattcatgtgctaatttaatccccaattccatagtattaaaaggtaggggctttgggaagttattaagtcatgagggccctctccccatgaatgaggttagtgccttctaaaagtgtgggagggaactattaatagctaggcccctttttgctctttcaccttctgccagtcagggcgtaacatgcaccccttttgtcatgtgaggacacagaagcaaggtgccatcttagaagcaacaagtagccctcaccagacacaggatctgctagcaccttgatcttggacttctcagcctccagaattttgagaaataaatgtttgttctttagtatttaaccctgtctcaggaattttattatagcagcacaaatagactaagacattcgggttttctaaaaattgatatcaggatgttggtttggaaagttcagctacttcaaattttttgcatacctcattaatttaattcaaattcatatagtaactggcatacatcaaataatttatttcaaattcatatagtaactggcctatagtaaccataaaatttatatagtctgggcatatagtaaccataaaaattgtgtctacagaggcaattataacacatcaaaatttattaaaaacatatttacacttgaaattagccttctagtgggtatagagaataacatgaatggaaaatttcatctatatatgtgaaatatagatgaaattattgtttagtgttgagctctgcccgtagtcaggaagccctctaaatacgtgatgcctgagtttcttgatctagacaatgtgagtctaggacaattcccaaaataatatgattctaccaatcatatatttaaatttatgttcattgcaaatgaatgagaaggaatctgaagcactgattctaatttaatttgattaccacatataaacactatcactatgctagattctttaattacagaagtttaggctgttttaatttccactgaaacctctctctttgtttctttttgggggtttttatttacgcttttggtttggattgttaatggggtgttagtaactttttgcctatgaagtacataaacttacaaattatcagcttttagtttaatagcaattcattgttgaaaagctaacacttaaattattttatgcaatacgatatttctctttgaagaactgacagaaacaaactttccttatacttttcctatgttattcataatcaatctgtcttgaatcaaatgacttataatttaacattcctgaggaaaaatgaagacaattcaataaaaatgtcaatgtaattttcaatcacaaaaataggaatgtttatttatttttatttcactaaaattggaagacagctgtaaataaaagattgagttatttatccataaataaacaaaattgttattcattgtaaaaaaaaaatgaaagtgttcctcagcatatttctgttactctgaactattttcattatttcaatctcttcaatgactattattgaaaacttactatatgccagaacctatgtgctatgttagccatacagttgtaggccctatctgcaagtagtttaaaattgagttggacggtggctcacacctgtaatcccagcactttgggaggccgaggcgggtggatcacaaggtcaggagatcgagaccatcctggataacacggtgaaaccccgtctctactaaaaatacaaaaaaaatagccaggcttggtggcaggcgcctgtagtcccagctacttgggaggctgaggcaggagaatggcgtgaacccggtaggtggagtttgcagtgagccgagatcatgccactgcactccagcctgggtgacagagtgagactctgtctcaaaaaaaaaaaaaaaaaattgagttggaatggtaaatcatgtatactgataactaaaataaaatttgtctattgaagtctgtcaccaacaatttactgagttgctcttattcatcaggtgctatgctccaccataaagggccagtgagataaacagacccagtcattactgctctataaagtttacagtttagtggtataggtaacatacaaaaaaaaaaaaaaagctatacagtatggagagattacttttagctaaaaaggatatgaggagaaaatgtcttgaggtgttttgccaaatgtttcacatgaactgatacttaaaaggtggataagagttttaaaggctacggtgggatagtgttaagttgttcactattgcaaaaatgagatattttctaagtaagtaagaggaattcagctttccttcaacgtggagtaacaaggaagaatttaccttccatctgaaagaaccaaaagaaaaaaaaaaaggaaagagtatatttaaaaaaaagaaatatttcaaaacaatggacattaggcaacaaagcacagtgattcttgagtgacaggaaacaaattagttgaatcccctgattgcctcatcttactacattaagagagtttcaagtctgtggcacagggaagaggaagctatgcatagcccagcagactccttgagttgagaagatggatctgagagtcaagagaaaactatgcaggtagagtttatgggacatggtaccagagtcgacattgacagagaaatgtctctagagatataggaaggaaactccttaaacagtcagcagatttctgatcagctcctgaggaaactgcccatggtttgagaaaaaactaccccaaaagatgagatgtaacaatatctggagctgacatggggccaggaatgccacttgtcatacagaattctatacccagcaaaaatatgtattttaaaaggtgaaatgaaacatatgcacacaaagaaaagctgaaaacattatcataagtagaaatggaccacaagacaaatttaaagaagtccttccagtggaagaaaaataatacctcatgcaagtatgtatctacacaaaaatattacaacacttgaagtagtaatgacgtacataaataagatttgtcttactatttaaatctcttgaagaaatagttgactaattaaagttgtttaactacgctgcgtggtgttttggtgtttgtaacattgactaagtaaaatgtttgactacaagagcatttgcataaagaaccttttgatgcttcaagttctacctccccattccccttctactccacatctgggcaagccaacaagaaagtcggcttgcttcctcatttggcatcagcagggaagttcaaaccatgcaaaccctggcacactcactagaacttttcccaagttcccaaccactaaccacaataaaaaaaaaagcaaaactatatgtataagtacatttttcacactgctgataaagacgtacctgagactggataatttataaagaaaaagaggtttaggctgggcacggtggctctcgcctgtaaccccagcactttgggaggccgaggcagacggatcacctgatgtcaggagttcaagaccagcctgatcaacatggcgaaaccctgtctctactaaaaatacaaaattagccaggcatggtggtgggtgtctgtaatcccaactactcaggaagctgaggcaggagaatcacttgaacccaggaggcagaggttgcagtgagccaaaattgcaccattgcactccagcctgggcaacaagagcgaaactccatctcaaaaagaataaaaaaaagaaaaagaggtttaatggactcacagttccaagtggctagggaggtctcacaatcatggcagaaggtggaaggcacatcttacatggtggcaggcaagaaagaatgagaaccaagcaaaagtggaaacctcttataaaatcatcagatcttgtgagacttattcactacatgagacaagtatgggagaaaccacctccatgattcaattatctctcactgggtccctcccacaaaatgtcgaaattatgggagttacaattaaagatgagatttggttggggctacagccaaaccatattattccaagcgtggcccctcacaaatctcatatcctcacacttcaaaacaaatcatgccttcccaatagttcccaaaagtcttaactcatttcagtattaactcaaaagtccatagtcccaaacctcatctgacacaagacaagtacttccacctatgaacctataaaatcagaaggaagttagttacttcctagatacaatgggggtacaggcattggataatagctgttccaaatgggagaaattggccaaaatgaaggggctacaggccccacacaagtccaaaatccagcaaggcagtcaaaccttaaagctccaaaataatcttctgtgactacatgtctcacatccaggtcactgatgcaagagatgggttcccatcatcttgggcagctccacccctgtggctttgcaggtacagcctccctctcacctgctttcacaggctggcattgagtaactgtgacttttccaggcacatgttacaagttgtcgatgtatctccctttctggagtatgaaggacagtgaccctcttctcacagctccactaggcagtgcctcagtgcagactctgtgtaggggctccaaccccatgtttctcttcaccaagataatggggaaaatgtccccagggcataacagaactctgtgacagctcctcccatcacaggcctggaagtctaggaggaaaaaacggtttcatgggtcagacccagggccttcctactgtgtgcagtctaggaatttggtgccctgcatccaagccactctagccatggctaaaggggtcaaggtacagctcaggccatgacttcagagtgtacaagtccttgaagaccccactcctgcagcaaacttctgcctggacgtacaggcatgtccatacatcatttgaaatctaggtagatgttccaaaacctcaattcttgacttctgtgcacctgcagcctcaacaccacatggaagctgccaaggcttggggcttgcacactccaaagccacagcctgagccataccttggtccctttagccatgggtgggatgcagggcaccaagttcctagactgcacacagcaggaaggccctgggtttgactcacaaaaccattttttcctcctagacctccaggcctgtgatgggaggagctgccacagacttctctcttgtgctctggagacatttttcctattgttttggcaattaacatttggctcctcattactttcacaaatttctacagccagcttgtatttcttctcagaaaatgggtttttctttactattgcattgccaggctgcaaattttctgaacttttatattctatttcccttttaaaactgaatgctttttaacagcacctgaatcacctcctgaatgctttgctgcttagacatttcttccaccagataccgtaaatcatctccctcaagttcaaagttccacaaatctctagggcaagggcaaaatgctgccagtctctttactaaaacgtagcaagagtcacctttactccagtttccaacaagttcctcatctccatctgaaactatctcagcctggatttcattgtccatatcattatcagcattttgctcaaagccattcaacaagtctctaggaagttccaaactttcccacatttttctgtcttctcctgagccctccaaactgttccaacctctgcctattactcagttccaaagccacttctacattttggggtatctttacagcagcacccaactgccagtaccaatttactgtattagtctgctttcacactgctgaaaaagacatacccaagactgggtaatttataaagaaaaagagatttaatggactcacagttccaagtggctggggaggcctcacaattatagcagaaggagaaaggcacatcttacatggtgacagtcaagagagaatgagaaccaagtgaaaggggacaccccttataaaatcatcagatcttatgagacttagcactaccacgagaacagtatgggggaaactgccccatgattaaattatctcccactgggtccctcccacaacacatgggaattatgggagctacaatctaagatgagatttgggtggggacacagccaacccatatcactattcatccatcccttctctcaaaccatttctgaccaaagagagtcttaccatgtgggtaatctttcataccttcttgggacatcttcagccttgtggcataatcagtcaatatggaaccaattctggggagggggcagttgatcatgctctttcttaggcaaccacagagcaactggcagtgagtagggtggcccaagggatgactatcattacctgagggacttttttgttgttgtttgtgacttgataactggctctgctgccacctggctagagagtgcttggtgctgtgctagtgtacttacactttgagatgtgctgattttgatgcattttctgagcttttctggcctctgccaagatttaaatgatagatctaagtcagaagtattgaaaattgacattcagagacaggagtattggcttgtggtccttcccaaagtgattctgagttctgtgcctctcagcttagacttatctgtgtgtcttagatttaatcatatgtctcaaatttagtgcaagccatgaatgatgctaggctcagatgaatgtcttactctatgactattggttatgtgtctcaagcaggtgttgactcccattctatagagtgctcaggggaaaggctggcacactgtgcaataagtatgcttatccaatgcttgcctatctgacaaggagtggtcaccatgtggtgtcctccagtccatacctaaactcagatggctttaggtatctaaaacaaccttcgttgttgttgctactgtctatgtgtctgtcatcaaaaagattctggttctcagggaagaacacccatatcatctcatagcacagctgtgggcttaattcaaacctgacttaagcctggagtccctaaacccaataacaactgccctgtgggagacccccaacatttaaaataatgatttggaactctctggaggaagatacatataaataaggacagagtagagaagattgcccttcttcctgaagcgtatcctgtaactccacccccaaaaaacaacaacaacaacaacaacaacaacaacaacaacaacaacaaaacactaggatacagggagaagaaacaaaaattgaaataaagatccacaactggactcaattgaaaatacaaatttttctaaaatagttattcaacagaaagataaaataacagaattggatttcacatctccacaatatgggttttaaatgaacagattctgatatgtagtacttgaaaaatctttgtggtcttcatagatactgggcctcaaattacagttatatgaggagataccactgaatgtacaaggtatatcctgtactttagaggagttaccaaacacaaaacagaaggcaaacatgtatgtctcaccttaaacattgaaactgttgctttgcctaaattccttgtggtcagagtgcccattgacctatagcacctgatacggacattttgaaccaattagtaataaattaatattaattatctggcatttacaatcagcttggtaaaatggagccccttggacctgtccttctaattacaatagttaatacagcccaacttagattaaaacaaggtctacagtaattaagaaccatcatataacacctactgaaggaaacaactattgttcctactgccttccctttaaatagtccaatttgttcagtgtttaaacctgataaaaaataattggcatgggaaagttgattaccacagcctaaataccctgatgcccctgattaagacctccatatcaatattactgaagttgttggttcctatcaataactggaaaatattttgctattataggtttagtgaatatgttctattcagtacttatttcaacagcttcccaagcatagtttgttttcacttttgaagagacaaaatatacgtgggtatctcaacagcccttgtgtgacattgcacacaaactttgcatgcaatatattaactacaactgattttctccaggaatgcatgtatgccattattttgagggcaacaaattcatttgacccattcatccagaaaatgcaaacaaaaaggagcccagaaataaaaggggattatctcacccacacaatacaaggccatgccttctcagttaattttctgataattatttggtcagcaaaagtatatatactctgtccaaactgcaatacaaaaggccctcccactagtatccccaagtctcctttgctacagaggcttcagcaacatcctctcatgatacttagaatccatgaacacacagtctaaacaattttcttttgagacagggtctcactctgtcacccaagctgtagtgcagtgttacattcggagttcactacatccttgacctcctgggctcaggtgatcctctcatctcagcctcctgagtacctgggactccaggcatgcaccaccacacttgactaagttttgtattttttgtagagacagggtttttgccatgtttcccagggtgatctcaaactcctgggctcaagcgatctacacatctcagcctccaaaagtgctaattcttcttaatgaaaataaccataatttccaatggttgtgtattattgttggttaaatactatttattttataaataagcaataatgtgtataattttaagacttttaaacacatttttcaaaaatttcttcaagggagtaattttattataatgcagaatctccaaagtgccatctatttttaacataacaagagagcaaatcagttatcgagactcactacgacagtgcaagaacccataaagaatcagtatgccttttaaaaatcaattttgttattaatatgtgttatattgacaaaataaaattgcatccattctatttttaattttaattgcagctataaatcatcattgttcttaaaattctgttaaattacatttattagtgctgacttcctctgacctctctttctgctgccagttaatgtagtaccttgataagccaacttatcctaaagtcattagtatacactcagccatggtaactactataatcctttaatctgaaaggcagtacaaacagttaaaaccttacatggttttattaattacaaaacacacaaaaatacttatatactcatcaatactttcatataattactgatttttaaatattgagaatatacttacttgtacagttaggtaaagttccagaccatgttccattggctgtgcactgtctaactgaaggtccagaaaggatgtatccctccatgcaggaataaatgactgaactagaaaatgttgtgccatcaattcggaagactttcccattggctgtggttcctgggttaccacactgcacagctataaaacaaagtgtttaagagtatatataaaaaatgcaatcagaaattcttcccaaaaaagttaatgactaaacgattctttcaaattattcaaagaagcaataaaaacttctaaaataagtagtaaagtatctaggtagttgaaattcaagatgaatgtatgttgattttattcgcttaattactgggatgcaaattataacattttcttaagactttttttagcagcttcagtaaaaactctacagagtaaaataattattcaaagagtactgtattggcttcaggtaccacaaaatcttttagagaaggattataagaatctctgtctaaaaagcaactcatgtaaaattggaagacatgtaacaatgagtgatgagatgcaacagagatttattacatttatatttcagaaaagacagatacacaattttaatattgtaagcatctatgtatatttttgtttgtataagtacataactgttttgcattaaaatgtataaattctatttctagaccagagtaccaaaactaaaccgagtaaaaacaaagtaattaaatattagtaatcgttttcattaagtttcaatatattctaaataaaagttacaaacacgaatgtctttttatgattaactattttatatatgtgtttaactatttgtcaacaatatgttaatttttaaactatctgacttaaaagctataatatatcaaacgtaatacttaattttcttgtaatatcagaaggcattttagtaccttacagaagtgaaggcttttatggatatgaaatatgattataatttcagaaaataccatctgcatctcttgctgcatcttaaatatttctttttgcctatcatttgtataactgccgtgtgtgtgtgtgtgtgtgcatgcgcgtatgtgtgtgtatgcatgtgtaggcaagaaccttatccattttacatatatacataaaaatcaaactctagataatattttaagcagaacctatgataaaacagacatttttactttgttgttaagcatgattactttcttctaaatgcattagtgcctgcctgaaataaaattttggccatgtttacttgttatatatcatgatccatagcttgacgtaatgcaagaaggatttgagataatgtcatcttttaaaatgtcatgtaatttttattttgaaatagagacctaggcagagtcaaatttctgcacaataaaaatcaagaatttctttagtcagggtggtttcaagatatggccaaatcgtactgttgtttctgttctcttgactttaattcctccacacctaatacacaaatttctcctatccagacattttatttgaactaagcacaagtaaaattaacttaaaatgaaacaaggtaagtgcgtcatctatcatgagtgaaggcttaaagcttgctggatacaatgaaaggaaacagcaactactttgcctctgcaatattgacatttaggagaaaaatgatttattgttgcctgtgaataaacctgcatttacatttagtactagtcaaccaaaccatctcttctcacaagagtcatttcccagcagtcaacagacataatctaataaaaatgagagttactatttttttagattcattaagcacttaatatgtcacagccacaacttttccaaaattatttacttctcacaaaaatgttctgagttagtattaacatcaccaccatttcttaataggaaagtgaggcacagaaagattaagtaacttgcccaatctcacaaagctagttaatagcagattgttcatctagtacaaattcctaggaatgatgctgatagcatacaataaaagcattgaatcatattcagggtaggaaataagctgaaacataatacatgtttgtaaattgaatttttttttgtgatgcatctttataggaagtatattttatatgtttgcctttcttttgttgctagagagaactcttattttaaaaatcatggtaccatttgtttccttgtatcaaagtaataagtagtcatttctaaaatgacaaaaagaagtataaggaagaaagtaaagattgcttaaaattccaccactgaaaaatagaaattgatatttatatatgcatatgtgtatatgattatgtattaatatgaatataattatttcaatattctatgctttgtgttaggtatagagtatacaacagtgaaatattaatttactcttttttatttctatttttcttacataaaattacaattaaggtatctttctatcataaagtttagtaactgtatggttttccatacagttaataatttacctaaccaattccctgttgaaaaacatttagttaggcttggttttatttttctatgatttttagatataacatactagaacttatatttacaactctgtacattagttctatgtttaagataaatatctaaaataatttctggatcatattttagtagggtgactgtaattaacaacagtgtattgtacatttcaaaatagctagaagtgaggacctgaaatattatcaacacatagaaataataaatgcttgtggtgatggatatcataaatattctgactggatcattacacatttatgcatgtaacaaaatatcacatgtgccccattaatatgtaaaattatgtatcaataaaaaatacctaaaacattaaaaatttaacttgtttgaaatatattgccacagaaccactaaagatattataacaatacacacttgtattgatagcataaaactttgcttgtgttcacacctcctatgtaacaccatttgccatcatttaaaagaatctcagtttgtcaaaaatgttacattcttcaaatttgcatttctctattgattaaatgaagtcacttaaacacattatttaatatttttatttttacatgtgctttatccttcacattctgaaaatacctttcatgttttattataaattattaaagtaatatgacagcaatagaaaacatttggaataaagagtaaaaataccaataatttcacaactctgtcctagtattatttttttgtgtatttcctttcatactttcacttaaatgaatatcatttctcatggttctaatatagcacataattttaaatcttatttctaagttttatataatgtacattttctcatattgcttcatggcctatatcgtaatattttattgactatactctattagatcatgtaaacataaaattgcttaagcaatacttttcctagtgtaagattgttccaaattattgctagttataaacagaaataaaaattacattttcataattgtgtgttctctttaatatttctattttccttggaaaacattccacaaaagtggagtaataaactgaagcaatagatatatcccatgaatatttatcattctattcattatcagtttgagagcaatttttgtcaaattgctctcaaaatataacaataaaaatcatcttgaaatattttaaagttctagttttgctgctcccgcacacaataattttatattaccgtgtttaaaataggtgaaaatgataccttaatatttaatcataattttttattagtagttctgttgaattttttctataggttacagtttttttttatttctgctttctgttcatatcctttatccattcgtctactaaaatctgtttgtgtaagtgattggtatcagcttcatttatgagaaaaatattaattctattgtatttgctacaactaatagttctccttttatccataatatgcatgctaacaaagcaatatcagcacaagtctgcatttcatctataaaatattttgtaggtcagctgaacaaaggactgacttagatgtcacctacacaatgttgcatgtataatgatgcccacagcatcattaaaaagaccttgactttggaaaataagtttgagaaataaagagtttagtctctcttactgtattttactcagcactatgttttccaagtcttttccctatatcaactaagttgcaactccttcttaagattattaaaactgacccagttacaaaaagataactatcttttctagaatataaatattaaacataatcaaatatttctataacatagtcaatcaaaaaaccctcaggaaagtttgattgggaattatcttctatttacaaaaccaatatgtttggtacaacgtcaagtaagtttaaaaatattttgcaagtttagtttttccaataaaataatcacaaaaagaacaattaaggtcaatacaataattttctagcaacattttatttactagtcaattttgtaaaatatttttctttttcctttttatctttctttttttttaaacagagtctcgctctgtcacctaggctagagtgcagtggcataatcatggttcactgcagcctctgcctcctggactcagtgatcctcctgccttagcatccggagtcgctaggactacaggcatatgccaccacacctggctaatttttaagatttttgtagagatgtggtctcaggctgggtcctactcaggctggttcaaactcctggcctcaagtgatcctcctgcctcagtgtcccaaattgtggggtttacaggcttcagccacaactggcactcttgtaaagatttaattatgttaactctgagtcagaacaattaaaattttactcaaacaccctagatgttgtgaattctagtaactaacagttgtactctacaattaaaaatcttaataatacttctgtatgtttctatatttttccatttctacaaactagaagctaagacagacattgaggttatgttagggtaagaataacctatcattttctcttgtctctacaatataggtacactagtctccccttatctactattctttccacagtttcacttagccatggtcaatcatggtctaaaaataatatatggaaaattccagaaatagccaatccatatattttaagttctgagtagcatgatgaaatatcatgtcgtcccacatggaaagtgaatcatcccttgtccagggtacctaccctgtatatgatatccactcgtcagtcacctaatatctgccttagttatcagatcaaaagatcacaagaagaagggtgagtacagtcaacaagatattttgagtgagagaccatattcacataacttttattctagtatattgctataattgttctattttactattatagttttaatctcctactgtgcataatttataaataaaactttattacaggtatgtgtgaaaaaatcatagaaataaagggttaggtagtatctgcgttttcaggctcccactaaaagtcttggaatgtattctccatggataaaggagggactactgtaaagaggaaagaataaatatttttaacaaatatatattactttttaaatctaaacatttgctatgttgtgaacaatgtttgcatatatatgaccaatgagggttttttaaaaaaattatcggttatagttatcttaggagatggttacagtataatgggaatacgactgttttatttcatagttgcaggcagaataaactagtaagagtaattttcctagtagtactcatctggatttagatacacactaaaatccagtagttgcaatatatttaatttctgcttgagattacctttgcactctggctgccttccggtccaactgccattagctaaacatgttctttcttctgagccatgaaggatgtaaccagtatcacaagcataacgtacagtacttttagttctgaaattgctttcctgtctagagccatggccgggagtacctggatcgccacatgtcccagtagcatcacctgcaatgcagtacagttcaagttaaccaattcccataaacatttattaagtttaccagttagtccaagggcctggtaggcatttgtttttgtgcatgcggtgttttagcacagatggagtaaaattgtaattcatatttcttatctgactccagtcattaaaaaaaagtgtaaatgaaaaagaaaatagttgcagagtacagtgttacttttttatcagtgaatttggagacgttaaataggttaaggatatttcataagtttttccaaacctagttaataaccaagctaatggaaaatgtgtaactgacagtactatgaactcaaatgacaacagactcataaaaccaaaatttaaaaaaaactgaattctgcaatttgcatgtttccttttctgaatttcctgattactgataatatttttattgtttttgttaaagtagaactgtggtgtgctaggacatgtaaatattataatacagttctgatagcctaggtttctctctcttattttctctaccaatgaccaatgatcaaagatgaatgaactgcatattcctcgtatatgaaaacataaaaataaaatgtaaaagaccaaaatttagaaactctgacttaagtttctgataagaatattgctcataactaggcgttcatcttttgattttagtgttaaagatttactcagtctttacctagtcgttttatcatttcttaaataatcctaatcaaaattgccatagtgttaatatacattgagagagagagtgagcgagctagagagaaagagagagagagagagagaagggttgaaaatataagcattgaaaatgttctttccatttgtcctttttatatgccttgtgtatttggaatacttcattatatgtccttattttcatgtgatgtaaaattaataaccacacaaaattttaagattagtatttcacttttaaatatctgtgtaccattttattactcaatttagtagcagtttcctaatttcctaatacattgtggggtgggggcggggggtgagtctgtgtgttcgcatgtataagcagttatctgagagttaatttactatgagtcactccaagataagactttaattctcataaaatcaattttatagttacattaaaaatgatagtttttctaaatctgtagattacattcaaagtcccaggcagtcacttcatagggattaatcactagttaaaagatttggggttaatttaccatttcactgcttttaactctaaagtgaaaataatgtaaaacaactcctagtaagtcatcagaatggtatccacagagataaagtagtgtaaagacaatggacaatatataaatataaagaaaaagcagaaaaataagcacaatatctggttgatgggtaaaaataaatagtatcaactagggagccatcatagatctaaaacgtaaatggtgtttttgaaaaaaagtggtaacttaaacgtttatctcagaaaagatttaccaaatacttactctgtgaacaaattattaattaaaatatctttaatactgatttatgcaaagataactctaagcaatatgtcacttattaatattaggatagataaatatctttaataaaatgaattagattagttcaatttacaacattttggactttattttaaaattataccattaaagtaatcaattgcttagaaagttaaacagaactgaactctgacagaaaaccactgatacaatattgccttctggggaaaattatatgtggtatctgctaaaatgggatagatactttagcttgaatagtttcaccattttaacgaacaaaagcacttcatacagtgtagcatcctaaaaccataaattctttaaattagcaacacagttcaaaacacaaacttgtaatttatcatctacaacatcagtaccctgcatttctatagccttacacatattccagtaatgtgtaagcagtgtttcagcttttcttatgagatttttcagagagaaatatattttaagtctttagattgttttgtgtatacgttgctactactactactaacaataatgtaatttccaacacatattgtccaattttccaagtggtacctgaacaatgaggttgtgatccactccaatggccattcaattggcaggttcttgatgactggcctaaaagggaacgctttcctgtgcaggaatagtgaacagtagacccaaaagtatacttctcgccagacaggactgcattaggaggaacgccagggtgtccacagtcaatcactacaatacataattattaaatataaaatttttttatatctcctatcgaacaacctataccagcatgtttatagaacataccagaagtaaatgttctgctgaaacatctaaagcctccagaaatcaaacatctatgttgaaggtgtctttttaaaaacaaagtggagtttgcagctatagcagctgttctgttaacttactcattccgaggatgagtttaacagcaacattgtaagctaagtaagcattaaaaataattaagtgattatgataaatctgtacgtgtgagagtgatgagtgtgtgtccacatatatatgtgtatgagttcgaactgtatctgttcctggtaaaatctgtgaaagttaaggagaagattaatgtggatttgctaagtaaggacataggacaccatgtggatttaaagtgaagcaatacagaaattacatgaaaagaacttgagggttcaagagattcaatgaagattgatctgtgattcacaatttaatatatagtctagaatcattacatttcaagtcagtaatgaataaattatgctgtaaaaagacaatactcagtggcttataaactaaaactgctactcatagcagaatcaaaagtcaatacattgtagaatattctttatgagtgataggtagtttcagaatttaacatgtgtcccctgttagttgtactcagagaaatactgagtgtcacatatctctagagtatcatacagcacatgaggacacaaaaacttaataaaacctttcagtatataatactctaccagggagagctataggaaatgataagtcaaaaaacatatgagagctcagaacacctgaagaacttcaggtttacaagtcctatgaagagatttttaactttaatgtggtagctacataagaataagtaagtaaattattcaaataattagaccagtcaacacaaataagtcaaatgaattttaatcagcaggccaaattactgaactatatgcatagaatcaaattttacagacacagcaaaaagtgttgtttcttcattagtacatgaatgttgtcacaaaatgttcataaaagtacacctcatgaacataaaaaaatcctctaaatgaagcataatcataaaataattttatttagcaatttaataaaaccaaaaattatttgccaaaaatgaacgatttcttcacacgctattcattcagtctatgaaattgttcttctcttccctgtcaagtccaagactcaccaactgtttgagatctagttcaatttgaggcctatcaattgactgaattgctagaatttatgttcactcctctatgccttcacagaagtttgatttataactgctaaattatttttctcactacgtgtgttactttaagcatcttggctgtaatctattttatgtacattctacaactcctatcataacatataacaaaatgcacttattagatattcactgactagaaagatgatgtatattaacatttattgcattaacaagtatatgtgtctctatatgacaaatatttaaggtcaataagttttaagtcacacctttgtgtaaatcttcatgtattctgaatccatgatggatgtttaagactaattttgccttaaatgaaatattaaatattagtacagaataaaagtgtagttgcctcttacagacgataatattgtaaagtaggaaatatgactacttttcatattttatatgctccaaagtgcaaaatcaaagaatgatagataaatatttatcacattaattttaagaaaattacatttggacattgaatttgcaaaatatagaaaagtataatttcaaaacagtaaaacaataaaatcaatatgcttctctgtgatatatatctttaggtcattttataaagatgataaacattcctatggtttccatgacatgttctcaagaaacaattcacattatctacttactgatacattctggtaaaggtttgtcccattgtccatttggttgacatatcaaaactgaagatccaaataaaaaatatccaggattgcagtcatagaataccacagtgccgtaagtaaaatttccatgttctattttactttctcttttagaattggctggaattccaggatcagaacagttgaccactaaacaaatgacaaattttgaaacatatgtttggaataatatacatatacctatatagatttatattagaaatgtacatacttagtttcaaaagtaaatttattcaaacaaccagattccaataataaaattaatcccatggattatctagaaaatggactgacatctatgtggtagaaaatacagaagaaagaaaaaaatttggcaacaattaggaaaatagcaactttgtaagtattgcgctaagtacgaattttaaaaatgacatattttaagctatagctgaactgtaagaaaacaacatgcaggagaatgataattaggttgtattttgtcatacaatatgaaatatacttctttgcaaactggaaaaacatcgaagagttctccttaatctgtttctatagattaaaaaaatgaataaagcctcaatacaggtgtactggcaagccaggcccacatatagttttcagaaaaataaaaagaaaataaatgccaaagcaaattgcaagtaaaaataatctcaattactttttatatgcagtcacaaaacagatacaaataagagagttagaaattaactctaccacttttaacttttaaaaatataagttacaaaagaaagttagaaattaactctaccacttttaacttttaaaaatatgttacaaatttagaaaaaggaaagcattgttaatgagatgacatcagtattaaagctttttgttttattagataaaaactttttactattctgctcaagctgttttaagtgtgtcactgatgtttatgtgaatattattatcatgccaccaaatgggaatatacttagacatttacctttgcacataggtggaggatggctccactgtctgttggcctggcactgtgcctttgttggcccttgcataagatacccaatattgcatgagaatgttaccacatcattaaagttgaacccatttccacttgttcttccataaattggactaccagggtgaccacagctaacagctaataagatgtggcaggaggacagggaaggaaacacagaaaaaaaatatttagttatcagttattgcattattgattatacttaatcatttcaaacaaagtagaaagaagactactttttatctggaaatatacggaaagtacatttactaatgtagatgaacaaagtagaatgtcaaaatagtctaacagcatgattatattagtaaatagaaaattatttaaaattgtgataattttatgcaagtggtacatagatatttaaagtttcacggtacctatttcatcctttctctctactttattggggaggcaaagagcagagtattgaaatgcaaagaaatctggggaataattaaagttcatgtccatacctaatagcagaaaagaacaaaactagccaggtgtggtgactcatgcctataatctcagtgctttgggaggccggggtgggaggattgcttgaggagaagagttaaggctgtagtgagcatgatcatagctatgcatatatatcatagtgagctatgatcttgccactgcactccagactagatgacagaatgagatcttgtgctttaaaaaacaaagttaaaaagtagaaaagaacaaaactgcaccagttttccttgtctagttaataattgaggatatttaaaggcagttttttgcatttaattttgaaatagtgctttcaatattatttgaacaaccaatttttatgaataatagattgataagcaaatgtgtgcttgtgaagtaaattaatgtgactacataatgtagaaaatagaaaatgatacacaaaggctgcattaggatattcattaatattttgagatagtctcaaaatattctctaaatcaatcttactggtttcttcatcactgatatttgataatataatttttcttggaaataatattcttaattaggttcttttaatgctgtgtcccactataaattttacatagtgctggctttccccaaacactatttctatgaactgttttattgcattatctcactctattaatcagagcaacttcagtaatagtgcttcctaattgggcacaggaaacgaccacagtcactttcagtacttaggaaatgacccaagagcaattatttttcagctgtattgttaatgtcaacctacccatttgggaatttaactgcatcttattctggtttaaaattatcaataaagaaaccagttttaccctaagggccaattctcatttatagtctcaattattcaacaagaaaaacagtggtattaattggctatgcttgaatataaatgaaaaagaacatatccagggcagacacaagcaggatattgttgtctttaaatcatcagacaatcaatttgcttggggggggtgtaggggtggaaagtgattttcattgtcagctagatattctattatcctattatcataaccatgaaactagatgttctattatcctattatcattaccatgaaactagaatttctatacgtttctgtggattggatcaaaacagtattatgaccgaatttataagtatacatgcaattggtcacagattaaatgaaatatttcctgtgaacgcatactaaaagtcccatgtattgtttatctgacacttccaaaatctttatcctatgatcctattataattacaacatatttacagtacttatttactaataataattttaatataaatgtccgttatctggagatggatattattaggtgaaaaatataagaaaaatgtagttgactttaagatccaaagtaggatagattgtgatctgaaacactaaatacttacggggattctgagatgtactagagtttatcattattcagctctatttttattttcataatatagcagtcataataagtgcacaatggccaaatccacaacatacatataggaagagatccattaaaaccacaaagcacagcaggtatatttaagaaataatgaaaagatatttcaaaatacactttattcttcatctgtgaattcatatctaatcaacctaaaagatcacatggatatatgtcgaactggtgagatctttttaaaatatttctaaaattacatatattcatatgttttgtatgaattttaaaatagtgtaaacagtgctttaaaataaacttttatttattttctttttatctgctttttaaaaaattatttcaatagtttttgaggaacgggtggtgtttagttgcatggataagttctttagtggtgatttctgagattttggtgtacccatcacctgaggagtatacactgtacccaatgtgtaatctctcatctatcactcctctgctactctttctccctagtccccagagttcatgatatcattcatatgccttcgcaacctcataaataatttttaatttttttcagacaaaatatagctacgttacatatgtgtaatcttgatatatttaaaaatgcaatgcattttgaggttaaaagatgacataatgataaacatcttcaaccacacactctctatataagggaattacggcccagagagattaaacactgcattagctcacataatcatcagaggacctgaaatgagagcaaaggttcttcatgtcatgcctaatgataatatattccccactgtgcttcatcagtatataatcttgatgtcatgacagtagtatcataattgttagataatatttatccaaaatattttccactataaaaagctctgtaatatcacatagtaacaaaccttgatacagctacacagtggtctctagaaatttaaacccttataattacaaatgtgttgataatgtgtcttccatataagaatattaatttatcaatattatatatttatattaaatatgagaagagctaaatttaatttattatcttcatgataaaatataactgaaattctcttgaacatattccactttaaagacttttgcatagcagtatcaaattggattgtggaaatttactttatattgatatatataacaacataatatatatattcatcttgcctaacaaaaactagaattattccaaagatcagaggtctctaattgcttttgccatgcttacttacgcacacaggatgggagctgaccagaccaattgtgatcctgttgacatatcctcactgaagaaccaatcaatcgaaaaccaggattacattgatatacaactgtgtctctatatccataattttctccaatgacttgaccattcacaatcagttctggaattccacaatgacccgctgaaatacgttataaagtaatatttttaatactgtgatttgttttatttgtatatttatatacatgtggaacatgagcaaacctttaaagttgtcttaaaagcaagcaacaaataattcaattataactatatgacataaaggtaactatgaaatatttagcaaaacaacaaatatatggaaattaaaagaagacacgtgtctagtgacacttgggtcttgaagaaattataaaatatctcaatgtgtaaaaatgaaaatataggctgggcacggtggttcacgcctgtaatcccagcactttgggaggccgaggtggcagatcacgaggtcaggagattgagaccatcctggctaacacgatgaaaccccgtctctactaaaaatacaaaaaattagccaggcatggtggcaggcgcctgtagtcccagcttctcgggaggctgaggcaggttaatggcgtgaaccggaaggtggagcttgcagtgagcgcagatcgcgccaccgcactccagcctgggcaacagagcaagactccacctcaaaaaaaaaataaataaataaataaaagaaagaaaatatatcaaaatttagaggtacagataaagcattacttattaaagaaattaataagtttcagtgcttttagtagaagaaatagagatataaaagcaatgacctaaaactccatgttaagaagaagcaaggagcaaaatgatgtaaaaataaagccaaagtaagtagacagaaggaaatatttaagattacgaataatagagaacattaagttaaaaattctttctctaaaaatagcaacaaaattattaaactcttagctaaccctattaacaccaaaaaggagagaataaaattgtcaataacaggaatgaagtgatatcactataaagccttaagaaattaaaagaataagggaatgctaaaaacagctttatgccaatacattttaacacttcagaagaaaagaaaaaaaattctgtgaaaattataactcgccccaaaactaacacaaggtaaaaatataaaaatattaatagtttttatctattaaaatatgtgaattcttaaacaaaaaccttcccacggatttttttttttggctgggaaattcaagcttttaatggggaaaataattcttatgcaaactcttttagaaaatagaaaagaaaaaatcacctttgaaattattttatgaagtaatcattaaccccaatagtaaagcctcaaaaaaaaaaaaaaaaattaaaaagtaccaaagtccttaaatgattataaaggaccaaagtacttcataaacagagatacaaacctccttaataaaattttagaaaatcagtctagtgacatataaatgataatacatcatgattatctgggatttatccagaaatgaagtttggctaaatatgaaaaattactgtaattttgacataataaaagagaaaaaattctatgtaattatttcaatctatgcagaaaaagtatgtagcaaaatgcagtgcctattcacgattaaaaactgacaacaaattaggaatatagggaacattctcaacccaacaaagacattgttaaaaaaacctccagtgcaatacattaatacaaagaagaaaaacagcacaatgttgggaaacaaaatagtgaaactgttctatactcaggtaatacgtacgtagaaaattatatttttaaaacatcttaaactagtaagtgaatttagaaaggttgtagaatattaggtaaatattttgaataattgtattttatatactgacagcaaacaattggagaatgtaatttagataaacaactttagttgggcacagtggcttatgcctataattccagcactttgggaagctaaagcaggaggatcttttgaggccacaatttcaagaccagcctgggcaacatagcaagaccctatctaaaaaataaaaaaagaacaattttactttttacttacaatagtaaaacattctggggaataaatttagcaatagcacattctatgctaaaaatacaaaatgttgccattgcacaaaaaaaaaaaaaaaaaaaaaaaataagtaaagacccaaacaaatgtactctgttcatggatcacaagactcaatgtttttagaagccaattttccccaaactgatgaaaggattcaatcccaccagaatctctttgtagagtttcataaactaatataagatttatatgaaaccgcaaagtgttatggtatccaaagtgattttgaaaattatgaacaaatttagaggatttacatacatgatttcaataattattatgaagttttttcaataaatagtgcaagatacaaagtgcaagtaaaaaagctcctcaatgctactatgtaacacataggaattaaaaataacattggagatataaaagttaaagctaaaactataaagcttctagtagaaagtaaaacaaacaaaaatgatagactttaccaaacttgaaaattcctcgttgtcaaaagatgttattaaaaaatgagtaggcaagtcatagaataagagaaaatacttataaaacacataatgatgaaggccttgtaacaagaatatgtaaagaactcctacaattcataacaaaaaggcaagtcaatatactttaccacttcacaaaggaaaatttacaaatagccaataagcctatgaaaaactgtgcttaacattagtattcattaagacaaaaaatattaaaatatcataggatacctttatgcatccaacagaatggagagaaaaagaaagttggctataccacatgctggagagaatgggagacaactagaactctcccacatgtattctgttgtgagtattcaagagaaatgaatgcgtatgtccacaaaaagacttttacatgagcatgcatagcagctttattcataatagcctaaaactggacatagcccatgtatccatcaaaaagagaatggctgaaatgtggcatatttgtacaatagaatcctattgagcaataaaaggaacaaattacagatatgcacaacagcatagataaaagagaataaaagaagccttatacaaaagagtgcacaattttcaattccatttaatgaatttctagaacaggggaaatgaatatatggtgaaaatatcgaaatagttactgcctcaggttatggaggaggagagttgcacagtgaccgtgaaggggcataagaaaactttctgaggtaatggcaatattctatgtctttatagtggtttagttacactgatgtatacatttgtcaaaactgatctaactgaacttatgatctatgtacttcactacatacaaattttgccgagtttaaaaaaaactttgaacaaatactgaactctagctaatggtatgcatgcttaatatttggcaacaaagtatactgatgtttacaacttatttcaaaatgcatcaaaaaaataaattaatggattgatggaggcctggaaacatggatagatatgtgataagcaaatatgaaaaaaatgctaattgtagaattaggtggtaggcatatgggtgttcactgtcaattcctttaattgaaaaattcataataaaatactaggaaggcaggaataaatgcaccatacttagagaaacaattataagcacattctcatggccgttctaagctaaaagtgtctgaggttacacaaactagttgagaagaatgaaaccttaaggtcaattcacagtgtaatattctgggatttgcttgtttggtaactgtactttcctcctaccaacatccttttgcatttcattgtatataaacactgtattctctacaatggatgatcttgtctccttagactaagaggcaatattttcttataaatattcctgttatgccctgtctttccagagaacagaatcaagattctaagtaggtgaataaaaccacatactatatacaatattaaataatatataatacacaataacaattcatgagagcacatggccataaaatatagtattttcaaatttatatgtatatttaaaatgcttttaaaatttagttttattttaactatattttaaatatggttcattttaaatataatattttaatatatatttaaatattttaaatattgtatttaaattatatatcatttaaatatagtattttaaatatatatttatttataaatgtatacatatttaaagatacatgtaatatataatttaaatacttgagtatgtataaatatatatttctatataattatatataaatttaaaaatttatatgtaaactaagtttacttaaaaatgcataagtaaactaagtaatctgtaattgaaattagtacaaccaaaatcagtttacaaactattaagattttttatttttttgagtttttatttgattatataatcacatattaatacataatcatttaactcattaactattttctgttttcttcaataatcattgaagtggcctcatccatatgcccaaccttatccaatgggagacatcatgactcctatcctcaccactctgctctgtctaggtgagacttaaagaggaagaggaaagacactagtctgagaggaactccatccctagccagagcctggtccattaatgaccccagagactcaggagttccctgtgtatattcaaatatgtgtgctcttataaagaaattgttgctgggcttccaagcataactattaacaaatgtgcctgagaaggagaaaaaagacattttaaccaaaacttctaactataccatttgaaatttcaaataatgattgtatttctatgaatattttcaagcttattagccacacaatatataagtataaacttttctgccatgtgtcatattcttaaacagtaatattttaaagacaaaaacactgtacaaattttgccgtactctattcatgataatcagcaatttttaaattcgtaaacaaaaagatcttgccttacttccaacagataagtgaataatcattagaaaaattttcattattacctaactcaatacttgctgtcagatcttgaaatcattttagagaaaacaaagcataaatagcataaatcatactattttcttaatattaaataaattattgaaatctttgaaaaaggagataaagcataaaatataatattttcataataaaagaggcagggtaagaagaacgaactagttcagtttctttaactgaagattttttataataaatactctaaggggaaaacatcctaattgcctaaaatcaggttcaaaaaatttttttttaattttaatagaaattagttttatgcatgttgaaatcttatgaaataaaacggaagaaaggtacttaaatacacacattacattgtttatcttcttcagtcattaccttaagcaaataggtgaaaagagaattgactatggtttagaatgacttaatagctacagcgattaatccagctgagtaagcaggcatacagttttcagcaattagttttcaccattatattttcaccatgcctggaagaaaatgtgtctctccttagatttcactaggaatgctatttgattattccgtttagtagcttttctatcatgagccatttttaaagataagtattttctggtttttaacatacttactgaatgaatataaattagtatctcatattagggaaaaagagatgcctcttttcaagggtgaggggcagggggaagtttgacaaaaacaaattaaaaatctgtacctaggcatctggtttcagattcactccaaagacctgaggaaaggcattcccttacagcagagcccacaagcatgaatcccaagtcgcaggtaaagatagctgttgagccatatgaagtttgagttccaatcttatttccatttggaggtgtaggtagttctccacaggaaataactttaaaatgataaataaataaaaatccttaaagatatagtcaagctgcacttgtaacaaaactgtgctttgaacattttgagcttcctatgatttgatgtatttacaaaggaaattggcatttgtaaaacatgtttgaatgagtgtgaaagtagggagaaaagagatgacataacgtaaaatgtaccctctttaagtccccatagaaccttctaagtaacagagacataaagttctttttttttcattttttttttttttgcatttttcgcttagtcaacctggctatagtggatgaaaaacatcacaagtttaaagagatgataattcattaatccaaaatctttctctgctttatcaagtaactttgggcaagccctttgacttacctgagccaaagtttcttcatatctaaaccaacattaaaataataattacaatataatttttgtcaagaactctatcgtttgagttttacatgtaaaatatttgattttcatgagatccattagatataattcatctgttttttctaagttttaaaaaattgaagaaaataaatttaactggcttgctgggtcatatagcatctcttatgacttcttcatatttgaagaccacaaatgaactgtcattctagcataaaaacaataacagatcatgttcattgggcttgtattatgtactaggtgctatagtgttttcatttatgtaatgctcaaaacaactctctaggttttcagtcttaagttttagatagctgtcaggtagagaaatagaaaactttcaaacttgcaagagttgcatatcaaatttaaaatgtactgatgattttgagctcatccccccaaaaaaaatcatttgaggtcgctattaatattattgatatactaatattattattaattctaatatttatattattttcatttaaaagatgattaaatggaggaccagaaaaaaaatactatttttttctttttctcaattaattgcaattcctaaattccttgccattccctcattcttacctgtaggcagtaacccaaccttattcatcctttaaacaattctacatagtaaagaatctaacacaatggaatcaaacatttgttgaaaacctgattaaatgagtgtttctgttgtagataataattacctagctctttgaaatattcctatccatgtgccctttaaaaacaaattattctttttaaacaataatttggaaaaaacaaggagtctgcagtcagagaaaaatcctgggaaaaaaacttggaggactagtacaaaaatttagaaatacaggctgtgcgcagtggctcatgcctataatctcaccactttgggaggttgaggagggcagatcacttaaggtcaggagttccagaccagcctggccaacatggtgaaaccccaactctacctaaaatacagaaaaaaattagccaggcgtggtggcaggcacctgcaatcacagctactgcagagactgacagaattgtttgaacctgggaggcagaggttgcagtgagctgagatcgcgccactgcactccagcctggcagacagagcaagactctttctcaaaaaacaaacaaacaaacaaacaaaaacaacaaaaaaaaatacagatgatggcacatttttacaatattaaatataatttagaaatatatttttaatactttaattcattaatgtgattatcttggaacacagggcaaccgaaaaattctatactgatatagagattcaaaaaataaatttcaaatcagtgaatattcataaataaaataatatcagatacttgtgtacttattacacataagatagttgtctgctacgttaaacttcttaatcataataaccctaggtagacctttgatctctttattagtttgtctataaatcatgggtctctatgcaatatataccatagagttgtgttggacgctaattaaaagactgaattttcgcctagcatatttcctgaaacaaaacagacaataaatgaatgtaagaaagggagttcaagatatttcacctgaatatcctatgttctgttagcttatgtatattagatactggccatttatattataaaaatgtatggaaataaaacgccttaactgctcaatttggttcaataatatttattgaggatgtggttatagctggtatttcaattgtgtcataccattaaatgtttgcagtaactctacatgacaggtgttataattttctagttttaagattttctagttttagaatttggaatcagagagaataaacatgatataacatgataaaaagtcaagggttttagtcaggctacttggtcaaatatcatttctctatcatttataggctctctgactttaatagaatgattacatctggggcaaaggtttttttttttttttaaccaaatgagtataaaacatataaaggactaaaagcagtgtctgtcaagtagtaagtaatcattacttcattgttaaagtaggtaatagatcaacaattcaaacactagatttcttaatccaaagcccatgtttttctatttgctagaaaagcatttactaatacatagaaacatagttagaaaatttaaaaacgtaacgagaataaatgaccatattagtaatgtcatccaattattgatctaatgtgtttatgaaaggaactgattcaaacaattcgataaccaaacatagcttatgaaataagtttagcagagtgtatacttactttggcaatatggtctttcatttctccaactccaagtaccattaggaagacattcgatggaggcaggacctagtccatgataaccagggtcacagctgaaaactactttggttttgtattcataatgggagccattcacaattcgccatcttccatgttccaagataaaggaattgatgcttggacatgtaacaactatacaaaaaccaaagggtgtaattgctaacaaatcactatatctcaacgtctattccattctttacatctccactgacctaattcacttactcttgcactatacaaggtcctttagcatttgttctttatttcttttgcatgttgatattttccattcccctagctatatggtattgctggcagtctggaacacactcaatggtttcacaattcaatcttgtacttattattctacctacttagaatcccagttgttggcttacctctactcccttatttctttataagtttagaaaagactatattttgaggaaatttttttgatgtgaatggcctttttgtgcaggagtagtgatatcaactttagctaattcaaaactttttcaaggtaagtagaagccttattagaaacctatgctgagagtgcgaacaacttaacaatcttcattttaaatgaaatcacaactaagtggaaatgctagtactaaatgggaaaaaataatcgaaatatagagaaaattcaagagtttattcacatcaatattttctattttttgctaccaaatctttaccagaattaatgtcttatcattatgtaaacttatttacctagtgaagtaatagtgacagcaataggaactcttctaagtgtaagtaaacagaagaatatcaacaaaagtttaaagttatggataatttttgcaacattatttatccttataaaatcagagtgaaatatgtcaaaatataattttattaacacagtctttaaaaattttctcaaggggccatgtactgaaaacacatgttgactaaaggatgactttttacaaaataaaacatcattgtataaaataaaagtgccttttttgacataaatattctgaggttttcaaaaatgatggaaaagaccttgtactgtcttctagtacttcattgtacaagatagcttacttaacttttatttctgacttagacatcacatttcagtttagggattggtttttataattctaaaatacataaaatttcaggtatataaaataccaagagaaaaacaagtgatgaaattcccttgacacacataccaacacagcgaggggtcttgttatgattgctccatgttccatctgattggcatacagctgtagtgagttctttggatgacaatcgatatccatcattacaaaaataggtaactcgcgttcctaccaaatagtctgttgttagtattcctccatttgttggagctttaggaatcccacaggaaattgctagaaaaacatacacacaagcaaaatcgtataaacagaaaaatgtttaatttattaggtaactctgctgaactgtaaaacatgcaaaactaacggggatttttatcaattcctctgaaacaatctcagaatcacagaaatactttccgaaccataaattttgaataatttattccaaacccttatttagcaatgtttataaattgatgaatctatacattgttaatgctttatttcttggtttcttacttaatttctggtgatcatgtgcatggttatcagcatttgtatggattatatgagaatgcaagttaggtaaagagtatctctaatgcaagcccatgactggaccatcatatagcaagtttgattaattcaatttgacagataaatattaaatattttaaagagagtggcaaccaatatgaatcataattttggtcaggaataaatcaaatagatttattttacctgaaagctggctatttctgtcttagcagaagccacaatgtatgagctggggcaccatccacaaagtattgtgtatattggatatgtttaataaatacaaggccaggacttactgtcttaaaaacctagttaggatcttcctgaatttcactgatgtgtcttagatgtcttgatttttatctacaatacatttgatttaggtgaaaattagttttactatgatgtgataataatgtaaaatgttatatttgcctagtttgttgtatatattttatactttacaattttaaaaggctacagaaaaatcccctaaaattgattttttaccatttttgccctattaagtacacaattggcacttagaaacagaaaaaaaaaaacacataatctttcaaataacatgtacataatctttcaaagtatatatttggtagcaatactcaattaaagtcaggttttttgttttttgtttttttttgagacaggagtctcaatctgccgcctggctggagtgcggtggcactatctgggatcactgcaacctctaccttctaggctcaagtgatcctcacacctcagcaccctagtagctgggactacaggtgcgtaccaccatacttggccaattgtttgtttgagacacagtactactctttttcccaggctggagtcagtggcaggatcttggctcactgcagcctctacctcctgggctcaagcagtcctcctaccttcagcctcctgagtatctgggactacaggcacgcatcaccaggtccggctaatatttgtatttttttgtagacacgggttttcgtcatgttggccaggctggtctcaaactcctaggctcaagcagtccagtggcctctaccttccaaagtactgggattacaggcgtgaaccactgcatctggccctatgtgtatctttatatatcactctcagagtaaatatttatacatatctccacataaggactaacgtatttgaatatgagtgtcattccagaaccaactggagttatgtaataactgatagatatatgtagtgcattattgttataaaatgagaaagcttctgtattatgaaagatatctagcttacacgtttcatacaaagaattacagatttatattttctctcataacagaagaaataaactacagaaagatgagtttagtttaaatattataaatgctatgtactattcacccatcttccatttcgaccaaaaattgtttccacttctcttataaaatctaccatttgctgcttaattttcattaacccacgtaaattaaatataaaatgaaaaaccttagtgaaatctttacaaaactgtcaaaactgaatggcagaatccctactgctgaataattgatcttctgtaatttggtaacctgtaaattatgaacagaaaagctgtaacactgacttaaaatacatatgcaatctcacataattatgttattatccctgctttctaattacagaacctctaaaatagtgttgaaaagtaaatggttccctgatgtctgataaagcaatgtttatattttcacttagaacttttgggaatttcaagttgttatatgccatctccctcccaaagatcatgtatttactgatttttaaaaattaactattcattgttggtgtagtatagattgaatctaggtcaaagtaaaaagagatgtagttaaatagtatagattccacatatatgtttagtaaaatgtggttctattttagaactaaaaagagacaacgtaccagaataatgggacaattcctgtgcctatggatagttaacaatttaacttctccgctaatttttttaaaaagaagaaaagaaagaaaataaatccagttcagaagaaaagtcatcataattgagtggttgtaaaagaggcttgtctatacaactctcaggaaatcacaaattaaaagtgagacggaatacaaagtgagtttccacgtaacactacataatatttaattatattcatgaggattgttcaatttttgagggggggatcaatagttatgtgatgagaacaaaaataaataaaacacctgaccaaacccaaatagatatagctgactaattttctatgtttatcctcatgttgtgtaactttatagctcaagtaaatgtatgtcaggatgtataagaagacctaagaggtaagagaaagaaaaatgactgaaaaatgcaaaacaagttgaaataaaaggtgcattatgcaaatagctcttccaaatgacatacaaacatttcatttcaattagtaatgtccaaatagaggtcatatcctgtaagcattttttcttaatcttttttaacaattagaaaagatcaatttttggaaatggctacatgatttacatatattttatcattttacttcaccaaatatctcatttttaaactatatttcaactttcttatttgaatttaaaacaattttaaattaaggacattgaaaaaatgactccatatgtaaattacatggaatatattcaatgaaattgtagcactaattctacaaagcaatttcaaaatttcagaaagcatgcggtatttttattttacatgatagtcaattattctcacaaaatgtttcttaaggattatatatgtataccatataggagtgtgtatgtgtatgtgtgtatataaatataaataaaagcaatcattatgtaactaaaatacaaaagtttaaaattaaaaacaattaaaattcagagcatgttaatggttatttaaaatatatatattataagcttattttatatcttttaattctattatgaaatttgacatcaaagattctttcccaaattaattctgggaaatcagttaatactaagaactgtaaatactcctgctattcattggtcgaaggaaagcagctgttttaatactttattaaaatgtatctattctgcatgaagtaaatgccttcagtgttgataacccattaaggtaatggtgcttcccagaatcctaataagtgattaatgtttccttgcatcaatacaacaagaaacaataattctttcattttgcatttgtttacatatgcctttgaaagctatccttttatgaattataaattgcactctaataggtaaaagaagccatttcaagtgcctggtaatacctattctttagctaattttaacttattattggttgattttaaattttaattacctatcttacattttgttttttataaatgcccaccaaaaaataggtaataagtaagacttcttgtttattaacctagagtatcctgcattttttcatgtgagaattcaaagttgctatctgcatctttacatgctgagtagagttaaacaaaatacaaaattaattttcatcttgataaaataatataatgaattaagtattttaaaattttcaaagtccaatgacattagcttttctgcgtagctgatgttgagcttgtctttatgactatgactacacttacgtaagagactcaactactatttaaaacaagtctttttgttttgttttgttttgttttgttttttgagatggagtttcgttattgttgcccaagctggagtgcagtgttgcaatctcagctcactgcaacctccgcctcccgggttcaagtcattctccggcctcagcctcccataaaaacaagtcttaatcaaaaactctaaaacatgcaattttttgattaacaagcttgttattctttttgcagcatgatataatgctcagtgcctcgacttttgacaaaatacaaagaaaaataaaaaacatatctttgatatctctgttgtgttatctgtaccactgaagaaaaaaaatatccaggtggtgggttacatttttctcttaaatttgttgctgtgagtgcaaattttggatgctaagagtgaaactcagtcttcagtgtacttgcccattcttattctctattacctctctgcagacttcatactaactcagtcttcctctctttcaataattgtcttaaaacaaagtaactggaatggaggatgtatgaataaagtatgtatacaaggggaaaaagtcaaggcatataagttgcataacaataatgaataattataaaacagtatgtttctttcccctggaatttatcattctgcaatgttatgccttgtttttatgaaaagagttcacaatatgcttccgaatatttccattctcagaaaagttagtgatccaaataaaaacgttaaatggtgctaatctcacattcatgtttttgttcattttggcataatatacttcaccttgacaggcagggactggcgcatcccatgcatgatacccataggaagactttctgcacacagcactgctttttccaacaagtcggaatcctcgatcacaggcccaacggaccacactgttaagctgcccacctgtctgactgataatatatccatgaggtggggattctggtgtactacagtagaaagcttttcaaaagaaaaaaaaaatgctgtttaattaatgaatcagaagttattacccaaagtgataaacacctatacagcgactagtgcttaaaagtaggtcagtggtcatctatgtaaattttacttcatatgaacaacatattgtgctctttcctcttttgaaaatgatctactgacacaacttttgggagacataactaactctgagctttcttccaatttatattgtcaccgaaaatgtcttctgaattgaaatgtattttcttaacaccctggaggttcagaagcccaacaaatatctaactgaattttggaaaccgcatttcctgtcatttgagggacctatatgccacagccttggtagcaatattttagagcatgtcgtttacatgtcactttgaagttatatccagacacctctaccatgttaggtcatacatttcattttggttgatgtctaaaataagcccccacattccataatcctctttcccagtctattaaagtgtgcccattctgtcaagagcgtttacatattatgatacaaattgccaataaaataaaaaagttttttcatctcctgatgtttgaaatgccaacagatactgtcaaatagctttttcatatgtacttttgagaatattcagcatggcaggtcccatttaccttctgaaactttaatgaattcatctgagaaaaatggggctttgggggtaaatagtaagaaacaaattggacttaggatatatatgtcataacctgtcatttctaaaggcaaaaatacatatttaatatgtcaagctgttcttgagggctaaaagtggtattttcattatattaatatccaactttgtcataaataataagaacaaggattggtctataatacagtcaatctaatacttacaattgtttaatttgaatagtttccttttatgttatcatgtatcatgaatttaatgtgctgacttttaaatgccctatttgggcaacactttaataaaaagatatttacattgtttatattatagaaacataagctcaagtatgaaaattcttcaagatgactgggtgtatcatatagttcagttttttggttttttttgagaagaagtttcgctcttgttgcccaggctggagtccaatggcgctaccttggctcattgcaacgcccacctcccgggttcaagtgattctcctgccccagcctcccgagtaggtaggattacaggtgcccaccaccatgcccagctaagtttttgtatttttagtagagagggggtgtcactatgttggctaggctggtctcgaactcctgacctcaggcaatccactcgcctcagcctcccaaagtgctgggattacaggtgtgagccaccgcgcctggccatgtttcagttttttaaaacacgtctactttgattgcataataaattatttttgatttaatagaaacattgtaggatacaattatgtacatagtagtaatatgctgtcagtcacaagttattctaatatgtaaaatacaaattattaattagttaaaatcaaactatcatctcagagttttaaaatcaagggaattaaacagaattattctattcatacattttatatgtagttgtaaatttgtataaatgagtaaaattcaagagtatactttttagaactgaaattcaaaatgtatctgtctatgcccggaatcatagtgtcagagtttataaaacatttataaaaggaattttcggttgaattgattaccaatgacacatgatttgggaagcatggtgtgaacactgtatagaaagagacagctggctgattctgagggattctgctattgagcacatatccatggcctctgacatgatttagaatggtctctgacgtgatttagaatggtctctgacatgatttagaagggcagtaaagaaaaggaacataaccttcacataatagaggactatttatgtacatttactcaacaagaaaattattggttcagtatcagtagaccctataaacaggaagacataatagaaaaatctatgtcatcttgctattaacaagaatttccagcctacatctttctaagcatcacgcaaggaaaagcagtagcgacaaaacgcttccgtttttaaaaacggaaggtttgtaaatgatgtgttactctctctttcgacatttaagatattttagcaagtatcacaaatagatggataaaaattaaaacaaagattttgacctctgtatgtttatcctttgttttaacttgtcatttaaaggagttcttaaataggtcagataacacacagctgagcaacactattaatattttttgtcagttcaaagaaaacaaatctattttttaaagtattaaaaatcacagtttaatttataactgacatataagtcataaatatcctaaatgcttttttaggattttttagtcataaatatcctaaaatgcttttaggacatataggataatttataactgacatataagtcataaatatcctaaatgcttttttaggatattttacaaaatcatatgagggatgtagaattattatcattacaataggaaatagagaggttacataaattgtccaggaaccatcaatggaggagctgtgatttgaattcatgtctaactgaatagtgtctctgctccttaatcataatcataccgaagatgatagtgagatctgtcctgaagttataagttttacatacctatatatcttatccggaagccttttttgttattgccatgatctgctgaccactgaagaaatacttcatgaccattgcttgttatattaaaagcagatgaataatccccactgagggaaataagcactggactttgaatatttggtcctttgggaagaaaataaaacaatttagataaagctaattatattctcatttgtctttagtattttatatctttagaatagtattaaatatggttaaattgcttcaccaccaatctacctcattaacaataattgaaaacataaaatgtttgttttaagcattttaattctatagctaaatgatgtataatttgtaaaataatagtggagctaactataattttcatatggtataggagtgaatttaatgttggtacttctaaaaatatctgtaagataaactcacataagcagctgtttatactcaaagtttacatgtataattagaacatttgtacttaattgatgaatatccaataaatataacccttggttaccatcatacacctgaagaacatcaaattccttttctgtctggaagaattctacaaacatggtgatattataacccttttccactgaaatgctccatgcacacatttgaagatttgggtaactgtcaggatatccagggctcaatatgactccagtagaatctagccgtaattcattggcaggacagagcactgtcaaagaaaaatgtcattaaataatgccagtcttttagagcctcagtgaaaactgtattttagatactgagtattctgctttcatgttcaatagctataaggatgatacgttgaattatttgttagaagagacaagttgtattaaacttatgattcaaaagctggaggaatgacctaaaaatttatagtattgatttattttttattacatggaagatgcaccactttctggacataaataaatacataaataaaatataagccatttaatgcctcctctttcttcacatttttcccaacctctcctaatcttttgttctcccacctctgcctgtcttatctatgtccttgctttacctctttctttccttactttttaactcactctcttctctcttaaaccttctactcactcaggtgtgtggggtcagatagaaaactgtcctctctcaaagtattcatttcaagtaaaatcatttctgatatcaggtatatgtttaccatgaggatttaacacagttctgagtcaccagttgcctttcagctctacactatctccagcccataaatgtagcccaaagcacaaactctttttatttaataatatacctctgctttaatataatatatgtatatatatcaacacactataaaaacacataaaatgtgttatacattgacaaaaaacataattatggtctaacagcctgcaacatatagcaaattttagttgttggcatcaattgcattctgtatcagaccaaaattatgaacatctacttaaatttggatttagaatgaagaatatgactaagttgatcaatccctttttactcaaattatgccattttaatctcttacaaaatttttttgaagttctgtgatgtggaaagagtattggaattatttagtatggtccattgtgcagaagtaaaccaatatgcaccaaacaggatttgcttcaatataaggaagaactttctatttgtcagaatagtataatggccatagtaaaatgtcttacgaacataattgctaaccagttttaaacttagactggactatcttttgggtgttcttactgagaacatttaggcaactgaatgaatgggtgaactagataattttgatgatttggttaattagaaatatatcccatgcaatttcctaattcatctactataccttagctttcattttggagttaaatagcattgtttctcaaaataattagagcagcactttaagaagaattcctgtttttcaatgtttatttgaatgagttgggattgaaaactactaatgtagttgctggaatataataaatagatgaagaacttatatattcatagtgttcagggtacaaagacaattaaatatttttgagttataaagtctccaacaagtataggagtagaaaagagtaactaacatagtggattatggcagcatatgatttctctataaacatgttaataacttgaaaagacttcttgaaaacttgaaaaccggccagaactaacacatggctttttgaaaactgactatataatagagtttaaaatatagtatagctaaagctaagagctgttttctactttttttggatattatttcagtttcttctacttcaacctgggattttccttcatggatataattttgagattaaaaatattgcataaatggtatcaggtcattctttctccacctaaaaagagaactctgacattgattttcaaaaaatttaaaaatacataaaaaagaaatagataaacctgaagattggaaatgatatggaatatatgagtcaaaggccaaaaaaaagtaagtatgtggctacgacatattgaaatgactggtatgatccaatatactttactacaatacacaaattaatctattctcacattatctaacatatagcaagaagcctgacagccaccaagaataacagtaaatatttgttgattgtaactttatgttaggcactgttaaacaccattggtacattatctccgttatcacaactttaaaaactgtgtatactttttatccccattgtacatatgagaaaactgatggccagaaagtttaaagtgctcaaaatctcctagattcagttgcagccaatgtttttaaaccagaaaatgtaagcatccattaaatttcatttacaacaaactctttacagaaaaccatatctggaattattttccacattttaagtgagacacatagagctacagagcatctagagaagaagagagaagaaaaatgatactactacttttttaggaaaagtcaaaaaattttttaaatggactaaaaacgatgtaggttaattctagccgattccaaacaaatgactgtcttagcaagcttgtgtaataaactcaattaaacaaaaatgtaaagttagttttttggcttaaatgcctggtgaaataattaatatagaaactctacataaactcattctaaaggatgatttattaactttattagctagtatctgaagtgttatcaggagacaaaaattttctatgttttctgtattctccacagcagacagaataagttcaattactaatctacaggaaattctgatttggggaataagacattgaaagtctgagagacaaaaaactgtaaaatatctagcttatctgaatgttatatttactttaattcgtaaaaaattttttgaattgggattcagatataaaaacaagaagcttgctctccaagagctcacaatatagtttttattggagtcaagacagaaatgctgttatgtaattggctcattgacatatcctgtgtctgctcaactttttttcccatgtataacccctcaaaggttgagcctctgtcttctctatttgcatatctaaatatctgaacatgaaaccgacataatcctaaaggtctagagagtagccttacatgaaggaaaaagctgaatgaatgacatctaaatgtctggaatatgtaagtgatagacttcagaattctcaaccaacttcaagatgtcctaatagcagtaagaccatgagaaattctcacattggctccaatttatacccccacacccactttcctgcttttctttttgctaccatcaaagcctcctgcaatctttttatcttcttgaaaggctttcaattttatagtatgcttaaaaccccataataatcagaagttactttagacttgttatagcagctaagatactgcacaagaaacagatttccaaacgaaacctaaagaaggaattaatccaaaaaagctagaaagaataataaaatacaactcaattgtattcaacttaatcaacatttatgataattgtgtgttaggcactgttctgggcctaggggctacacaaatgaacaataaatgttttttgaacatcacagcttagcacatcattcaaggtctatctttgccttgctcttgtaacatagcgaatccttgaagtccatgccctgttgtttttcacttctctatctttgcatatatatctgccacttagaccaccctctctctagctctgttctaccagaataagactcattgtcatttggaattgtgtttcatgactcaggaaacaatgcttccatcaagctttccctaccccacaaccggttaaaaattatatgaatctacagcttcctggtctctttccctaaacactgtacagctatcccctgtatgactgccatatcccttttccatgatgcttccacagcgagggccacttaaaatttattttttgttactctgcttgtttgttttttccttagatcctcattgtgtaacaggtactcaacaaagtttaatgagtctagtggttagataagaagctctatctaagtaaaagcaattaacattgaaacctttatttaaagtgatttccctttctctccacctccattcccatccctaagagcaaaataattgaagtaagttgaacggacttcatgctaaaccagaaaaatttacccttgaaagaatcaaagatgtttaaagttaaatctgataaacagtggactatttctaaatgaaatagcacatatgagttataaaatgtatagcattgtttccagttaaacatttcatatttatatagatttttctcaatcatacctatattaagttaaacataaagcaaatatttaagaaataaataatcataggaaccattgaataccttgacaaactggaggtgctccatccatctgcagtcgttctcctaatctgcacgtcagaattgcattaccaactaaagtaaatcctggaagacactgatacctaataatatcacctattaaacaaaagaggggaggtttcatataagcaacaaggtgatgataaaaataaacaaatatttcaattgtaggagaatattttctcctttagttattttcaatcagtataaaaatgttattaggtataagtaggagttatattcaaaatattgaaaaaccagtatataatactcattgacccatcaggactgaaggcaaaagtgaactgccattccctctgtactggtgcatgctggctggatataagcaatagtcataaggaaataatttagttgatataggtgagatattcaataaaaatacaacaagtagttagaaggctttctatttattgaagttacatcggtcactgatagtttctttgtgtgtctcaaccaaaatcaatataataataataatgaataataaaagtttattacagcaacattaagatgtcttcgtatataattttttttcaaactgtgtggcattatttgggttgaatttccaactcagttttaaagcaactttatgattaaattgagtagaatcaactaagcattttccaagatatggaaatgaaatatgtcttctaatatggcctacaaaccattcattctgccaagtcaggcataggcctgaattcaaagaacaaaggttagaactatagtgtcagaaggcagcaaaataatagtttggaaagaaccatcagaatacagttaacggcttcaaattttaacacgttttcttattgtacattccagaaaaacaaaattaatttttcttctctaataatccctttcctcttttcactccttctcccttcttaaaaattctaaataatctctatcaacacagggaatgagggtctcaagacaggctattactattctgtattttggcttatttttaagcaaatagttctgccagcagtatgttttccttgaaaataatttaacagctttacctatttcaaattcatcatcttccgtcaaaatttcagcattgggcacaggtggtggaggttggcacacccttagttgataggctacaaaaataaacaaagtgtttattccttttctgtgcagctacatgtattcacatatgcaaaaaaacaagaaaattatggaaagttgtttaaaaaaataaaaataaattacataatttatcaagtgtcaattacatctttatttttaaaaatatactacaacattacaaaatattttcccatggtaacaatgcttactttttattctttatttcttacccttattctagtccttcttgttatgtggttcaaaacaccttgtttttttcctcctttgcatgatcacaatttggaattacgtattcatgtttgcttacttgctctgtgcctatctttcccaatactcatcactgaatgccctgcacttagcaaagtgcatggcatacagcaataattgcaaacaaatgctcagtgtttactttattccagacagtattataaatacttaactcaatcctcacaaaaaaaattttcttatttaatttatgttactatttctataattgcccccattctttttttttatactttaagttacagggtacatgtgcacaacgtgcaggtttgttacatatgtatacatgtgccatgttggtgtgctgcacccattaactcgtcatttacattaggtatatctccgaatgctatccctcccccctcccctccaccccacgacaggccccggtgggtgtgtgatgttccccttcgtgtgttcaagtgttctcattgttcaattcccacctatgagtgaattgcccccattctttaaaaaagaaaactgttaaagagagttaaaaatttgcccaaatcaagaagctataacgtgacagagctgagatttgaacctagatagcctggctccagagccttgtcttgccatgctactttaatataattatgagatatctgtttatcaaatgtcatgtttctaattatgatatcacttgaacagttcatctcattggattagattggcatttggcataattgaaaggccaccacgacaaagtctctatgaatccaagcttcatgcctactatcctcacatgacatctaaaatctacaacaaaatcatttgcttgattgaagtctttttttttcccttaaagtcttctaaaaatgtactatactcatattcattcaggaaacatgttttatactattataacatctgaggcaaattgttttatatgcctatttttactacttaaacttagaagttctttatgtactcaacgtgctgataaagagaatgagactcaaaatacacagtagcttatacaagagcacacaattagtacaggacatagccaaaaactgaagtgtatatcctctaatttcaaagcccattcaacactgcttctattgcaaaaaagtattatgggagtattgaaaagcatcaactagaccagctcaggaagactcctatagtaggaaaagaatgagatatacttgaaagaaggagtaaaatttttccagttctgaagagtgatcctggggagaagagcatttcaggtggaggagaaaacttgaacaaaaacttgtgcaaagcataaaatcattgattcatcatcatctaacaaaaagctatttataagagattaattggctaataaacattcaggttactaaggacaaagaaaagaaagacttttcaaaatgtagatctacagtgatgaaacaaccaaaaaaatcgtgttttaattttcttctgcaaattgttttctgtcccttcaaacatcttccttccagtagtttaacctgtttataaaagcacttgctgtgcgtggatgttaacttgcaagtaaaacaccactgtacagaagggttactgctagagaagaaagacttgctgggaaagaaccccatggcagaaagtataatccagatttttgataaaatgtttggtggatagtaattaggaattttgacaattgttttcctgaacttatactttaaagggggtacagtgataaagaaaaaaggtaattgtaagaaatgcctaaaatgtaagagaaaatggagaagatagggggagcctaaacagagaaatctttctgagactatgctttagagaaggctttgtctgatcttaccagagaatagagatcaactcagaaattacagaaatgtagagatgctcatacctgtattattttacttgtgtttttctgtgaagttattttaatcttcatgctaatcctaaattgtttgattattgtaaacaagaaacacttttttatgtggaatccatgactattatcatctgtggaatattctgagaatgacctagataactcagtcacaggatttaaaagatcaaaggttgtaattttttactaaagaagactatgatgctcagagttattatgttatttttccaagacaacatgggtgctgtgagctaatgtcttattctctgttctttcctatcactgtcagttttataaaatgtgtccctagaagctaagagatcactgtgagcccatggagggtctgaggtgtaatgtccttaacttccaactctacttcaataagaacaactctattcttatcaattgtataaatttgaattctgaacaaactttcctttgaataaacattctacattcttacctaagtgattcccttgattcttttggctacaattctgactctgtgtctcaattcccaattctatattgccaggctaaacatctcttctgacctcttcatgcctccctttcccactcctcactgttattttctaatcacagaaccccttttgtggcacatgtaaacacgacttgttcaaagtgtgttattttccatttatttgcatgcttgttcattgggtccctatgtagactttaagttacatgacagaggctatttgtttatctacctttttcactatccaggaattagttcttgtcactatacttataattcaactaatatttgctaataactgacagaatgtaggtttcttcaagagggaagcagtctctcaacagtcttccctaagatgactcccaactttaaaattgccagtggggatgaaatagaaacaattgagtgtcagacaatgctaaacattgaaatataggcaagatctggttaaaatgcttttcagggttgaactatgtaattttgaataaaaaagtaaaggggaaaggagtaatgaaaaacaaacaaacaaacaaacaaacaaacctcttttcatctgtttctcttttgacttttgaagaccaagcactacaaaaggcttaatcataagtagcttgcaacaattttgttttcaatcttcatcaatctctactagtatgttctttaacataactctatgatttgtccaatgtctctccaatcttgctgccaatatctcagtctagattcctgccatttaattcccgctgtactgggttgaatagtttcacctaaaattcatgcctttcctggaacctaaaaatgttatttgaaatagggttgttgcagacgtaattggttaacttaaggttgtataaaattatgggggtacccttaattcaatatgactagtgtccctataaaataaaaagagacacagagatgatcacacaggtaagatggtcatgtgatgatgaaggttcaaactgtagtgattcatctataagctaaggaatgccaaagattgcttttaagccaccagtttgtggtactttgtttcagcagccctagtaaactaatacacctgtgttattaaattggcctatagtgtgttccttaccttcagtgtctccctgatactacccttcttacatacagtgaagtgatagaagagaatcaaggaagtatttacctggaatccactttgtacaaaggactctgaaaagtcctttacatgcctctttcattaatcactaaaatgccacatcaaaatatgtgtaaatatactcatgttaccaaaagggacactaaatttcatagtggttgaattatttgccctactcacacagccagaatttgaaccaagttccaatataaaattaagacacattgtctccccgatttatagataaataaacctcattttgaatatcattttgttgctgccatttccctattttcaatttacagtgtttttttatggcctacagattgaatttatcatcttagataaagcaagatcattaccctaattctcatcagtctctcacacaagatgtctgctatatacagctgaactttcctgggtgctttgtatttgccatgttcatttcctatcccacatcttcatttctggcaagcttgccagcctagaaattggcaccataatatttagcatttagtgtttcattgtgttgaattgttttatgtattggttcacgttccgcgtatagcttatgtattttgtattgtatttgcatttcctacaatacctaacacatttaatttagttgtttattaaataagttattattgagctcctatgatctgccagatgccagaaaccataataggtgctggaaatgcaaaggtaagcaaagcagacagaagcctgctctgtatatgctaatagttggtgagaaagatattaattagtagaatttaactagttgaagcaaggggtgtgtgtgtgggtgtgtgtgtgtgtgtgtgttttctggagatgaatgatagccctagtgagagagaggagggatcgaaaagagcaaaaatcaggggctaaatcagacaggattgtacaagttatactcaggatttcatttattttaagctgagaccaatgggaggcctttaaagagatttaagttggaggggaatgtggtcagatttatcctttaaaagatcactctggctgtagtcagaaatttttaaaaagcacacacacaattggaagagaacaagagtggatagcaagagactactagagtctatattgcagtgggtgttaaataaacaattgctgatagagtctacataacttcttagtgtccccaaatgacttacgcattaaattaaaagtcttgattatgacctccaagggtttctaactttgtctgattaacttcatccccacctattaaccagcttatatttttagctataaataatcaaaaaatagtttatctcctctacttaaaattcaagtaccactgataggcatgtggcctatcattcttacttcttaaaaaaatgttaaaccacatctcttcatttttaatactaaatttcaaaaaatcaaacctgtctacaacctcttactgtagtctttttaattactgcatcaacagagctcttaaatggttgagagcttaacatttgataacatagctaaaattttatgttctgtataattttcttttgtctttcattttcttgaaatctatcttcctagctcttttataactttgaacatgaccaaaacagagatgtcttcactgataatgctacctaaagttgatcctttgcagttaactttgtttcacagtctggcaattttcacaatctgtaagaattatgcatttgtttactatctattttcttatactagaatgtaaattccatgaaagcaggcatttttgcttttcttattaactactaactctttagggcataatccagtgttcagcacgtagcagcatccaataaatatttgctgaatgactgactgctagagaaatgaaagaatggatgccgaattagtgtatatacatatatattacatataagtatatatatgaatgagtatatacgtatgatatataacacattcttatggtattgagtaaggacatagtctagactctttggctctttgggttcgaatcttattttgaacactgaaaaactggcaaaacttgggcaagttatttatctttctgctttgctttcctcatttataaaataataatgataatagtaataattttatgccatcccaaagggcagttatgagaatcaaatgggtttacacatgcaaagcatttggaatactgtctggcacattttaagcttatctttcaataagaataaaccactatgacatcaaattgggtttctatttcttcaagatatttgacattcacaaataaataacataaatattaatattttctgcttttcttaactttcacttcttatgtataaaggacattttgatttggcaattatttacagaattatgaataaaattgaggcatgttgtctttgttggtcaaagaaaagggtgtaatgattgtgaggtgtgatgcagcagatgttttgtaattgaaggcaacaaaggggaattaaacattgtgcagctctgcttctctttctgaagatgtttctatcaaaccaatcaacatcataaaaaaatacataatccagtttgtattgataactacatttgtgcacaaagcaggctgatcaaatatttactctgtaaccagactgatggttcaaatctcggtctgctgttggctatttccatcaccttaggcaaactgctaagaatctgcttcagctatctcatctgtaaaatagacataaagccaagattgagttaaaatattataaagtgcttagaataaggcctgaacatattaccagttaagagggagggtacattccgcttgacaaatattggcatcagcatttctgctgtgatgatgtttgtgccccatactcatgtaacttcaatctgacgtgaccttcctcacaatgggtcattcaaagcacccacgtgacttcccagaacgtatctaaccatttgtttgtttcttttctgatttaaattggatattcttggccaggcacagtagctcatgcctgcaatcccagcactatgggatgtgaggagagcagaccacttgaggtcaggagtttgaaaccagctagccacctgcagagacaggtgaaaccctgcctctactaaaaatacaaaaattagacaggtgtggcggtgcatgcctgtaatcccagctacttgggaggctgaggcagaagaatcacttgaactcaggagacagaggttgcagtcagctgagcttgtgccgctgcactccagcctgggcgacagagtgagaccctgtctcaaaaataaataaataagtaaataaataaataaattggatatccttgttttacattgatgtaccttatactgtagtataaaatccatgagtttagcaacacactgtatcatcctatataatatgtaagtgtctgtggtctcaaaactattagcacagtgctctggaaatcacttaagaaatactaattaataacaaatcaaagttagaaaatacctcattctgtataaaatatatgctttggttactcaggaagaaaataaacaggtctggtacaaatatatccaatattgtacaggttaggatcatagacaaactggaaataatcttagaaatcatttctcctagactctttaaggggtagtaggaagatgacctaaataagtgaaatgaggtggacaaggtcacacattcagccactggtggaactgaaatgattaaatcatataaattatgtcatctaaactttaaatcatatgtacatatatgttagtccatgcttttcatggattgttctatttagaaacagtttgcagccatgaccattaacagaaaagctgcacaaaatagatattcacactttaaaaatacacattggaactaagtatgtgttctttttagaagaatcatgttatctgacatgccccaccaacttttaaacaccatttgctatctaacaactactaacaactacatgagagcatcgtattccacatgtctgtatcttctgaggatggctattatttaaatagttctctgtttttgtccaaatgtgcatagatatctggttcctcgtccaacaaatatgctttttgaaattggtttaagatttgattctggcaatagtttttcgttatttttaattttctattttcttttcaatgaaacatccaacccaattccagaaaataatgctgcatgtatctacttctattcaatgcgctattaaagccttcttcaaaaaagacaaaacagaacactggcaaattgccattccttctccaaaccaaaaaaagcacaagcacataacctttctgccaagtaaggacacagtattccttacagaggacagaaataacgttgcatattcccttataaactctaagctctatataagccccagtgtacttcagtgctcatccagattagttcaagtatgataatctcatgatttgggggagaacaaccattgataaattttatgttctgttatgcagtttgggcagtgttatttttaaacttatctgaaataagcttaagctatttcacttgaaagcagaactaagtgtattgaaattaatgctaccttagttttaattgaagagaagaaaacaataaatttgttttccattttgcagaaaatctgccagtgagttgacatgaagatagaagtgtgttccagcagggtttaaattactttacaaatatcccttttacatcactaatattttatattcagtttgtttctctgcctctataagggagaatattagaaatcaagagtgaatgcttatttggatttagagatgcgagaaagaaagtttctatcatgaggaatgaaaatgaatcaatgatctgatttggttctgtgtcctgacccaaatcttatctcaaatcataatccccataagccccatgtgttgagagagggatctagtgagaggggattggatcatgggggtggtttccccgatactgttctcatgagagtgagtgagtgctcatgaaatctgatggtgtttgacagttcctcctttacacactcactgtctctcctgccaacatttaaaacgtgcctgcttccccttctgccatgactgtaagtttcctgaggccttcccagtcatatggaactgtgcgtcaattaaacttctttcctttataaattaccaagtcttgggcagttctttatagcagtgtgagaatggactaatacagtcaacaagaagtcactcttactatttacctagaaaagaaataacagaaactattgtgaaacaaaactactgggatatctgctgcattattgtaagaacatttcaatatctgttgcatgaattgtcttctccgcatgcagacagctaatttaaggtatgctgccttagtgctgagcccattaaaatctgaaaaataatgtgccaaagacctcttctctacattgttgagttccctggcatatagacctggctctaattgataggcattgtctcctgttaaacataaacagtttcccagaagacaaggtaattctttgaccttgttgaaacaagcgagaaataagacctttccataggcataatcagaaaacaagaacactgttcaaataatcaaaatgacagtcttccacctcagccaacattagtgaatagtatttccacactaattatataggtatattccattcccccccaccttctagaaaaaatactaagatatccaatcataaaactgctcaaattttctaacagcacccaatccagaagaaaattatgtttccttgaacccttctcaaaaccatctcatacagtcaaattcctttatcaagcctctcctgacacacttttgctgagatcacagagtccctcatcatatgttgtctcactcattatcatgagctaataaatctaactttgtttaacagaagttgtgttcctgatagtctttggctggaggcaacagaaagtaagatatttaagaaaataaataccataccttatcaactgggcatatacatacagtgaagtgtcaaaagatagtaattttgacatgacttttagttttgagtaataattaagtagtcatttaagtcatttaactaacagtaaatggtattttcctttcctcctaacagttctagcagtttgggttttagctccattgtttcattttatacacacatatacacacaaacacacacacacatacatacacacacatacattattacacgatgtccatacccccgttctctctggacatcaaataataaaacactttacgggttctgtgctctagctattacaatacaaaaggaggtcaggtctttaggttatgtgaggcaaaggggtcacacagttaaaggcaatcgtgacttatggtttatataaagcatgtccttacatctgcagcaatctcttttaggatgagactttgtgaagttaaatatacttgtttccaaacacagcatttattgtaaaagtagcataaccgtaaaagatgacctgaaacacattacaggccttttaaatacatttctttacaataatgagtcattatgtaatcaactcattcttcaatagaaaatgtgccaataacagaaaataataacataattattaaatcatattatgctaagaaaatcttccacttacaaagtgaatttccctagtacattgatattagaaaatcaagtgacctggataattggcttaaacaccataaaataatttcggtattaaattagtaaatacatattttggctatactctagtcgcctggttattttgagtgacataagccagatctcaataaaattttttctcttggcacagtgcccacaggcacattttagaaactataaagaatacattgagctgtgataaatctataatgtactgtcactactttgtagatcttgggtaaatgaagcaataagaagcttaaagcttcaagttataattaggaggcgtatttgagaaaatgagatgacccatcacattgctaaaaatgaaaatcactttgactaaatttttaaagaacaattaggtttatataccattaaatataatctattcatgagataataccagcttagaacattgtctggcacttaataagaatacaatgaattttagctgttgttattgttgttttgatttttcaaaaagggatcattctttgaagtcaggcagacctattttgaactccagccagcccttctacttattagttctctggctttatgtaggttatccggttttttactcagtttgttcattattaaaatgaagataataatacttaccttatagggttactatgaaaattagcaataatacatggaaagcacctagcacaaggctcagcatattaaattttcaataaatggttgttaccactaatatagtgatggctatacaaagtcactgcaaaaagaacactcagttaaaatttattttgagtaatttatctttcagggggtcattaattaggactgaatattattattaattataaaccaacctcatcttgactctacagcagatatgaagaaaatgcggttcttattttaggaaatcataattatagcaacacaaagagatacaaaaacatttcctcaaatgagaaaaaaatatgatatctgaggtaaactgcctcaacatttacgcttgtcctattttttcattgcagagagctttcattttgcaaagcttttttataaatgttatttttgatcataaaaggctttacgaaggtgatgttttataaaagacagatggctgcctggatcttataaaggaagttaggttagagaaaaaaacatacatttttttccctctcttttccagcacattcaaaatatatcaacaaataaaacttcaatgatcaatgtgaccttaagaaaatacacaaaaatattgaactgtcaaccttataaaataaatatacaagtcttgagaaaatcacttctgaattataaagcaaggtatatcagaagtaactatcaagtctaagaggatataaagaaaactgggtggggtagtaaaccattcaaagattaggcatactcagccagcttaaaataagtgttaagcttataatgaattatatacttggtttatttatcaaaaattccaaataatttgaccaattttttactattatgagatttccttatgacattgagcttatagctcaaattagtattaacaggcatatcttcttgttcttgttaaggaggatgtaatttagaaattacacatttagtaattctaaaatgatctttgtaaaagttgttactaacactgctcaaataaatgcaaacaactttttaaagagtctgaatgcacacttcccactgtaacactaaaatacaatcagtcaataacaaaaatataaagaggataagaacaagaaatttgtatcctcaaaaaacagtcaataaactcctaaggcttataaaataatacaccatattgtaattaagttttcaaaagtttggtaaaaagagtaagtgtaatcatagaagtgatggcagtgatcaccatgagttcaaattatcaagaagtggaggaaatgggacttaacataaaaagacttaaataactgaagatgagttaagaaaccaagagtatttatgatggagatgaagatgagatttaagaatggaagttcaggaggcagtgagaaaaccaacctgactgaagttgtgtagggactgcagagtaacaatcagtgaactggattatagggtagctttaaattagatttaatgtaggcctcatgcattcttgaaaaggcaggtaggaatgaaagcagtgctttagaaaaattatcctattaggctagagaaatttaaagtatcagtcaatttttaacatgaactctggctatgctcccaaacttcaagtttattttaaaatttgggtagaatctccatagctgttgattcaaacagtaggcttcattaggctctggcaatttttttgcaccttattataaaatctaatgaataaatgtcctatttgaaaaatctaaaatgtgaggtaagatatggtatggaaacagatatttactgaacatctgctctgccaggcattatgctacctgtatattatcaattatctccaattctcaaaacgtctcctcagcttaaagctgataatagtaacaattacaatatttctacagttgagctatgtaaaattgcccataggattttttgaccaatgattttatatggttcaacctaatatatgccagtaattggaataaattatacatatataatatgacatttaatcctctcagcaattctatcacattgctttacagctgaggaaagtagagatcaaagtgtaacttgtccaaggtcaaatagaaaatcaagggttaaatgaatatctgatctgttttatttttattgattgattgattgattgattttgagacagagcttcactcttgttgcccacgctggagtgcaatggcgccatctcggctcactgcaacctctgcctccggggttcaagtgattctcctgcctcagccacctgagtagctgggattacaggcatgaaccaccacgcctggctaattttgtatttttagtagagacggggtttcgccatgtgggtcaggctagtctcgaactcccgacctcaggtaatccacctgccttggcctcccatagtgctgggattataggcatgagccactgcgcctggccttgatctgctttattcttaagcaattctatttctatcacacatgtctcaaagcccacttgcaaaagtcaagtgaaacattttgaaatgaggatatatgtttatatattcatatatgtgtatatttaaatccacactaagattttgtgtttatgtatatctattatccacatatttttatatgaatgttcaaattctgtctcatacacacacacacacacacacacacaacactgacatcctttcctttgataatatttttcccttgaaatgtctcctaaatttataaaaattttatacttcctatagggttatcttgtggatatttatagttcatcaatgaatagtcctttctttatgatttcaagcagtacataaaatgataaaaaatattgaggcagaaatccatgtggagataaaatgtacataatatagtttggcaactaattcatttttttatcttaatgattatgtattagttcccgaattatgattttctatcaaagtaataattctattgtttcagccttaggctatatctgcaaactgccagcattaatgatcaactcagtaggaaaggcaaataaattatttttttaaaaaaaacagccggaataaaagttgtctgactgaatatccaactttccagaagagatcagcgtgttcatggtggtatggccatagactgaacccctgacttttcaactggttatgttggattgcgtatcagttctggatggcagtggatcactatggagaaactaattagataccatctaattggctgataagtgctcaaattaagcaactcaaacattttatgataaatttctgactagatcccatgtgctttaaatgtctttgaacacaatcacagttgatttactatatactatatttttcatggaatataagctttaagtatcaaatatttagctacttgtatattaaaaaggtgaaatgctaagtcatacattatgtaatgggcaaagcacatgtccagcctcacattttcatataatttttgcaaacttaatttagtagattattggtcttgtgaaatactcatggaattagtctgacaaagttatatgaggcagaatgtgttataatgagactgtagtcatagcagataaaaggatgtaatcattatagataaatagccattttcttattaataatggaatacaaccaattgaggattaaaacaaaaataaagaagagaaacacctctgtgaaaccttctgaatgtcctttcaaaaagttaagtttatgaatacagagcccagaacaaaggatcctatacaatgaaatcaaattgagactatacataaattattccacagcagtaaaagctatgaacttaatgatctggaatagtcacttaaaactgtaagattctagaatagacacagttttgaaacaacagtataaatgaatgagtaatgtgatccaaagcgtgaagatactgaatgccaattttagaaagagtcacagcaggttgaatagattaaacattttgtataggaaaaaaatctattgacgtctcaaaattacatgcactagagtatgaacagctggttctcctttattggttttcatgcagaaatgattattttccagtgggtaattactgactgatttatttcctatatccatttgctcacattttaatgtccctgaatacttagaagaggtcatcttttgcaaggaaatgtgtttgaaatgctaaagttactgtgattataaaatttctaaattttaataccttttcaatcattggttaaatatatattacattcacttttttccaggacaaattaaacagtagcaaatgaaataggaactctcagataataccaaccgtgataactgagcacaaaaaagccacttgttgtgaaatcactgtggaatttgattagaatctgatttgaagtactgtagactgattccaaagcggtattgccactgaactgaccgatctgaggtgaattttggtctggtccatccctatgagacaaggattgggaaaggaggagagatcaagattgattgtggaagtagttttgaaccgtatttaataaaagtattgcatatatttatattctaacgtatcaataataaagatgcaggaagctaaccaatgagtacaaattatatattctatatctatgtaggtgaccacatatttttaaatgtcaagtataaaaatagattacatttttactaaatggaatgtactcatattagttataatcaatacattgtctttgtttttttttttttttaccaaaactctgatgcttttaaatgcttgaggtttgcccctcttttattttcttcagcaacagtcttgagaatcacagactgttaaagttacaactcttagaactcagataaattatcagtagttaattattaattcagatactttctttaatacatttttatttatttatttatttagagccagggcctcactccgttgcccatgctggagtgcagtaggatgatcacagctcactgcacctttgacctcccaggctcaagggatcctctcatctcagcctcctgaatagctgggaccacaggcgcatgccaccatgtctggctaattttttattttttctagagagagtctcactatgttgcccaggctggtattgaattcttgggatgaagtgatgctcccactgtggcctcccaaagtgctgggattgcagatgttagccactgcacctggccttaatatatttttaaataaagatgtttcaattgacaagactttaatacaattaaatttttatggcagaaatccactagttatattaaataattataatttcttaaattccactggcttttgtaagtagagaacttccataccttaaacttaagtctgttaacttcctgttttagcacattaatttaataatattttttaatcttgttttcacctatgaagtctttgttccacaatgcttacctagttcatggggcaaataagccaaaacctatttctcttgtgtatgtaattctacaagacacatactgtcaccctcagttactcacatcaattcaaatatcagatgacaatttgtaacagaggattgtgatatatttttattccaaccttgttttactgtgtatataattgaataaatcaataacaatagtcctgacttaccatacagtaatgaaatcatatattggttctgtttgaaggacagtaaaattgatgtagatgccattcccagggggtactcttacaagccaaaaacaatcttgaaagtttggatattcatcaggatacccaggagaataaatggtgccattcattgcagttatattcccaccacaaagagctacggaaaaagtcacaaaacaaaataatattttaaaataacaataaactgactgtggagaaaaaggcaaacatttcacatatcttaagcattatgaaacacatttatgccttgtttttacttcagttgaggtatgtataatgaagttggcaacagtgcacaaaatagagtcaacttttatttatttttccacatgaggtatactaaataattgttattaatgatcactagattagtaaattacattgtcttctctattatttaaatattttatatcaatgcaaagactttaactttcatttgcctcttactatgtgtacatataaggccttataagaggttcaaagccttttatttcaaaggattttctagaggaaaggaactcagtagcagtatctgggttagtggtttatgtaagaatgacttaaatgcatacaaacccacatgcacccccttcccttccccacacacataagaaaagctctaaagtgtgaatcaactattttttcactcccaataggaaaggttaggactcctgccaataatgataaaatcgttattcattatagagccttaggggtttaaaaaatatcttcagctgagagactatatatttagcatgctattggaagaggaagacaagtaaaaagtgccaaaacaatattaaaaacagatgacatcacctaaaagatagcttcaagttagaagcataccttcacaccttggaagtggatgattccaattacgactgactccgtgaaggcatgtgagagctgaatttccaattaatgtgtatcctgggaaacattcaaatgaaatggtttgacccacagtaaaatcattaccaattacaaaaccatttcgaaacgggcgtggatcaggacagctttgcaactgataggctggaaagaggaaaaagaaagacattttttctttccaaatttcagaggccacagatagggtactacagcaattttgcaacttaaaaatagatgtgatgctacttgcagttgattataaatagcaattcaggtttatgataaatgctgtcaatgacctgtgacataaatttcttctcatgtctacaattttcatatttaaaatgttagtacaattaataaaaacgcatgctttcttcacctacttgtgcaacccaactaaattatgttttaatgaaaatgtaaactcttcttaaagctacaattttaatccaatgcattctgattctcttccagagaatgcaattgcttcttgattatgttacaagcacacagaatgcaataagaatatgtataagcctaattctgagcctttttacagtttgttttactaattgtttttctacagatcacaatatacttctgttgagttaatttcaaagaagttagtttgtaaaataaagcactggaaaaaaattttattttaatataaaatgaactttgtacttcagttatgggataatttgggcaatgcagtataattgcctatttatttgttcatacttctcttgctctacattttgtatgagatcaaagttcctgtttgtattattatcatatctcaaagccttggctattgcctttcacagagtagtgttaaataaacattactaaataaatgttagacctatgaacagggcctattctcataaaatatcaatatttggaactttttaattaagaagttcaaaattgtattctaattagtaaaatttaaatttctgaaaatcaaagactacttctctaccaaaccgttaaaattttatattcctcaaataaaaaatcacattcgaagttaaataaactatcctgttgtttattacaatataactcaaatttttaggactaaagatttcagaattaatgaacaaattctttaaaatgttaagtgctttcattcttaatgtgtccttttcattttaattgatattctacacaaaaaatattctacacaaaaatatattagaaagagttcttattccaacttaagacaaatgtgtattaggaattgatcattaggagttggaatatattattctattaaatataccctttcaatttctactccaagttttttagtttaataagtatagaaaatagattttaagtgtgtaggagaaagttcccattctaatgttatatacaatacagtgaggtgggagaattgggtctggaggcagggaacctaaggctgtctaacaccaacttcctcaaactaaattgaaaggaaaaccctaactttccacaacttagtaataagaggaccagaggcaactccatctgcaaacccctcacctttttggcccagcagatgagaaattggctgtctgcaaccaatcagactgattgcaggccgagtcctcgtttgcacagaagtataactttgtaacttcaccttagcctctgattggttgcaaaaagcaattggttgctttttgcaaccaatcagatatttgcacaggagtgtgatctttgtaacttcacttcagcttctggttggctgctttcagatcagactgattgcgggctaccacttcatctacatggggtgagcatgaagtggccaatgggaaacttctagggggcatctggacccaaaaagattctgtatctgggcccttgagccactgatcggcctgctcccacactgggagtgtacttttgttttcaataaatctctgctttcgttcttttgttgcttcattctttctttgctttgctgggcgttttgtccaattctttgttcaaaaagccaagaatccggacaacttgcagtcacaatcttgtaccggtgacaacaggacttaccaaacctaataatcttgtcagtaataacattaattttcaaactgattccttcagtagatgggtactctaaattgtacagtataacttttccaaattcagaaggttcttaaaatttaaccacaaaatcaatccaaaaataatattgactctgtgaatatatatgttaactatttctttaaaatgcactaggttagttacataaatgtagcacaaaaagaaaccattttaaaactcagtgtgattcacaacatctcctcatcattgtaatacattatggctcctgttaataatacgtcagtaacagtgaaaaaagtttatatattttacacttttattaggtcaataatgaattgtttttcaaggatatattaactgaaaatatcagagttaataaagctcaatttctagttttacatcattcaaataagaacattattttgagagagagggaaaatgagaataggaaaaaaacaggtttagtctgttttaaggtgcatggcaaagaacttggcataaggccatgtacacttgctaaagtatatcacaaatatggttctgagtcttctagcagcaaagaagagaaattcaaccaattacccaattgttttaaaaataattaatttccttgcaagcatggttaattcaatgtgctgggaggtgattgaaatgactcctattttatgaaagtgattatgtgtaatgtagtgttcttacattatgcacgcaagtataatacaaattataattatttcagatccatgtaatttgatgtttaagacctatctctatcttaactactttcaaatttcctctttggtagatactttagcaaatatttattgtgcttactgctctagatgcttatgatactccaatgaacaacccaattgcctgttcttgaggagctgagatacaaaagcattacataaagtccttcaataattagggcagagatgtaataacattttagtttattttgattaaaaatttcagccattagaaataaactttattatgtaaaatatcattttaatatttaattttaacagaatatacacatataagacatgaaataatataatagcaatagctaaaaaggactgagtaattactaaaaatatacatcatggaatacaccttacatacattttttaataaaaagttcaatacaacttatctgaaagtataattaactccattatgcacatgagcaaatggagagcaaggccgaggccacattagatagaataggaagaatcaacatttgagcctagctctacttacgcccaaaccctttactcaaaagagataaaaatcttgctcaaggtcatgcagtagttctgtttgagagataggtctaatataacatgattatcaaagtatttatattctcatgacaatagaacaaaatgaaggaatgtcatattagtcttatcactataaagtaaaagaacattttacataatacaacacatgaataatacaaaatatcttttcaatatattccttttaatataaaagcaaagatacatctttgctgtgcagctggccttgcttatttgccatgccttgcttaatttaattgtgtattaacttaagactaattcaatccagtttcatggttaggattttctaaggtctcagagagacatcattctccctgtgtagttcccagagagttgcattgttctaaaaatcttcctaattgaagctcaccttggcttaagtttttttttttttctttctaaaacagaatacagaaaataattagactcagttaaatatttctaatagctgatttggggttatataaattttcattttttattatttctcttaccttggtatacaatatgaaacccttgtttgttttgtgaatagtcactgtgaaaatataagctggtttcatgggtggtgctgaataaggaagatggtatttgaggaccactaagccggccaataacagtactagtttctgaggatccacttcgtacttccaaataatcatgtatggtttctgtagaaaaatttacaaactggagatgtacacctgaagaagaaaacaaacagaatgctactttatttgctttaccgaattaaacataaatatacacacacacaatcacatcaatgtacttagataagtttgcatttaagtcaagaggcataatctcaagatctgagtcatggatttgctgtctgcctaggacaggtaactttgctgaggttcaaagtaaaagaatactgctctcacatgtccattattagttaaaaggaaaaacatttcatttcattataatgtcactgtatgaaaaatgatccaaaaaagtggctttcttattctttaatacgctttaaattacataaactaatttttagaggaaaaggccgcttttggcctaatttgtgttatggaaaaggtcaatctaaggttgaaaataattgcaaatttgtaatatagatttgtaacatagattccacaattgcattagaagttattcattcacaggagagaaattaacttctcagaaatataacgtatataatttaaagggtgctctttcagtgttttgcttatcagaagataatgcaggcttttatataataaccttaataaaatctggtgatcattgttatatgtggtcatattgcaatgtaatctcaatatctttataagcataactaaaatacgagacagtgaaatgtctctgggataaaaaatgttaattaaagtatatttgcttaattaatttaacactcaattttagtaaatttgatgtttttcttactattatcactctctaaattatttgtaataaaatctgatatttggtgaaagttttaagttatttatatttgctacacattatatatattacctgccttaagtgatttatatatgctaacttatttaattctcaccatttcatgagaacaaggaaagtgagtcgcagagaagtaagacacatgtaaagtttacacaatgacccagtaggcttgaactgcaaaccgaggcattcagactcttaagcttatgatattaataactacactggggctctgagtaaacgcgcatcatgttactaaatgattttttaaacagtcccttggacaaataagctttggaaatatttaaaacagggtttaaaatattaaacaactttctaaaaaattagattaactttttagaactttggacatgcaaccttaatatgtgaagaccgaagatatgcactttttgtttttatttttaactgagcacttttattacaaacattttccaaaattgtttcatatattcttgaacatatgtttctttacctcttgaaatgtattatatatatatatatttatatatatatatttatatatatatatatttatatatatatatatagtttaaatacattggacctaatatttgatttaatcaaaactcaaagaaaagagtatggttattaaaatgtaatcaagtatctaaatctcttatgttttcatttataaattagagctatatattcaagttttaataaagttggttttcaaaatcaagaattagccagaaattgaagatcatgttataatgagattattgaaactatttttaataattcattttaaaataattcatttagctacataagctacagtggctagtgaaagacgtggaagagccatgctggttcaaatctgttgttcatttacatcagtattctatcaatggacatagaagttcactacaacttcgaatttagagtttccacattttagccaaaatgatcctaaataggatttctaaatagaaagtccccagcaaccttctctcaataacgttctgctttcccaaaacctcaggccagtcacacagtgttcaggcatgtttaattttttttagctttctcacctgcatttttctacttgttaccttgtttacctggaatttctttcacacgtcctgcagcagactgacattctttgctggactgacttttacttaactttttgttttttcatttcatttaatcatttatttattttttaaagacagggtggcccagctgctcagtggcatgatcacagctcactgtaaactcaaactccggtactcaagcagtccttctgcctcagccttctgattaggtgggacatacaggcgggctccaccatgtgtggctagtttttttttatttatagtacagacagagcctcactatgttgcccaggctggttgattatttatttattatttatttatttattttttgagatagagtcttgctctgttgcccaggctggagtgcagtggcaagatctccgctcactgcagcctccgcctcctgggttcaagcaattctgctgcctcagcctccagagtagctgcgactacaggtgcgtgccaccatgcctggctaattttttgtatttttaatagagatgaggtttcaccatgttagccaggatggtctcaatctcctgaccttgtgatctgcccgcatcagcctcccaaagtgctgggattacaggtgtgagacaccatgcctggcctggttacttatctttaaagctaaagtttaagcatcactccctctgtcaagactttactgcatttcctatactaggctgatgtccattctaagtacaatcctgtgctctctagttacactgtatcataataatacattttactgtctcctcattatgactgtaacttatttaaagaaaaatgcaaagtctgcattgccatacattttatctccagcacttagcagtatctggagtataatatacactcagtaaatatttgtcaaaactatgagttatctgttaatttatgtaaaacatttaaatatgcatttatactctgaggttgtagatgcttactgggtagtgagatacccaagttcagtcctcaataagtgacatagtacagaatttcctaataactctaaaactacctggtttgtgcttcaatgagtatctattcatcctagtcttctgtgatttaatgaacatgtgtaccctcaatcaagcacttcttttagtgcatttataaactcataggatctgcaaaagctgtaagagagtatattagtgatgtaagggtaaggagaatttattaaatatgatatattatgtaatgtatcaaaaatattgggaattattacattaaaattgggaaggtattatagtgatttgtatttaaacctaatattttaaaattcatactactttttaaaaataaaatctgatttacttgcaaagaaaatgggatgaattcaatagattactagaaaataataactgtactacttgattacagcaataagaaaagagttacaaaaacaatgcacataaaatttaggttgaatttatcattattatacatatctaattcagggtatatccatacatagcgactgaaaaatagtataagtctgtctagctatatcagtctatacatctctatatataattataaaatgacctggcacactgttggtgggaataaatattagtacagacattacaggaaacaatatggaggttccacaaaaaaatttaaaacagaactaccacatgtgccaacaatcctaccactgggtatatgtgcaaaagaattgaagtcagaatcttgaagagatatcttcaatcttgtatttctgcagcattactcacaatggacaagatacggaatcaacctaagtgtccatcatctgatgaatggataaagaaaatatagtatacatacacaatgaaacactattcagccataaaaaaaacaagggaattctgtcatatacaacaaaatggatgaacctggagggcattatgttaagtgcaattaagtcaggcacagaaagacatatcacatgatctcacatgtggaatctgaaaaaactgaactcaggagtagaaagtagaagggtagttaccagggtgtaagagagaaggattaagaaaatgttggttaaagggcacaaaatttcagttacacaaaagaagtaaattcattgtacaacatggtaactatagttattaacaacatattgcgctcttgaaaattgctaagagggttttaagtgttctcaccataaaaaatattagagataatatattaattaactttatttagttcttccaaaatgtatacaaatttcaaaacatcatgttgtacatgataaatatgtacaatttttatttgtcaattaaaaaataataaatcagagtaaaaaaaaaatatgcccatataccttcaattatccaagtactccaagtgaaatgtatttgacttaagcaacaattatttaaatttcactcttcaatttacatagttgtatgtattcctaaactaaactgcaatttgtgaagattttataaattcttattcgacattgaaatttattttaaggctacattaataaatattgaaagctctttcacgtgtttttaatacacataccaaaacctatgggtagatttattgtccatgtgcaatctaaactgctgggatagtttccaggaaacccaggactgaggatcacaccactgaagtctgacatagcaccaccacactgagctgcaaaataacagaaatccaaagtaaaccagagtagaggaataatttactgtattaaaaaacatattaaaatcatttcacgttttcaaggctctgagttaaaactgatataaatttgaatattgtctgttcactcactatacactaggaattaaatataatcaacaacagattttctaaaacagcataaaaagacaacatccttccttcctcagaaataagtggaaagtaaatcaattattgcataaaagtaacagatcatgtgcagtaaatataaacgaacaaagacatgtgctttgccacagcgggcactttatttctcttcctcaagtagtcctagaaatgttttgaatcatcccaaagacgatataatttagagtaaaatcaagccaaccacttcagctctaagtactgtattcaagaggaaatcattttcacagccttccctccttttccttttttttttttttttttttttttttttggagaaggagtctctctgtcacccaggctggagtgcagtggcgcaatctcggctcactgcaagctccgcctcccgggttcacgccactgtcctgcctcagccacccgagtagctgggactacaggcgcctgccaccacgcccggctaattttttgtatttttagtagagacgggggtttcattgtgttagccaggatggtcttgatctcctgacctcgtgatccgcccgcccaggcctcctatccttttcctctttttgtgagaaggctcaataaagatttgtaagcaaaatattggtttccattcatatgtgagaagttcacatattacacattagatatggccttattttatcctaaaagaatcaagacaaaaaatagagaagtaaaaataagtaaaaagatgcacacaaatttgagaatgtagggagttcgtaaatgtgcttgtcttggaatccctattatacggtttactatcaataaggtaagcaaaagctctaagaccagaaatttactcaagtttttaaatataattagatagaacccttgagcatatatgaaaggcaattgcattttagaaacctattcttgaccgtctaaagcacatttttatcattttattgttagatgaagaatcaaatttcatgactacaaatgaagttcaaaagttacctatacagaatacttatttgcaatcgcatccatttatttcgtgccaagagtagcaacacacagatactcaaatctcaggttatatattttaaaggcaaattcagtaggaattttaacaatgttttatacaatattcaataagtttgacaactatcttttgctatgtgaactaaataaattatgtgtcaatctgattttatataatcttggagtcaacctgcatataaacctttcatcaaacttgtgattataatcaagctctaaagatatacccatatgcttttttatgcttctgaaatctcgttaattcacccttaaaccaaatcaattttcaatgaagttagtatttaccaattcattttcctaaattcaattgttcacacatattcatcacaaaatctgataattaatgagttgtaaaaacaatagtttgctcaattaaaatatttttaaagtttatggcaatacatttgtaggtttgttttgctttattctgaaatttgagtaaaaggcaaggactatcttttattttcttgccttcacaatttcaagtctttgagctgctgattgtccttctaattctgttactttctatctctttagatatgaactggaattcctgtcctctgcattgatggccccacctttcagggtgaaaaataccaaaaccaaaagagaaaaagaaaacagaatagagtaaagagataacaacaacagaagaaaaacaatgacaaatcattagagacatatgaagaaggataccaaagaatgcatctgccttcagcaatttgttcatgtctatttcctcagtatctctgcaatctcaacactcctatgccttgaatatcaattttgtgtgtgtcatcagcagcttcatgtacactcttttgtgtcccattacactctttttgttagggacaaccataccttagtcttccaaaataaaatcaacttctgttttttcatcttagttgtctctaatatctaaaatctcacataaattttccttctttccatcaaaatatctggcagattgcttattttccagttcacgaggctgtagccttgttatctgatgactagtgttttaagacattcgctgaatcagcctcttgcttctagtttctccttacaatattgctattgtatcactgccaatattttaatactctgtcacatgtagtaccagcttattgttcaaaatttataaaatacaaaaaaaaagagtaaaaaggaatttaaaatgggtcaggtgcggtggttcatgcctgtaatctcagcacactggtataccgaggcaggcagatcacctgaggtcaggagttcgagaccagcatgaccaacatggtgaaaccccaactttactaaaaatacaaaattatataataaaacaatttttctaatttagtttataatataaatgtaaacttaatcaaaatgatactttatctactaaaaaagtaattttttaaaaaattgttttgttacattttatttctcttttgccctgtcttatggtgctgagaaaattgataattttttaagaataataattgatgtaagcaatatagcaagatgggaactgtcctgtaataatagagtggtatttaaattggtacaaccttctggagcaatttgataatatttatgaaaggttttaagcagttctattcagtgacataattaatctatttaagaaaaattataaacaagctattagagctgttttctaattatgatatgagatgtgttcataataaatataaaattatgaagtacataatgtgaaaaaataaatatgtaatttataatatcaaaagatgagaaataaacttttaacgaaaaagaagtaattgcacaaattagacaatgctatgtgtcaagaatcaaaattcaaattttgtttgtttcagttgtagtttttgacatttcaaattttgaaaacaatatggtatgagaaattcttacacgttaacatcaaaaagaaaaacattactatatatatatagtatcccaagcctttacattaatttgttcactaaacagtatataatggatgcctatttaagatgagaaacttttcaggcactagcaatatggtaatggatgaaagatctaaactctgtgctttcatattagcagaaaaaaacatatttattttactctttgtgctcttttatattctcaacttttatactcaattggatatacacataaacacacacacaccacacaatatatttacaatcaccattatctgcacatatgtaagtgttcagaattgcattacatgtatatatatgaggtaattttaaaattggtataatatgcatttacaaattaatcatagtaccttaaaaacttcccttaaaaaaatcatccaatttaaagtctgagtgttttcaatgtactttgccaattaaacacatcatcactcttaaacatttttcagtactcttcaaaaagaattgtgtgcattttacgcagatgttgtggacttaattatgtccccccaaaatttatattttgaagtcctaacccctaatgtgactgtatttggagatagggccttaatgaaggtacttaaggttaaatgaggtcataagaggagggtcttaatccaataggactggtgtcctttaagaagaggaagagacaccaggagcgtgggtgcacaaaccaaagatcatgcaagagataccatctacaagccaacaagagaggcccttagaagataccaatctgctagcaccttgttttgtaacttcaagcttccagaactctgagaaaataaatttctgttgtttaaactacccaatctggagtgttctgctatggaaacccaagcagaggaatgtaatacaggtacggtcattgtgcagagttaagtcacacaagtcatggactttttttttttttttttttgacttgggctctttctccaactcagaaagagatatcttcttcctccatgtgtcttaattagacttattatccaaaactctgtgaaaaccttgcaggctgaatatgtttgccaatactttagtcaaccccagtctcacttttctgaaattccatcatgtagttaatgataaaatttaactctaaattatttgataacaaattcatttattttatttctagtactccaaatagtaattgaatgttttaaaggtagggatcatacctcacattactttctcttactctttacagcccagtatattaatagttgcacacaaatacaaaaaaaaatgaggaagagaaaaaaaagcatgaatagaagtaatttggaagcagcattgagttaaagcaaaaatgtgcacctgtactttcaaagtacccaagtttccttttaatatattccatatcttgactgcctgacaccactaaagacatctcatgaggtgtcatactccttttgctagacactttagattctttatctattcccgctcaatagtaagcaatagaatatttacttatttttctgttcaatagatatactgagaaaactctctaagaatttttttaagtcttttcttaatttctacagcttaagtcatccactgatactgaagttgaggataaataaaaataaaaattttaaattaaaaaaaagaagatgtgaaatattttcctcaaaaagtcatttccataagatctggtaaaaggcaaactatatgtttgaaaatcatgatatacagaatgaaactttaaaatctgatgaagcttacaaatactttatagtctttttttttacactttaagttctagggtaaatactttatagtcttttaacttacctaaacaaattgggattggataattccatcttcttacaggtcctggcatacatgtaatgtgagagtgaccctacataaacaaaatgatgtggttcagtacacatacataaaaagtttaaatttattgtagcatagtcaattattattataaaaacaagcttaagtacatggctttatttttatacacatatttacttatatgaaaatcttagcatgattaaagtaagaaaggtgattatatacacctatgataaaatgtaagaaatagctacatgatagtggtagaaaaaataatacttcatatcatattagaattgcggttttaatattttcctataacaatatgttttactaagatattgcagtgattatataagtgaaagggcagtatacatggtggtttataataaattgctataacacacaaggtgaagtaggttaaagaataattttaaaattttttcacaaaaatattaaaacaagtcaaagtatattaacttttatattgaaatataaagtcctgaaagatctgtttgcacttctgagatttataattttgtgatacaactttaaagactataaattattaatttttaattttgctttctctgaagaatttatttatctaatatgtgaaacagtattttccttaactttttatcttaatgagtttattctttaaggaaatttttatgttactataaacctgggaccctcgacaaaaaaaatcaaaaaagatcaatataaatacataaaatcagaatatacattgcaaatccagttccttagcaaaatatacttgtagtaaattttcactaatttgggaaatgtattgttatggaagtttcattcagtgttttaagtggcatttccctttattttcaaattctaaaaatccaggaattcagttgtcacaatcctatgtgaatagagacaaaagtaaagattaatttttactttaaaagactttaatctaattaattaaaatcaaggagaaaggacttccctaactttcctaattttgactcaaaatcagttttgtttacttccaaacaaaacaaatttagtcaattccagcaatatttctcatgtgcatattttattatcaaattgagcacccttttgacctcagacacaaaccaggatcaatgttgtaaaacccgtggcttatcaatcattgatttgtaaaatattctgaaagggccatgaaaatcaaaaccacaactttaaaatagacttacctgaagagaatatccttgatcacactgaaaggatactacatctccaaccatatatctgtctccaattttaattccactgctaggagtttgtggttcaggacaggaatccaaaccaattgctaagaatatttaatgataacaatttaagtaactttcaagtgataaatgcttaagttatgcatattaagttgctaaaattgaatatcagtgtctcatcaaactagatactatattgagacgttgagaacgttctgtgaacaagatttaactgtagatgtcaagaataatgcacatttgaacatcattataaagctatacaattttaatttttatggcaccagtcattaagctagctgtgtgaatatacctaaattgtgttttaactccaggcttaattgttttctactgtgaaacaaaagtaaaaatttctgaaaagaaaattcctacatgaaaattaaaaataatttattatgataatagaaataaataatactttaaaaacattcttagcaaaaacttaaaaattatttgctattttgtcttccttgcttaactctttcttcttttattctgaatcggcttttaaatttatgaggtacattttgatgtacttcttattatatgtaaaatttttaaaatatagttgtaagtagaacttttctttctctgaagatactataatcaaaaaggagaggccaagtgcggtggttcatgcctgtaatcccagcactttggggggctgaggtgggtggatcacctgtggtcaggagtttgagaccagcctggccaccgtggtcaaaccccgtctctactaaaaatacaaaaattatccaggtgtggtggcaggtgctgtaatcccagctacttgggaggctaaggcaggagaattgcttgaacccaggaggcggaggttgcagtgagctgagatcttgccattgcaatccagcctgggtgacagagcgagacttcatctcaaaaaaaaggaaagaaaggagaaaaactggtgtctcattgagacctgaaaagtattatgtgctacttgaattcagtatttttctgataaggagataacaatgtaattcaaaacactttcattatttttattaggtaagaacttattttttatctagagcaaaggaaaaagttcctggaaacatgcaacctcccaagatagaattttttatctagagtcaatgaataaatccttgcaaacacacaacctcccaagatagtatcagtgagaaactgaaaccctgaacagaccactgagttctaaaataaaatcagtaagaaaaaaacctaccaagaataaaaacaaagccccagaccagatggatttatggctgaattctacaaaacatacaaagctgataccaatttaccaaaacttacaaaaattcaatgagaagggactttcctaactcgttctacaaaggccaccattaacctaataccaaaacacggcaaagacacaacaaaaaaagaaaaatacaggacaatatttctgatgaacacagttcgtaaaatcctcagcaaaatactatcaaaccaactccagtagcatatcaaaaagttaattcaccatgatcaaacaggattcttcctgggatgcaaggttgtttcaacatatgcaaattaatacatgtgattcaccatgtaaatagaattaaaaataaaagccatatgatcatttcaatagatgcagaaaaagctttcaataaaatccaacatcacttaatgataaaaaccctaaagaaactatgcattaaagtaacacatttcaaaataataagatccatatatgacaaacccacagacaatataatactgagtgggcaaaagctgggataattcatgttgagaagaggaacaagaaaaggatgttcactctcaccacttgtactcaacataattctggaagtcctagccagagcaatcaggcaatagaaataaataaaaggtatccaaaaaggaaaaaacaataagtcaaattatctctcttcactgacaacatgattttatacttggaagaccataaagaatctgccaaaaggctcatagaactgataaacaacttcaataaagtgtcaggatatttaatcaatgcacaaaaattagtagcatttatatacaccaacaacatccaggctgacagtcaaattaagaatgcaaccccatttacaataactgcaaaacaaataaaacatgtagcaatacatcttattaaggaggtaaaagatctttacatggagaactacaaaacacttctgaaagaaatcatagatgacaaaaacaatgggaaaacattccatgctcatgaattggaagaatcaatattgttaaaatgaccatatttcccaaaccaatctacagattcaatgctatttccatcaaactaccaacgtcatttttcacagaactaagaaaaaaactgtgctaaaattcatatggaactgaagtaaagcccaaatagccaaagtaatcctaaaccaaaaaaagaacaaagctacagtcatcacatagcctacttcaaactatactacaaggctatggtaaccaaaacagcatggtactggtacagaaacagacacaacgatggatggagtggaatagagaactaagaaataaatccacacatccacaactacttgattttcatcaaagttgacagaaacaagccatggggaaagaactctatttaataaatggtgctaggataactggctagccatatgcagaagaatgaaaatagacacctatctctcacatttacaaaaactaactcttgatggattagatatttaaatgtaagacatcaaatttcaggaattctagaagaatatctaggaaatgccactctggacattggccttggcaatgaatttatgacaacatcctcaaaagcaattgcaacaaaaacaaaaattgacaagtaagacctaattaaactacagagtttctgcacagcaaaagaaactgttaaaggagtagcaaacaacctacagaatgggagaaaatgttcataatgggagaaaatgttcgtaagctatgcatctgacaaagctctaatatccagaatgtataaggaacttaagtcaacaagcaaaacacaaattccccattaaaaagtgggcaaggccgtgcgtggtggctcatgcctgtaatcccagaactttggaagtctgaggcaggtgcatcacgaggttaggagattgagaccatcctggctaacacggtgaaaccccgtctctactaaaaatataaaaaattagccaggcgtggtggcaggtgcctgtagtcccagctactcgggaggctgaggcaggagaacggcatgaacccaggaggcggagcttgcagtgagcagagattgtgccactgcactccagcctgggcgacagagctggagtctgtcaaaaaaaataaatagataaaaaataaaaaaataaaaagtggacaaaagtcatgaatagacacttctcagaagacacatgaatgaccaacaaacatgaacaaatgctcaatatcagtaatcaccaaagaaatgcaaatcaaaaccacagtaagataccgtcccacactagtcacaatggctatgatgtaaaagtcagagaaaaacagatggtggcaaggctgcagagaaaaaggaatgcttttacactgttggtgggaatgtaaattagttcagccactgtggaaaacagtttggagatttctcaaggaacttagaactaccatttaacccagcaatctcattactgggtgtagaatcaaaggaaaaaaaatcattctaccaaaagacacatgcactcgtatgtttatcacagcactattcacagtagcaaagacatgaaatcaacctaggtgcccatcattaaataatatgcagccattaaataatatgcagccataaaaatacagtgaaatcatgtcctttgcaggaatgtggatacagctggaggccattatctgaggagaattaatgcaggcataaaaaaccaaataccacatattgtcacttataagtgggagctaaatattaagtagacatgtggatgaagattgaaacaacagacactgggggttacttggtaggggaaagaaagaggagggcaagggttgaaaatctatgagtactgattcggtttggctgtgtcccctccatattccacttcccatgtgtctcctcccacaacacgtgggaattctcatcttgaattcccacgtgttgtgggaggaacctggtgggaggtaactgaatcatgggtgaaagtctcttccatgctgttttcatgacagtgaataagtttcatgagtactgatggttttaaaaagaggagttcccctgcacgagctctctctctttgactgctgtcacccatgtaagacaggacttgctcttccttgccttccaccatgattatgaggcttcaccagccctgtggaactgcaagtccaattaaacctctttcttttgtaaattgcccagtctcaggtatgtctttatcagcagcatgaaaactgactaatatcgtaaattggtaccagtagagtggggtgttactgaaaagatactcaaaaatgtggcagccactttggaactggataactgacagaagttggaacagtttggagggctcagaagaagacaggaaaagatgggaaagtttggaacttcctagagacttgttgcatggctttgacaaaaatgctgatagtgatatgaagggtaagttccagtctgaggtggtctcagacagagatgaggaacttgttgggaactgaagcaaaggtgactcttgttatgttttagcaaagagactggcagcattttgcccctgccctagagatttgtggaactttgaacttgagagagatgatttaggttatctggaggaagacatttctaaggggcaaagcattcaagacatgaattgggtgctgttaaaagcattcagttttataagggaagcagagtataaaagtttgaaaaatgtgcagtctgacaatgtgatagaaaagaaaatcccattttctgaggagaaattcaagccagctgcataaatttgcataagcaatgaggagtcgaatgttaatccccaagacaatggggaaaatgtttccagggcatgtcagaggtcttcatggcagcccctcccatcacaggcctagaggcctaggaggaaaaagtggtttcatgggccaggcccagggtccccatgctgtgtgcagcctagggacttgatgaccttcatcccagcctcaagccttggcagcttccacgtggtgttgagcctgagagtacacagaagtcaagaattgaggtttgggaacctctgcctagatttcagaagatgtatagaaatgcctggatttccaggtagaagtttgctgcagaggcagggctctcatggagaacatctgatagggtagtgtggaagggaaatgtggggttagagcccctacacagagtccctactggggcactgcctagtggagctatgaaaagaaggccaccatcctccagaccccagaatggttgatccactgacagcttgaatcatgcacctacaaaagctgcagacactcaatgttagcagacaggagtgaggctgtaccctgcagagccacgagggtggagcttcctaagagggaacctacctcttacatcaggatgacctggatgtgagacatggagtcaaaggagatcattttggcactttaagatatgactgccccatttgattttgaacttgcatggggcctgtagcacctttgttttggccaatttctcccattttgaatggctgtatttacccaatgcctgtacccccactgtatctcggaagtaaactgcttttgattttactggctcatagatggaagggacttgccttgtcttgaattagactttggactgtgaactactgagttaatgctgaaattagttaagacttttggggactgttgggaaggcatgattggttttgaaatgtgaagatgtgggatttgggagaggccgggggtggaatgatatggtttggctgtgtccccacccacatctcatcttgaattcccatgtattgtgggaggaacccagtggcaggtaattgaatcatggagcaagtctttcccatgctgttcttgtgacagtgaataagtctcacaagatctgacggtctttaaaagaggaattcccctgcacaagttccctctctttgcctgctatcatctatgtaagacgtgacttgctgtactttgccttctgccatgattgtgaggcttcaccagccctgtggaactgtaagtccagttaaacctcttactttgtaaattgcccagtctctggtatgtctttatcagaagcatgaaaccagactaatacaattgctatgctgactaccgaggtgatgagattattcataccccaaacctcagcatcatgcagtaaacctatgtaataaacatacccacatatcccctaaatctaaaataaaagttaaaattatgtttttttaaaaaagagtttatttttcaaaataaactaaaaacatagtaaaagtaaatggttttctgaaaatgattcattgaaagccttaacaaaatgtttgcttttttgccaaaacatttttcaaatatgcaactattattattaaaaacttttcatcttcattaaaagccattgtttattattcattttgttgtaattacattttcaggctaatctaatgcatatttaaatgggttagaaaaagaggtcaccactccagcagcattatactgtatacatacggatttcatttttaaaaagcattgaaaactaaaccctaaagaatgataatgctttatatgtattccttcattcctgtgccagattatttctctctgatagatattcttgtagcaccaccctctacattctttttggatacttaacacaatctgataatatataaataattgtgcaattaattgttcaatatttatctcccatctgagaatgaaagctccagaagggccgttagagaacagtgtcttgaggaggcactcagtaaacattacttgtgtgaatgaatgaataatataagaaagagagtgtatccctatatctagattatttcttaataaatattaatgcctaattatgcaaaggaaagctatctaataacacaatggttagagtagcttaaatcatgccaaactggatgacatttaacaatagaaaatgccataaaagcagtgacttgatagagttatgattagattagaaagtcaggcagtaaagatcaggagtaaagtggtcatttgggaatacatttgaggcagtcttgaattagataaggagagtctgtacattgcaatcccaatgcccagtgccttaattagttaggtctccaagcatgcatcatgttctattcctttttgtagtattgaatttatggacctaggaaaacttggttactattaaattgtgacctaattttaaatgtttaagggtttacaactttcttctccaactagattttggaatctaagaagagatagaaattgccttccctgtgtattaatcttacttaatacccgttgataagcctcacacatcaaattcatctgatttcatagagtcttcatcagaaactaccgaatacaaaaatagtgaactatgatataaacatgtatgctttgtctatacaatttcaccttcctttggtacaattttagtttcttgggagtcctgaacagtaaatttattactcttcaccagtaaggacattcttgcaatcattctcactgagaaggccaaattttgtacacattcatttctcttcctttctaatcaaatactctattcagggtcatatatataaaaaactatcaaaatccagtagcgacagtttccttctccaagaggagaataaataaaactatgttagtgaggtagctgaatactgagatgctcatttttaaacaagattttacataatatacataaacaaaataaaatgtttgtgaaggtgttttaactttttaaaaaatgacacaaaactctataaactaggtaaaagcaattttgtaagttaaaacaaattcttatatgtatataatcacagagataaataaccaaatgtaaatatgccaaatggtggttgtaattcttgattataagattactggtgatttgtatgtcattccttgtattttcctgcatctccagagtttctataataacataaattatttttgtatataataaaataacttataacctagatgaattagtactagcagaaaatttagaagtacaggaacatattcccttcaatttttctagatgatattgaattgggctagctaagttcatttgaagagatcaatcagcaactgatttgtgttagggaagaaaataatgatataatcagataagtcatatgctgatggcttcattcatttttttgcagcagtttctttttcatgtgcagtaaagaaaatgaaacaaaaatacatgaaagtcctacagtttgaattttgcagccattttttaaatttacacaaataaatctccaagtggttaaatattaactctaaaatatctttgggaattatttttcacctctttataagtgacaaaatcaataagttatttgtaggaatcaataagagaatttttttgtagaaatgtggaaaaggcttctcttctgcttaaccaaggctagtttcctgcttaacaaaagacatcaaaacattgagtcattttaaggttcatgagtataaattttgtaaaattatgccgttggcaaccaaagctgctctctgattaaatattttttaatgggattggatcaattaatctgctgttgtagccaaaaaaaagaaaaatcagaaatgaatccagggaccaatccatacaaaaaattgcacacagttatgtctgtctgctgtcaaatgattgcaggcagttaccctggctgaaaatattaaatccttactgcttcacattactaatatttatttataatcaaaacgtattatttccaattctgttcacaaagcaatcaatcaatctgtatcagaaatgttgttaatcatatcatatatagttggtaattctgaatgtgtgtgtgtaaataaaagtgtgtatgtatatatatacacatacatatatatatatatatatatatatatatatatatatatatatatatatgtcctagtattccaaattgatttcaaatgagtgattaacgcattgagatacgaagacatggaggggaaaatgtttaattactgctaagacacccagtaacattgttttgttaaaggaaaaactcattcataaatttgacatgacaacctatgtatctatttattgaaaatgcagaccaaaaatattggttttgcatttatgtgagaaagaaacaaaagttaaatcatgtgtctttgcactaaaggtggtatttagtgatagtaaagatctttttattccaaatatgttgcatgtctttgattttcatcttttctctaaattgtggatacaagacaactattatgtttatgttgatactacctttaagggttttaaaaagatataccaaaattatcatttcacattccacatctatcattataaagataagagttcaagaataatgtagacatttgtggtaatcaaacggtgaacccaatatgagttggtgtactattaatagtttgaagacttgtagaaaactgctttggtaaacatgcagatatttttctggcttaaggtacctcagaatcaattgattaatctactaaacaaatattttgtcaaatacctaatcatgtaacaagtaacttcatgaatgtttgtggataaacttttttggaagcaataattctgactatcatcactgatgggcagcaatgctttgggaacatgtagcacaggctacattaacatttaccttgatccttaatactttatttactttatctgtgcttactgtaactgatatttaacttagaattactctgtataagtaaatgaatactcagtaatacacactacttatcaaattttagtctatagaataatactaagttaaatgaacaaaaagttaaatagaatcacgacgtgtaggtattattcattcattcaataagctgttggtgagtacctattgcgtgctctgtatcatgttacattccagaaatgcagagatcaatcagcaacataagcaaccatgctctaaagagactcttgacggaacaggagaggagtttgatttgacagatgatgattagagcgcggtggaacaattgcaataaatgaaggtcatcctttgtttaattagataattgctccatagaagtaacccatatgagtactgaaaaattatatattttaccaattcattatcctgaggggtagttgtgtatggtgttctgacacagaaagtaacatattaaacgaatggagttcttagagatttttctttcttttttggaaaggagggaagtgtttttctcaaaaacacattgtagtgttctgtggaaggcagcaagaaatgaagctgaaatggaaggcagaatatagactgtgaacagtcctgaaatcttaaccaacacaggtatttgaactttctgtgtttaatgcagggagaattcagagttaagaccacaaccttttgtgtgcatcctggctcctctagttgcatgctggttggtttgttttaaagtctgagatgttttctatgcctcagtttcctcacctataaaatgggatgagtaaatagtgacttcacagtcatattatgatacttaaagaagtgcatgcataatacttagagtagtgccaggaatattggaagtgcctaacaaatgttaactattgttgaagtgtttcaggcactgaagtgaggatgtccatttgtattttagataaaaagtatacttttcttcttgtcacgaagggtatatttctgtttaagatcaagagatttcacatgtgtgctctagtagtattaatacaaaaaatatataaatatttatataaagcaccacaaatttaagcatcctgagtctttcaactgactcaacatgagaggcttcttctatatgcagctaaaagattattaccttcactgcaagaaaaccctgggtaccaggaccagtgtccctagctcatgatataactagagaaatgtatgaagacaaaaacacaatgtttacaaaattcagaaacctagattaggctaaaactatctctacgtcatcatcacaaaggggtgaaaaatcagtgagataatcaggaaataaaatatgatggaaataaaaggaagcaaactgtgataaatctgtaagggctttatagggttaagaagtgcaatgtgtttataaagatcaattacacttatttgcatgcaatgtattctgagttaatggcaattgaaattagaaatgacaaatactaataatttaatttgggcaggaggtatttctacaattaatatttattacatttatgaatgttgatgtgcataaactagttaaaacaagaaaattagtgtaagtaaaaatacagttaatcttaaaatccctgtttttcccaaataatcaattatataattagctcaagggagaagaccatttttagtgattataaaagtaaactcattaagaactaatgcattatctcttaagcatattgctcgaggatgggaagcagtaaaaataataacagttatgctgaattgaatcttttgctatttataagatagagtcaaatggatacatttctgggcatttattattttgagactaattttatgctttttacaactactacaagggatagaaagatgctttcagatattccagtttttcctaggattttactgaaaattataatcatgagtgctcttaggtgtaggggaagagaaaatctattcattatggtaacatgtacctttgccttcctcagggactacgtcctgagatttttgaagacctctaaagatcttcaaaggaccttgaaactaccattacttcatgcagccttctcttttaaaaacatgtatattttataagttcaaaatgtaattctgctcattgatttacatatgctgcaaggtccctctaggatttgccattagtgagattttaacatgtgtctctacaaatttaaagaaatgagatggaaaggacatattcatattacaatcaggcaaagagtctaatccaagactattaatgctgaggcttcactaaaatccaagtggcaggacaactggaaagtacaagttctcttagtggaagcctaccaacaatcaatatatttaatgatattccatgagctaggatcattttccctagcaataaaaatgattatgcatgatataaaattacaaacaggagcaaatatatttgaaaaaacaaacacaccagaaagcaaaaattgtcagtttaagaattgattcccatattccagtgctaatgtggatcaggaaaaagaaaacttgaatacttcatgtgagaaaaatttggggtaaattctatgaattcagcacagctacatttgttcacaagactatgtaaccaatatatgttcctaatacaagtaatgatgtagctttatttggatttatgatagcctatatcataaaataccaaaatagtaatcagcctccactaaataatgtttaaacttctctctaatgaatagagagaaatgtgtccaccaatatctggtatgtttgccttaattttcctatgtctcccaaagttgccaagcaaatagattttcttgaattctgcctgcctccttcctcttcaatattcaatcccctttgttattaacagaaagcaaaattggctctttttctcaacctttccattaatatttgaaacttatttatatgttaggtaatttttgttagcacaaaatcagtagaagacatcaaagtttaagaaaaaacaattagggtgaagacacaaattgagaaatttatacaaggagacttcaaaaagtttgtaaaaatgtatattatgaaaaaaaattacgcatagatttccttttttttttttttttttttttttaccaaatggacttctaccatcttcttataacatgtttgaatagaatctactttcatgcaccaagaaggataaaatactagtttgaaaaaattcccctatcagagcaacatgaattctgcaaaaattacatgaagaacaaacatcaaacttatggtgaggtttgggtggaagaatggtgaaattcattgatgctttacaaaaagtgtatgggaacaacgcacccaaacaatcaggagtttacaaatggataactcattttaagaaggaatgagagaagaagatgaagcctgcaaaagcacaccattcacatcaatttgtgaggaaaaatatcatctcgtttgtgctctaattgaagaggatcaatgtttaacagaagaaacaatagctaattgcctagacatctcaactgattcagcttacacaattccactcaagggatgccaaaacttttgtgcccagatcagctgcagacgagaacaaagctttcaatttcaatggaaattttaaacaagtaggatcaagaccctgaagcatttctttgaagaactataacaggagatgaaacatggctttaccagtacaatcctgaagacaaagcacaaccaaagcaatggctaccaaaaggtggaagtggttcagtcaaagcaaaaacagactggtcaagagcaaaggtcatggcaacagttttttgggaagttcaaggcattctgctggttgactttctggagaaaccaaggaaaatactgcttattataagagggttttgagacagttaaccaaagcttttgcaggaaagcttcaccagagagtcctttctactgcaacaatgctcctgctcattcctctcatcaaacaagggtaaatttgaaagtttcagtgggaaatcattaggcattcatggttttttgttttgtgttgttttgaaatggagttttgctcttgtcactcaggctggagtgcaatggcacaatctcggcgcactgcaacctctgcctcccgggttcaagggattctcttgcctcagcctcctgagtagttgggattacaagtgcatgacagtatgcctggctaatttttgtatttttggtagagatagggtttcaccatgttggccaggttcgtctcaacctcctgacctcaggtgatttgcccgccttggcctcccaaagtgctgggattacaggtgtgagccaccacacccagccaggcattcaccttatagtcctgatttggctccttttgacttccttttcttttgtaatcttaaaaaactctttacagggcactcatttttcttaagttaataatgtaaaaaagatggcattgacatggttaaattcccaggaccctccttagagatggacaaaatggctggtatcattgcttacaaaagtgtcttgaacttgatagagctttgttgagaaatagagttcatatttttaaatttatattttaattccatttttaattccctttttatatacattcaatttttctataattcaatttttctctaaaccttttgtagtcccttcatatttattaccttgctttgtatgtctgtaacttagaaaaactgcaccaattcaatttatttgtggcatatctataacctccaaaatagtatagtttgagcagcatgactataaatatttaaaatatatgtatataataaatgtgctatcacattacaattttttcttactttacaagtagcactatattcaccgtccatacaagttttactctttgaagaatacatctatcttgtcattatcattagaaattaggaaatacttttggttcctagattccacagaaacatatgagatccaattactacagttaaataaaagcacttatgctgaccttgatataattaaatcaatacctagatgctgaaaacaaaaaagtctagggagttgaaaggccagctctccaattaattaaagcaaaactgttatcatgtaagaagtgatattatctaaagtgaaaaacaaaacagaagaccagaaacctgagaatcatcctctactcctttttctctctcatccccaacatctaattggccataaagcttttcaattatatcttattaatatctcttgaatctgctgccatttcatctacacaaccacaactactgccttcagagtttcccttgtgaaccaatgcaacagcctcctcttaaatttctttccttgggcttattctcaccatgtaatgcatacttcactttccaaaataaaaagtcctctttaaaattcaaaacttttgttactctaaaaatccaagtccttcaatgaggctactctttctccaagaaaaaagcctatgccacattttaaatctataccatttgactactccagctatgtgggtttatctcatcagctataaagggtagcatttattaagggtttactatataactggcactgcaataagcactttatttatttaattataaagcaatctttcaaattagaactatgtattatgggtgagataacttggtttttagggaacctcaaaaattttctgagtgtcacatggccatcaaatggcagcgtcaagatagaaacctgagtctgactccagagtaaatgctcttatatctatctgcattccaggaggtcccttcaaatgccaagccattctcatatctatctttaaattcttatttgccagaaggaattcttttgacttttgatgaggttttccctgactctaccaccagtaacccctaatacaaatgatctccaccttctctgttcatcacctaaattatacaagatattttcatactttggccattgtgagagtcactttgggaccttggtaaaaatgcaaatacttgagtgaatctcagataaactgacttgacattctgggttggtagccttgtcatctggagtttctaaaagacttcaagatgattgcaatgcacaattatctgagaagtactaacttacataaacatattaatagtgcttacaccattttgcaattgctctacttgtttacatgtccttactcttaattagtctaaaaatattttaaggctagatgttacacaaatttgcagcacctacacctagaaaatgtaccttgcatttaacaagtactcaataaatacttgatgaataaatgaatgggtttgttctcagatttgaaaagcaatatgaagatgaaaaattatgggaggaggttataagtagggatataatacaggagttaggactaattgctttggaataaaattatctgaggtctactctacaacttactaacttaaaagtacctaagctctgagattattttctataattttccatttgtaaaatagggttaaaaatgtatctgcctcacagtaatttaaaaaaataaaacaaaaatacctctatgaaacatttagcaatgtgcttgacatatactgagtacttgaaaatgttagctttttaaacatataatgataatagcataatgttgtataaccttctttattataattataataatgacagtggaggtatcattagctagtttcgaagaatctaagcagtcattcaaatgcttacagttcataatactctggtacaaatggctatttacaatgtggatctaccacactttgaaagtagtcatagacaagtcaatgtgagcctcaaatattggttcttttcatattattaaatagttttctttgcttttattattttaaaaggaaaaatatatgaaaacatttaacgcagctatatagaaaactttatttaaaaatataaacttttagatttgtttaatgcttgaaaggaataaaaaatttacaaaaacccaaaagcaagatttttcttactctaaaaaatataatttttgaaatttagttccccttctttaataagcaattaacaaaagaacatattacaaactagcacatttggtgcaagtagcttgttagaagtcaggtatttggtgaccatcaataatagactggataaagaaaatgtaacacatatacaccatggaatactatgtagtcataaaaaagaatgagttcatgtcatttgcagggacatggatgaagctggaaaccatcatcctcagcaaactaacacaggaacagacaacaaaaccccacatgttctcactcataggtgggagctgaacagtgagaacacatggacacagggaggggaacatcacataccagggcctgttgggagttggggtgcaagggcagggagagcattaggacaaatacctaatgcatgcggggcttaaaacctggattacagtttgataggtgcagcaaaccaccatagcacatgtatacctatgtaacaaacctgcacgttctgcacatgtatcccagaacttaaagtaaaagaaaaactaaaaataaataaaaattaaataaataaatcacaatttgctattgcaagaagaagaagaagagggggaggaggaggaggaagaagaagaagaagagaaagaggaagaggaagaagaagaggaagaggaagaagaagaggaagaagaagaagaagaagaagaagaagaagaagaagaagaagaagaagaagaagaagaagtagtagtagtagtagtagtcaggtatttgtatactcagtgataatagccaaggcatagcccatagtcatacaaagtgatcatcttcatcagataaacataatcattgttttgttttgtttttcacttttccagcaaatattcattgaggacataaaaacagcaaaacatcatcttgtgtcttattggaaataaataatgtgcaacacactacccaaaagtagtttaatattcatgcacagagataattcaagaatgctaattacaattattacctaagcattagaactgcagaacatggtaataccttgtaaatcagagcatgtcattcctctgctcaaatctccctaatgatttccatttcaattagaggaaaaataaagtccttacaatggcttataagccccacttacttttcctctctcatttaatttcctactacctcacttttttgttcttcatacttctgtttcgtggtattggctctagctgttccctaaagcagtatcttcacttaccagtaaggtttattcctgcaccaccttccactacttgctcaaatgtcacagtctccataaggtctgccctgaccaccataacatccttctttttatccctagcactcctgatccctcaactctccatctatttttttctatgacacatcattttctaaaatgttatatagattactcctttattatattttcaccttttatctgtcttcacctgatagaatgtaaaatccaagggggcaaaagtatattgcctctttggttgactaatgggaacaatgcctgacacacagagttcagtaaatatttgttgaatgaatgaagatataggcattgagacaggtaaaaaggaaatgataccagaattcagagaaggaagagaccacttctgggctgggttgatttgatcaatgaagttaaaatttagggtagaaaaggagcaaggatggagaagatgctcagaaaacatgcagctgcccagatttcccctggcctcctactggggatctcactgctgttctccagcccatgagaggaagtgggcagaggtgagggcctagcccacatggatatggggcacacgctgctgggcagagaaatggctgcacatatactgctcctctgaagcaagactccttgctggtctccttctctttttctccttaaaatattgttagaatgcagagatcattgatttcctttgaaacaattcccatacagaatacgacatctcaaacagttcctcagcccttggcaatatttgtgtgcaggtgtttcatgagaagcagcacataaggtcctgagaaccaatgagtactggggagtggcacaaggagcttgtggcacctagcactgtggcatcccctacactccaggaattacactccctcctaaatgtctcccccatctccttgctaacctgacttccagcccccagtcttaagtaaaataggaattatgttttctctcttactacatctgtgaggtgtaagataaaaacaaatgacaaaggatgggcacagtgggtcacacgtgtaatcccaggactttgggaggccgaggcgggcgtattacgaggtcaggagttcgagaacagcctgacctacatggtgaaaccctgtctctactaaaaatacaaaaattagccgggcatggtggtgcatgcctgtaatcccagctactcaggaggctgaggcaggagaatcacttgaacccgggaggtggtggttgcagtgagctgagatcacgcaccattgcactccagcctgagcgacagagtgagactctgtctcaaaaaaaaaccaaaaaaacaaaaaacaaaacaaaacaaaaatacacacacactcacaaatgacagttccaaagacaaattaatctgcagtgaacaaggtggaagaaaggaagaatgaagactacttgataacaaaatacaaaaacaaacacaggctaaaacaaaaaacatgaacactgatgggataaaaaagttcacaaataaaaataatccatacacacacacatatgcacacacacacaattcagagttgagtcttatagccagaaaaaagaagagaagtagagcatgtcaagtggaggaaatgaatcgtgaaaggagtagagagaggaaaggcatgttacattttaaaacaaatgcttaatttgattaagtgggggaatattacaaaattcatgtgtgaaaaatgaaacattaagaaatcagtgttggaataagaggctaaagaatgttgcctttatttagtagataggaaggtaatgatatgaaatgaccaaatatctggaaatattaataagaccaaggtgtagaaagggttgagtggaaggaacattaggtttatctgatataattgatagtgataatagtattatgaaagatcaggcattctaaagttaaaatgccattatctcaggttcaacaaagaaaagataactataatgataaaaatcagcctatctggcgggcgcggtggctcatgcctgtaatcttagcactttgggaggccgaggagggcggattgcctgagcacaggagttcgagaccagagtgggcaacatggtgaaaccctgtctctagtaaaatacaaaaaattagctgggcatggcagtgtgacatgtagtcccagctactcaggaggctgaggcaggagaattgcttgaccctgagaggcggagcttgcagtgagccgagatagtgccattgcactccagcctgggtgacagagcgagactatgtctccaaaaatagaaaaaaaaagataaataaataaataaaaataaatcagcctatccgccagcatttaccttttaggtaaataaaaagcagggcatgtctgtgtagtaactctgccagcagaaaaaatatatatatatatatttatattttatatataaaaatatatatatatatatattttttttctcatgagtagaaaaatcagatggcgaaaacactcacttgctgggaggaatctcagccaaatttccatttactaagaaagaacacctgccatgtttcctgaaaccttcactatttaaaatactcctttaggaatatagtaagagtctactttcttggatgaaaaaaataaacactatccttttttatagaaaaccttaaagtgttctgcatctgttgctggtattcatagtgtgattatagactgtgatttccccactgtgattcttcccttatgttactcagtgggcagaacttttatcttagagactgtcacaaatgaaatacccaaaaatgtgcagtgacataggtgtctccttgataggaaaaagttaatatgcccaccctgtttacacacacacaccactcacacgcaatatcattttttcccagtacccagttgtttaagtattttgcttatctcaagtacctaaaattaggtatttaaaaaaaaatccacttagtccttatttacatgcattaaaaacacagttttctcttccagaggctgtatatctcaaccagcattttgaggcaccttaaaatacataaggagttcttcagaatttctgtatctagttattaaaatctgccttaacaaatgaacagattcttgaattgtcacaaaaagagatgtttctctaccaagagaagcctaccttttttgaaacttgacagaaattatgatgcccttttcataagcaaaatagattattgggcgggcgggaatcgatgtggtgcttgggtagagggcactgtattcgctggagtttctgggagtaatagtctccagtgtgcaactgagtgaatggtcagcctttctgattgccctgctggatattgttctaaaccacagctgctctatgtagcacttgatccaccaaacagattttaactgttattcaacctgttcttagcaatgcagccaaaaatgctgccgtggcttgttttatacgtttgtccttaaagaccagggcagaatttattagtatttttaattctgtaaggcaatacttagtctttaaattttcttgttcgatctcccaccattctcccgaatttaaactcaatacttagcaaatattatgttaatgtccttactgattagacagtagatttgcaaacaagaaacatattataaaattttaaaaaatgattaaaagaatgttagttatcctttggcacagatctccccactatcaacaaaatgtatctttttctcatctctctttatcagtccctctcccctattacctctctttttccatatcctgtaactctctttttcacatctatttatctgtatcctttcagttttctatttacaattataattttaatttagggccactgactttgtttaaaaatagcacctgccactgtagtatttttatgtcaccagtgtagtcaagtgtaccatttagtaaggtatttattaaatttcttcaaaaaagaaaggtctttgtctacatggagagttaacttctgctaaattatgatttgataaaattattatttttctatatctttaaaggctttttgtagtgctggtatttttaattatatttactttaattcaggaagttttcaaataataatgttccatttaaaaggaagcattcagcaaatgctttgatgtcttagttaaggcctatcaacacaatgctttaaaaagttgctgattataatatcgtcttctaataggttgccaccttgtggtttttgaaaaatacagttaacacatttcacagattgcataaatatcctgctctatgttttgtttgtttatttttctcttaggtgaagaatctagatagctaacgactcttaagaagtgtctagggatcattttgaacccaaagcatcgctttgcgaacatttagattatgtgaattcaaactaacagattaaacgccattcactttgaatagcctctggaccattaggagagttggtagtgttattatttaaagcaactgcacataaaacacaccaatgtatcatttgttcttatgctcattcattaccaatagtaaattctttcttacattttttagtttgattcagataattaatttagaggacagtggctttctttgattgcttgttttatagaaataacaagttgtaacttaattgggtaaacagtcacaaatacactacagggaaaaacatattccatgtaataaagttttcactcaattagaaaagagatttgtctcattcatctcccaattcccctacagttctaagcagagtgtccttcacataggcactcaacattactttctacattaaagatcatgattttaaatgcttaaattacaactagtatgtctttcccgtcaaagatgttggtttccaagacctaaaattgtgagatttaatgtgactagttattgatttccctcaggaagagcagtcaaacttgcaattctctgttctaaaaggcaagatactatgtattattagcacctattatgtgttaattaggatatagctcaatttttctcatttattaaaaataagaatttctaactaaaagaacagtttaaaaaatattatatataactaaatcatcttgttaaatattaatgatcatatcttatacaaataaaggatttttgcattcagcaatatattttagaaatgtaaaagttgtacacaagaatctttttaaagtttcatcaatttacttgtggtttattataatttaatggtctgtattatgaatgactatcaaaacatatgctgcttttgatctgtggcacctataacaaagtcaaatttctcattacgacatcctatacctttcaggagtagtcatgcttatataagcagccttagttactgccatgccctcaaatcttatataccaacccgactgaaatagtttgaattttccctaatgtggcatatttcatagctctgtctgaacatgaagtttcctctgctgaatctatccaccccgtcttgcttaactgtaaaactcctacttatattttaagactcaccccaagtgtcacctcctgtttgaagtattccctgaatttcctaaatgtagctgattatttattgcttttgggtgatctaccacaaatatatctattactgtattcaaagcactgtaatattgctttatctttctgaatcttctactagactcttcaaagaaaaatactgtgacatgtctatcttcacattttctatgtcgagcatagtgcctgacatatggtaggtgttcaaaatatttgctggttgaacaaagaatgaatgaataaattttgtcttatggatttgacatgtatttgcattacagtaatacatttattgtatctgaagttagcaataactgaaaagtaaacttcattatagaaccaaaacaagtaaaaaattaattacttgcacatgcttatcaattgcagctgttgttcgctcccactgagagtttcacgtcattcaaaacttccagtttaggtaatggtgtttcagtgaggaactaagtggcctgaatgaggtgatgttgaggagctaatactcagtgggaagcagaagccagcacaattacaaaacatatgcacacctagattctaaaccccattatggacaccagcatcagtgtaggtatactaatgttaatgatatatataccaacattatatgtccattatcttctacctctaggtgctatgtccatttattcatttactcattcaacaagtatattttaattgtttggtaagtttcaggatctatactcagtgttaaagacacaaaaacactctaaaggatatggtaaactgctatgaaagatttttgtcttctggagtttgcattttaagtagagtgtaagaaaaaccacagttacccaaacactcacctaattacatttgtgataattttatgtgtgaaatgacacaatgtttcatatagttgtttaacaggagaactaatctatttttatgatgaaaagttttgcaggaatttgggagatgaatgtacattttctatgtcaagagtagccactttaattccagttttaaaatttctacagcatctagttgctttttcgcaatttaaaaacacttataataaaaaagtaggcattacaattgatgtcacagaaattaaaagaataagagactactatgaacaattacacaccgaaaaattgaataacccagaaaaatgaaaaaattcctagaaatataaaagttaccaagactaaattttaaggaaacataaaatctacatggacccataactagtgaaaagattgaatcagttaacaaaatcctcccaacaaagaaaggcacagcaccagatggctacactggtgaattctaccttacacttaaagaattaacatcaatccttctcaaactcttcaaaaaaaattgaagaggggaaaatatgtccaaacttgtttattgcagtcagccctgccctaataccaaagccaaagacaccacaagaaaagaaaagtataatccaatatcccttttgaatatggatgcaaaaatcctcaacaacatgatagtaagccaaatctagcagcatgtttaaaaacatcatataccacaactaagaggaatttattcctgggatgcaacaatggccaaatgtatagaaatcaataaatgtgatatattacattaacagagtgaagaatacaaggcacataattgtatcaatgaatgcaaaaaaagtatttgaatgtatgtgacaccatttcattattaaaaactctcaaaaaactaggtatataagaaatttacctcaacataataaagaccatatatgaaaagcccataactaacatcatactcaatggtaaaaaacaaaaagctttttctttataatcaggaacaaggtaaagatatccactctctccacttctaatcaaaatactactggaagtcctagccagaggaattagacaagaaatagaaataaaaggcatccaagtgaaaaaggaagaattaaaattgtccctgtctgcagatgataagatcctaaatgcagaacaacatgatgactccacggaccacactgaggtgtcatcttgccccagttaaagtggatattatcaaacacacaaaaaaaaatgtggagaaaagggaactcttatacgttgttggcgagaatgaaaattagtcaaggtattataaacaatagtagggaggtttcattaaaaaaaagaaaaaaaaaacggaaaatagaactatataagatccaaaaatctcactgccggatatatccaaaagacaaaatcagtatatcaaagagatacctccactcccatgtttattgcagcagtattcacaatagcgaagacacggaatcaacctgtgtccatcaatggatgaatggataaggaaaatgtggtatacatgacaatggagtactattcatccataaaattgaaatcctgttacttgcagcaacatgagtggaattagaggatgttacgttaagtgaaatgagccaggcatagaaaagggatattgcatattctcacgcataggtggaagctaaaaaagttgatctcatggaggtagagtagaatgatgattaccagaggctgacttggaaggcagggatgaagagaggttggttaatgggttcaaaaatacagttagatagaaataataaattctgatgtttgataagcagggtgactagagttaatggtaatttattgtatactttaaaataatgagaagaaagatttgaaatgttcccaacataaataaatgataaataattgaggttatgaatgataatacaattaccctgatttaatcactacacattgtatacatgtacaaaaacatcacatgtatcccagaaatatgaataattattatgtatcagtaatgttgaagagattccattaaaaaaaactgttagaactaataaatgaatcagtaaagttgcaagatacaaaattaacatgcaaagaatcagttgtaatttctatatactaaaaataaactatcctaaaaggaaattaaggaaataataccatctacaatagcatgaaaaataataaaatactttagaataaacttaaccaaggaggtgaaagacttgcactctaaaaactacaaaatagtaggcgggacgtggtggctcacgcctgtaatcccaaaactttgggaagtcaaggtgggtggatcacctgaggtcaggagttcgataccagcctgaccaacatggtgaaaccctgtctctactaaaaatataaaattagctgggagtggtgtcgggcacaagtaatcccagctacttgggaggctgaggcaaaagaatcgcttgaacccaggaggcggaggttgcagtgagccaagatcatgccattccattctagcctgggcaacaagagtgaaactccgtctcaaacaaaaaccaaaaaacctgaaaagctactaaatagtgacgagaaaagatacaaaagacacaaataaatagaaatacatcccattttatggattggaatatttaataatgttaaaatgtccatactacacaaagcaacctacagattcaactagatgcttatcaaaatctctgacaagtttttccaaaaataaaaaaagtactaagatgcatatggaaccacaaaagatcttgaatagccaaagaattctggagcaagaagaacaaaactgttggggtcacaattcttgattatatattacaaagatacggttaccaaaacagtgtagtaccggataaaaacagatatacagaccaaaggacatccagatgaacctggaggacattacacagtaaaataaaccaatcacaggaggataaatacttcatgattccacttccatgggaaatctaaaatagtcagacccaaaatggagtagaacagtggttgtcaggggatagggagagggggaaatgaagagctgtggttcaatgggtataaagtttcagtcatgcaaaatgagtaagctttagagatctgttgcataatattggacttatagttaatacaatattgcacacttaaacatttgttgagagggtagatttcacattaattattcttactcaacaacaaaaaaacttgtaaattcttgtgaaaccattaaaactttattcatgtaattttgcaattgaactgaagtaatagttcaaactttcaagaaaataagacaatgttttctttgagaaagttgctataatatgtacatatcaacaaaaatatttttaattaatataaacttgttcttaacctttttgaatggcacatgatattatttttacctgtgtattcaagatgaaatcctgcagcagaaacactgatgtctgattgaaaatttagatacagattattagacgtactattcaaaagatggggtattgttgttcctgaaatgatatatgagaaggcaagacaatgaccacataataagtactataataaaattaagtaagtttactaatcagccaatagaataccactaaaaatatgcattattcaagttgtttttcaaaaaaaatttaatagaaatatttttctcacaatcctctttcaatatactattcctgtttccaagaagacagaccacctgagatggctttagattgcttcctaaaaataggtaggagcaaaaagagcttgtgaaagttaaagctatacgtttgacatgttcaccaaaaataaatgttgaatttcatgtggatttcagtattccgtgcacaagctaataataaacaataaatacatatatatgtaaagttatattctgttagaaacatgaatgtttgcaatgattgctttcaaagagattattactctgtattctctctgttttccaatatgtttttttgaagactgtgttataccagaggcttctgattgtcaaagtgataaccagttttaactgcctgtatgtaccagattggtgaactaactaaaaagaaacacaaaatatgaataaaacacagtttgcaaactaaaaaagaataaataataagcttaattttgaactttgcaaagtaacaactttttatgagtcagataatatagtcattgatttccttttaataatgaattaaagttagacagctagatagatagattattctataccaggtcaagtgcctcaatgtttcttataccctgacagcaaagctggtagtcagctttcaaaaaaattccaattatgaactactgttactcttgtctttcagcaaatgcattataatgatatttttctggacttctgaaggagatcaaatttattttattaagttattgagcttgaaaatataaagtatctgcttgaatcaattatttcttgactttgctattgagcaaagagtttaagatctttgactccacctctagcagtttcaaatggcaagcatgaaaataaacaagcgctaattctacatcttaagacatagttcaacaagcatatgagttgaggtcattacaaacatttctttataagtaactactttctttacatttgctttgcgcaactttgtggacctcacccctgatgtcttctatggaagaacagaaagaatttattacacagcacacacttgcttcttttctggccatagtgtgataacagcaaccactgaagacagggataaacagaaacttaaaaggtcatttcacctgccttaagtctcttacaggatgttattgattaagagctctaattctggagtcacaccaggtgggtcccaatctcattctaacattagttgtacaacctcaggcaacttaatctctctaagcctcaattacctaccaggtctgctagaaagatcaaataaggaaatgcatggcaaatgtcacacagagctagcacttagtaatcaacagctgttatttatcactcatattatcattacattattattttaaaagtattacagatgggtatggtggctcatgtaataatcatgggattacaatcccagctaatcaggaggctgtaagacaggaggatctcttgaggccatgagttggaaaccagcctaggcaacatagcgagacctcagctctaaaaaataaaataaaataaaaattaattggggttgtggtatgtgactgcagtcccagctactcaggaagctgaaacagatggattacttgagcccaagaattcaaggctgcagtgagctatgattgcaccactgcaccaaagtctgggcaatagagccagaccctgtctctaaaatgcaaaaaaaaaaaaaaaattaataatactactaataaagtattacccctaacctattacaaataaaagtgtgctaaaattgtgtgcgatttttctaagatttctatctaaatctatattgttcatgtttaaatcaaatcactcttgctccagatatttctttcttttcctcattggtgatgataagtaattggttccacaagtccatttaaaaatctcttaaaagcttaaagccattcaaatttatttcagcatatctgaattgagtaagttaatatgttagctatatttatatttctagagtttaaaaagtataatagtaaaaaattaacaaagtaaaactttttattttaacttctatatgtcaaaagaagcttttaaattattgcataaactaccttttaaacctcaataaatctggctgggtgttgtggttcacacctgtaatctcagcactttgggaggccaaggcaggtggatcacctgaagtcagaagttcacgacccgcctcgccaacatagcgaaaccccatctctaccaaaaaatacaaaacttagctgggcgtagtgacgcatgtctgtaatcccagctactctggaggctgaggcaggagaatcgcttggacccaggaggcagaggttgcagtgagctgagatctcaccactgcactccagcctgggagacagagcgagactacatctcaaaaaataaaaaccttaataaatctaacagattttaaaaacaagtcaacatcttacataaaaatataagacttctattttatttatttctggtcttgttaaacatgtatacactaattttatataattttattcatttcatagaaataattctgtattctctttattctcatttaacagtaccttgtagcatttacctggttattttcatgacttcatagcacacaattcaaagcacagtctaatttttaattattattgctcatccttttcttttaaggaaaagagcgtacatactattcctgaaccctaactcagctgaaaatattaccagtaacataaaaccatcaataaataattacacaaatataggaagaattggtaagaatgtaataaggttttaaatatcaatattgatatcatctttaaatcttttaaacttcagtccttgtatctttgtgtatagtttgtaaaaagcaaattaaaactaccaagtaagagttgtagatagctctttaattttttttatattcctaattatatctgtattttaattaagctcagctctcttatttacctgaatagcttccaagtcttggagcattgttgtctcccccatcataaaagtccagagaatcccaattatgttctgtagcaaagctaacaacttgcacctgtgaaataataattacaggtaagaatacacatttctaaccagatacacataactatagtccaccaatcccccttggaaaagagagttcaaatcctgaaccacataattgtgacccttcatagaagggtttttaacagaactgattttttccattattgcactggcttacacgagctgatttttatatagaaaagcctttgaagcaccgaccaatgttcattgtgggtataaccagagcaatgtctgtcactatctcagaacattctcttttcaaaagatttgagctaatctaatgactcagtgccaggaatctcaatgcatgttcaaaacaatcggtgaatttttatgtatatgtactgatttgagttttctaatttgcttgtagctattaggaaaaaccagatctgtggtctacaagcctgtaggaccttataatatacctttttaaaaccaggtttatttctggatacttttaatttatcctttccttgcataaactttgctcaatttcttctcttccttttatttaaaaatttttaacacgcatatttttaataagtttcagtatggatgacacaaaaaaatgatattttgtaattaattcaaatgaatttttaaaaatttattttaatgaatagagttatagtaactacgtcacagtgaaggtccttaaagttgagaaggaaaatactggggaggtttaattctctcctgtctattacagtttatttagagaaagatgcatgtgttactttattgcacatcacttggcacagcttgagcttttgcaagaacccacaggaccctcacaactacggatgctacctattttgctatttctttattaaattttttgtggttttagaggaaggaaaggaataactttattaaaagttttttaagctaaaatctgttaaaaatgtatgcactgcactcattcactaaataattacaacaatttcactcattaaaaatttattatctgcaaaatagcccatcattattcttccatgcaagtgaatgctggtgcctgtttccaggggtgagtgccacatggcaatagataccctgcctgtatgattggcatcagacccaatggcagtgttctaagataggaataagaccagaagtaaagccgtatgattgtagtataaccgccacctccttaaacaattatcaattccctcttcatatctaaatttccctttccttcaattcagaggaagaaaatactgcattcagctttttaaaaaatgtgaagattcacgcaggagttgacatttgggctaagctgaagatattgagttattccactgaaggaaattattgagtgtctaacaatgtaaaaggagtcaaaccataagctagatttagtggaccatgagtaatcttctttagctacagtggggggtatttacataagaataaatatacatgaaaagttcgagaaagaataaaaaagttcaaaagagtagagtacagtagctaaatacaagagaacttagaatcaaagaggctaggtttgcaacttcctggctccctctcctcatgggcatatcattcaaggaaagttgttcatctttctgtacctcagattatttacataaattattgtcataagggtatcaaattcataaattcattgtaaaaattaaattagttaattcatataaggcaccctgcatgtagtaaagactcaataaagcttagctaagaggaagatcaggggagaaactcaataaaaaactaaaccccagcatagcaactatgcacttcaagacgtggtgatatcttcagttttccaatgaaggtttcagaagtcggaggaagaacatgattaagacagtgctctaagtacagcactgcattgggtgaagaaagtaaaagtgaaagacaatttcaatatctatttcagtaatatttcaatatgtattgcagtaaaaaacaatgagagactcaagtgtattggaggcaggagtagtaaaaatgggaacccagacgtcacatgtgttgctgtagaggaagttattaaattttgtgtgatttgaataggggaggaagtgaaaggaaaaatttgagaataatttattttcttttctgttattgagagtagtggggtagcaagagcaaaaatgtagacatctccaagaaaatctattgcctaggtgggagaaagaaagtcagtttacttctggatacatgtgtctagtgtatatagctgaataatggcttctggagatatcaggttctgatctctggaacctctaaatactaccgtatatggaaaagggtctttcagatgagcttaatttaagaatcttgagaaaggggaaaagaggccaaaggagattcgacattcatagaagagaagacgatgtgaacacggaggcagaaattggagtgatgtggccagaatccaaatgccagcagccactagaagctggaaaaaaccaaggaagagatgctgtcattcctgagaccctgaagtgggcagggacgagggaggagaggttctgccagcatctcaatttcagtgcagtaaagctgattttggacttcttgcttccagcgctatgaggaaaaaaataaaatctgttgtttgtaactataaaactcatggtaatttgttacagcagccagagagatgtaatataatttgccactgggattcgaggtacattgtgaatgtagtttggcataataaaaatataaagagtgtagaagcagaatttggccagaagaactggcagacaatgctatgagatttgttaagggactcaaatacatgatcgagtactcactatgacagaagacacatgaaagccaaccaaagattttttttttcttttttagacagagtctcgctctgtcgcccaggatggagtgcagtggcgcgatcttagctcactgcaacctctgcctcccgggttcacgtcattctcctgcctcagcctcccgagtagctgggactacaggcgcccgccaccacgcccggctaattttttgtatttttagtagagacggggtttcactatgttagccaggatggtcgctatctcctgacctcgtgatccgcccgcctcggccccccaaagtgctgggattacaggcgtgagccaccgcgcccggcccaactaaagattttaaaagaggtaaatactgattcagtgttcagagtaactttgcgttagatatagttgtccatcatggtaatggaatagcttcatgaggtaatgaatttccaatcattaaaactaggcatctatcatataactgttcaaattacattttactttagattatataaaatcacgataatcatgctgtaaattgatacaataatgtagccaacatattttcccccatggcttattacataaatatttcccttttcttgatggctatcactgctaattttgaatgtagctgcactggaattctccaatagaccctgctaaaataaacaaacaaacaaatgaatccactctttgccacaaagagtgggaaattctcatgtaatattaacaaattgtttgttcaggtaattcccaaagaatgttcaattattctatattattgtaatttttcagcattccatatgtttcttcttttctcctcttttcaagaatgattatcccactttatctcatatatgatttattgaatattcatacaattctttattcacacacatatttggcccaacagagaaaaatattaaacattgctttaaacctagggtagtagccagatagcttttaggtaaatttaatgaagtttcaaatgtaagtcatatattatgtgtgtgtgtgtgtgtgtgtgtgtgtgtgtgtgtgtgttacaagtttctatgactcagtgatatgtctaaaactagcatccatgtaaatggttaattagaaaaaggtccttgatagtttttttttagcgtgtttaaaattaaaagccccaaatgctttacacactatatgtttgctaaacgtgctgctaaactcaaattttgttttctaaagtacagtcaataaacaaagtccttcctcagtgaaagattttagtgttattcatatgtgtccagttttgaatagtgtttgcctaggataagtgatatataacacagtttttctgcaaacatcttagtagttcgttatgcctgctaactctaaaatagtcaaaactccacttgtgcaagtattcattgattcgttctaaaaatatttactgagaatacactgccaagcactgtgcagcatgtacttccactgtactagttgtcagaatggacttggcactgtcctcatgagcttacagataattagtagtaacattgaaatatgatggagaacttaaccttgtctcaagttcatggaaggtcttccacagaaaatgtatttaagttgagacagaaatgttaagtaagaataagcaacataaaaggagatcatagagagtgctcacagaaagaacaacatgcacaaagggtccagaggcaaaatgaagctaggtttttataaggagctgaaatagtgcagatagaatagttacaaaatgagaacagagcacaacggcataatcgacagtgtcaaaagagataaggagattggagacaactgaggtattagatacaagaaaatgatagtattagatttttactttcagatggttactctactggacgtacagggaatagactgcaggagaataagaacctgggacaagggtgatgctatctgatctcgggtagtaaaagtgtgaatggagagatatagatttgtttaagagatttatgaaagacaaacctgacgaatttcattgtaccgagtaagagtcagaaaagaatcaaaatttctgacttgtgtaacttaatggatgaggaagttgttctgagaaagagaacactgagaaagttctatagttttgagaaaattctatgaagtcagttttagaggttgaatttgacaagccatcaagaagtttagctgaaaatgtccagtgggcagtcggacatatgttttgcagcttaggtgagaggtctgagttagatatttaggtctgcatgtcatcatttattcagtccctcattcaaaaatatgttttctgattatctattatgatttacgtcctcgacatctctaacacataaaagtagctgaagccatggaattagacaaggtcccagagagagtaaagtgaaatgaacaaaggccacagaatctcataaacactaatatttgaacaatggattgaattgcaagaggagaccatgtagtagatatagaagtaggagctacagatgtagaagagaaaacaaaacaaaatccaagaaaatattggtgtcctaggatctaaggagaaaaaaatagtctattaggagtcaggggaggaacagcaagatagagagctgctgacagagcaagaaagatgaaccacacaatggatttaatcatatttagatcttcactatgagactggctctattagagtattagttgctgaagccacattgcagtgggtcaaaaagagaagatgataactaaagaaaacatgtcagggttttcaaaattttaagattagatggaaataagtaagctgatttaatatatagatgctcttgaataaccttgagaagattataaccagatgatgtggtaaaagttctatgaagattctaaaggtatcatatcatttcagatcctctatacaagctggagcatgggcaatcccaaaatccttattattctactataataagataggattgattcgttatcttcaaatttgacaaattgtctataaactagcaagaatgtaagtatgcatctataatctttggatggccttaaaactctgaaaatgtacatgctttttgttttgtcattggtttgctggcatattttactcccaacacctgtcaagtaatttttaaaacgtctgaacaattataaatccatgaagctgattttttttactaaaaattatgcttcaatctaatttcattattaatgcatggcatcttggctaatttttccacaactcttatatgtctcaagtttctaaagaaaaactctacaaatcaattagagaagtaatcaagttatatctgtgaaggctagataatatttatgaagcataattacctttcataggatatatatactgattctgcagtaaaatattatcaattcatccagaaaaaatatatatctttatgtaaaacagaataactggtcaaatagcagcccccaaaatagccataattcaaataacaggacagtcactgttgattacctatttttaaagagcatcttccttccttgctaacacagatctggcttagttcaattaagtgagagatgtgtgcataataggaggctgcacttattgcttactcctgatacgtaatatagttttatttgagccaaatcatagtaaatctttggttgttgcccattgcataggtttggaacggatatgattgcaatcttggtcaataaaacaggagggaaagtctgctggcaggtttcctgaaaagttttcttaaccactgaaatggtacataacatagggacattctgttttagctgctggccattgctatgtagggctgttacgcctagagcttttgcagccacctcaagacctcaggagaaggtgtctaagaactaaaaccaacaggctgagcatggcagaacagagagatggaaataacgtgggtgaggaaagacacactgaacccctgaaataatgtttaaaatctgcttacctcaagattccatgttatatggggttaacacattttttttgtattgcttatgccatcttgaattggctttctgttaattctacgtgaaaaaaattaataacaaatatctttctattcatttcaaccatgtcagtcaaaaccacttgctaaacttttagaaataatgttcattctgtcatctctgaaaagattaactacacacatacaatgaaaagaagaaaaacttaaatattcttacttgaatgccagctccctctggcactgtgatcttccacacacaattcagattgttgtcataaggctcagggtatccaggtgacaaaatagtccctttgcgcttagttaaaattccaccacagggcactgaaaataaagcagtccaagagagggagttaattctaatgcaaaggattaaaataagagtaaaggtcagagataacatcttagacagatactagacttgcaaatcaaatcatacttttttcaaaactgataaaagcaatgaaaatgaagtttttgtataccatggaaacgataacaaataattagacagcattaatggatgacctttgaatggcatatctaaaaatcacactacaattaactcaataacagcatagtatttgtattatattactaaaacacgcattgactaaatttgccttaaaaatagttcatttttagataaaaattgtctcgaatttttaaaaaattatttggtactttctccttcatgcattctttgaggagtaacagcatccactggaaagtaatgaggatgatgataacaattatattatgatcataacatttatatagagcctactatatgcgaggcacccttctaagtactttacatattttaactcatttaagccttccaacaactaatgagatgactaagtactctccacattctacagctgaggcaatcaaatggagtcattaagagattgtcttgcccaagatcacatatgaagagatgaagctggccaggtgcagtggctcacgcctgtaatcctaccactttgggaggctgaggaggctcaccaggtcgggagttcgagaccagcctggccaatatggtgaaaccccgtctctactaaaaatacaaaaattagccagacgtgatggtgggcgcctgtagtcccagctactctggaggctgaggcaggagaattgcttgaacccaggaggcagaggttgcaatgagctgagattgcgccactgcactccagcctaggagacaggataagactccatctcaaaaaaaaaaaaagatgaagctgagatctgaatcctggcagttgaagccagagtccatgtccttagatggaactgaagatacttgaagtggtcccagtttagttattgccagtctaactactacaagaaagaatatgtatgcagacctactcagaagtcaataaaggcttctatcatttttagaaggtactagtctgaaagtaaaattctcatgccattaatagaatcaccttgattctggccatgacctaactcataactcttaaattctgtgtgactttgacctgttctttacaatctctgaaacacagatatcttatctgtggaatggtaactctattgtttctaaaaggcttttgtgaaaaatacaaagaagctagaatgtacataagaaacaagcacacaccttggaaaacagttagaaatcaataaattatatttccttttgctacaaatattattttaggtcccaattgtactgtgctcctggggaatttgtcctagtatggctataaatgatgagatacaaagaacatatcttttgtaataataatttattttaaaagtgaattacagttttgtgccacttccaaagacaaacgcaaaaaccagggcaattactcaaaaaaaaaaaaaaaaaaaaagatgttgcaaactttttaaaatagtgtgacaatatatttttaaagaaactcacttagtcgtgttttcttacaaagctctgtaaatgggttatatacaaattctgtttaaattagtcaaaattaatttagctaatttaaatagaaaaccagcagttttgcatgatttgagaatgacatgcaaaagacagaggaagaaatttaaaatattcacccaaaaaatagaacaaaaacgtaattgatgaagtgttgatcctgctgatgaaaaaaaaatactttatagatgctcttcctctccatcgccaccgccacaacttttcctcatacgtactttttttttttctgagttactacattaatcaaataagtggcctccctatggctggtatgttttccatgcactatatttttcaaaatactgtcaaaattatttttctaaattaaaatatgacatgttgcttctctggtgaaaatccttcaaaaatttccccattgtctgaattcacagctcacagatagtttcttttttttctttttttttttttttttttgaaacaagctctggctttgtcgcctaggctggagtgcagtggtgtgattatagctcactgcagcctcaaattcctaggctcaagcaatcctcccacctcagcctacagagtagctaggactacaggtgtgtgccatcacacccagctaatttgtgtacagatattcagctaatttttatatagctaatttgtagagacaggatctgtgttgctcaggctggtcttgaatcaccagcctcaaacaatgccgcctcagcctcctaaagtgctaggattataggcacgagccactgtgcccggcctacagataaatatagttaattgtattagtctctgatttcatctccaggcttgtatgtaactataatttcccaagtcctcatcatcttaatcccccaacccagtccagccttctaaactaatatgctttcttattgctgtcacttgatttgtccccttctctcacctagctaacacctacccatctatggactttcagtgtgaatgttaccgcttcaaccctttggaatttccctgtgttaagtgtcctgtagtttaccatagcaccaaatgttttcctgtacaattttatcatactatgcttccgtattatttttatgttagtctcttgaaacagactcaagtctgagcagacaaggtcacccttttgcctgaaactctgtttatcaagattctaactcttcttctttgcattataaattttcttccatgctgctacagtgacaagctatctcctcttcctccatcctctctttcatgcattgcatcagacttttgtcctcactactctggtgaaataaccatgtcaaagtcaccagaatattaatgttgtgatatgatcaatccttaacttgcattttactcaatctatgaataattagctctcactgttgatcactccatctgtcttgagcctttgtttgcttgaacatcagaacaccatactctcctggttttcttctctattattggctgcactcagattttttttttttaactcattctcctctttgtaactttgtcttaggccatattctctttctaatcactgtccccccttccatgtcttctatatactctgactaccagatgtttatctctagctgtgatttctgtgagttttgcaatcatatgtctaacaagtatctcaaaatggatatgtccaaaataataactttgaaattcttcttcatccacactctctttcatcttagggattgtcaccaccattcactcagttcttaggccataaacctaagattcatcttgatttatctttcttgcagtcaagtttacatttacatctattctcaatctatcagtaatggctccaccttaaaaatatatcccaaagcttactaattctcatcactgtgaccataatcttcctatccaaatcacactacttttcccctccattaccttgataggcttctaatcagtcatattggttctactccacatctccctacactaactacagtgatttattagaaactgattaagatcatatcactccccagctcaatatattcccatactagttaggaaaatttcaaactcaccgtggtcttcaaggatccatgtgacttggccctctgctctgcctctctaaactcatctcctatcactctttgctatcatttactgtgttccagacactgtggcttgaacacgtcaagatctctctccctcaacagtccatacacttgctcaccaacaagaaagacttttattcatccctccctctgttcattttattcaggtttaaaatggcagcatgctctgggtgtcttgttgcaactccagctcctgctttatttttttctacagcattctcactccccaaaagaaaagaatatatttcttgatgacttttgtcctcctccagtaaaatgtaaaatgtaaatgcaaaatgtaaggacaaagatcttatattcttattcaaaactatgtcaccagtgcttagaatagtgttggcatgcagtaagcactcaataaattattgctgaataaatcactgaagaactgattgtgtatctgtacatatcttgtgctttcaaattacctctttatcattcctgcatcattcctgtctcccagtatttttctaaacaagccatatttgtctaattctactgcaatcatatttatttatttaccaacaaaatatgctatagaaaaattagcagatacgcaataccacaatctaacatttgcatcctgttttttaaaagatatatgataaatttctgttctgatcagtattcaatataatatgtggattaatagagcaggctttcaaatcaagcagcctaagttcaaatccaattctgcctttttatctaaaccaagaggttttactatctgtaaaatagagataattatatctaccttccaaagttgatatcaatattaaatgagataatgcttaatagtgcttcattcaaatgccaaaaattgctatttattattgtatttaataactttttcatggatgaatggatagatgaataaatggataaatgaatgagatggagagtttgtatatatttcttcatgaactttttttcccattctaagaaaagatgaagtagacaggtgttgccatggagactttcaagtaaaagtagttctttctgggtctctaaagaacttgaaaaaacagaaccagataagcatgatcagataagcagctaattaaagactctttgcctaaggggagtaggtggcagcttccagggcttttcaaaaaagacctcccactaacagaagtacttatgcctaaggtcatatattgtcaaagctattagtggctgcagggggttatttgaatcacagagtctaaaagggaggaaagcctgggggtttaggagactgcatagtttaagaaatgtgaaatgtaacaaggtcaaatttggaagataaaaactcagtcttcagcataagttttatttttcagtttttcattggtctcaagtctaatttttttaagtaaaattttattgtattttattgtaattaagaaaggcttggaactacagctttgtacaagattattaaatattgtttaaaaactggttgttaaagtttgtgaatcttctaatttagtatttgaccattttaactataagcacaactcacatatcatgtcttatggggctgctttccaatcaacagtttagttttagtatgtcagtgtgtgcaaaattaatgaacattttcttgtgctttactgtgacagaaaaaaaaacagtgttgacagtaataataagaactgtgaaactgaaatgatacaattgagagggaaatcattaggaatgtagaaagcagtattgttttgctttcaattggatgctgacttggcttaagttattaactgagcattcattgaactaagacagaaaaacaatcatcatgtataaaaccctgtaaataggctgtcaaagattatatctaaactgtaaagggtaaatggagaatttgctctctctcagaataaaactccccatataatatgtaaatcttttgcttgtgttttaccaacatacatatctttcctgcagatgtcagaagagtttgaaacctcagatttgtgaaggtttaagcaaggaaactatgcaagagtatcaccatgtggtggaatactgaaatggaaaaagtatggaccttggacttgggaagttggtaagggttgtcagaccctctacaaatattcaggaaattgatacagtaatttactaaaatccactcactgaataaaagtttgctgaacacctgttgtgtgccaagtcctcttttgattgagcccaaaaccaatatagtgacaatggaaagagggacaattaagacagattaagaaatgttttacaaccaaaaattatacataatacagttcgatggttgctgtaaaggtaatggtataaagagtaaacggttgatgggtggcagaaaattattttagataggatggccaagaaaaataggagacttcaatgaaatgatgtagtgagataaaaagctatctgttctaatcagaggaaataagaaattcaaagaccttggggcagatgttttatgcagttaacagaggttgaaaaggagcacaaattaaagagaacactttgatattaacgtaagatagctctgtacttgactctcacatttgaatatttaagacactgagctttttctatcttaaaaatattttaagacatgaccatttttattcagaacattttgaagctaaaaatatttatagttaaaaatagaaatgcaaactatattttcatttatgtaaagattagtagttgcaccaaatggtaaaacttaaacttgtctatcttctgaatgtcatttagaatcatcacctttctatttcttctgtcacatagaccccatatatccatctgtcatattgtcaactttatggatttacacctgttccacaaggaagaatatttttaaaacggtataaggtaatatgtctttttcatgtgatcttggcagaaaatacaagtcatatgacacaattttctatctctggatatgcacttttaaactgcctcattctattcaggccatagcaaaataccatagaatgggtggcttataaacaacagaaatttatttctcacagttctggaagctgggaagtcagcactggtagatttgatgtctgctgagggcccctttcctggattatatacgaccgtcttctggctgtgtcctcacatggtaaaactggctagagatctctctggggtctctttcataagagcattaatcccattcatgagagctctgccctcataactaccttccaatccctgcccccaatactatcatcttatgggttaggattctaacatatgaatttgggggattcaaacattcagactacagcattctgctgctggcccccaaaattaatgtcctcacatgcaaaatacattcattccatccctatagccccacaagttataatttgttccagcatcaaccataagtctaatgttcaaagtctcatctaaatatcatgtcaatcacatatgggtgacactttaagatatgattcatcctgaggcaaactcacctccggctatgagtctgtaaaatcaaacaaactatctactttcaaaacacaatgatgagacaggcacgggacagatatttccattcttaaaaaagaaaaacagggcagaagaaaggggtaacagatcttaagcaggaccaaaaccttaaaattcaagaagaatctctttgattcaatgctctgttcttcagtcccactgggcctatggtctcacctcctagactcacaggttggaggtctccacccagacacgctgcagggaaggtcccacattctggacctactggaggttatagtcttacttctgtaggtttgctgggcataatacatactacagctctcacaggttagagttgcatgcctgtggttctccctgactaacatcacacaccagtggctctactgtttcatgatcatattggtggccccacctctgtagctccactggacatttttccacaaggcaatgctaaaggtgtggggctatccacatgacccctatggcagttctttgcctgggcagagaggctttccaggacaccctttgaaatctacacaaaggcaaccacatctccatagctttattgggtaccgagcatggtgagccagacccacaggaactatccctatgtagccaagcagctgtgtgacagactgcatgaatcagagcctgaggtttaaggcccttcctttgaaatctgactccaaggcccttgcactatgggcttgtgactggatgggtagcctggatgatctctaaaatgcactcaggttcattcttcctttgttttggacaataggtcctggcttctgtttagatggctaactaatgctctcattgtattgatgaatagcttctagcttctactgagattgtgagttcatactaatcttcttatcaaacgttacttgattaaactcttttttttttttttaagacagaatctcgctctgttgcctgggctggagtgcagtggtacgatctcggctcactgcaacctctgcctcccaggttcaatcaattctcctgcctcagcctcctgagtagctggaattacaggcatgtgccaccacgcccagctaatttttgtatttttagtagagaccaggtttcaccacgctggccagggctggtctcaaattcttgacttcacgtgatccacccgcctcggctaaactcttaaagttctcttttgaataggtcttcccattttcccaatacaggtaggttgaaagtttttaaaatatagaagttttgattccaaattttttttttttttagacagagtcttgctctgtcagccaggctggagtgcaatggtgtattcttggctcactgcaacctctgcctcctgggttcaagcgattctcctgcttcggcctccagagtagttaagactataggtgtgtgccaccacacccagttaatttttgtatttttagtagagacagatttcccattggccagactggcttcgaactcctgaccttgtgatctgctcagctcggcctcccaaagtactgggattacagttgtgagccactgtgcctggtcccgatttccaatcaattaacaattccatgtttaaatcattggcagtcaagagaagccaagctgaaccattaacactttgcttagatattttctcagccaaatattcaatttcattgtttaaagttttaccttctagaaaactccagaacatgaacacaatcagccacttttgttataaagtggcataatctttgccacattataacaagaatattctttcctctattgttcaacaacttgttcctcatttccatctaaggattcatcagaattacctttactatccacatttctactaatattctgttcataaccacttagatattttagtaaaaagatgttgcctttctctagagctttcctccttttcttctgagccctcatcagaatttcccgttacagttctttcacaacaatgtaggctttttctagcatgcacctcaaactcttccagcctacacctgttacccagttccaaagctgctgccacgtatttaggtttttgttacagtagcaccccactcctggtaccaattttccatcttagtctgttcaggctactataacaaaaaaacatagactaggtggcttataaacaatagaaatgtatttcttatagttgtaaaggctgggaaatcaaagttttctaaagcattggcagattcagtatctgatgagggcccttttcttggttcatagacagctattttcttgctgtgtcctcacatggtagaacaggtgaaaatatccctggtgttgcttttatgaggacactaatcccattggtcatctcctaatggccccacctcccaatacaatcaccttaggggttagaatttttacataaaaaattggggaaaacaaatatttaaaccatagcaagaatcaatgcaaaatcaaaagtagtctgttctttatctaaagactcctgatggatgcagtgtaaggattctcaaaaagcccaggaaatacagactgctggatctctgacagagagatggtgtgggttcctgggtacccacatcttttgccctaaaagtaggaagtgagttctggctgaatctaggttgagaacagtaaactagcattcactcctgaagtggaatatcagtaatagactaggtaacagcctaaagcctttcataggctttagttcctggtgttagctactgtacttgctaagataaatccttagttggatagcatcaccttactctttttatatagatttttatttttgatggctaaaatgctgggattaatcaattgatacatttgaaatacaaaaacactttgcaataatcatgtagaataggggccctcttcagtttcagacacaaatggttaatggtttaaaatttatagtcttgggccaggcccggtggctcacacctgtaatcccagtactttgggaggccgaggcagatagatcacctaaggtcagcagttcaagaccagcctagccaataaggtgaaaccctgtctccagtaaaaatacaaaaaaattagccaggcatggtagtgcatgcctgtaatcctagctgcttgggaggctgaggtgggaggattgtttgaactcaggaggcagaggttgcaggagatcgcaccactgcactctagcctgggtgacagtgcaagactccatttcaaaaagaataaaaataaaaacaaaataaaatttatagtctcatattctctattctatgtttcacaaatattctcttcaaatgttcactttcttcactcacttctcttcgcttgctattttgctatttttttttaatttttccttttctctctctgtttaatgtgacagatcatttctcccatctatatcttgcctctttctaactctgtctcatctgcatgtcttcatggatataagaatatttatttctttggataatgtgatgtttaaatttttagggtaagaagaaaagcagagcataaacattggttaaatatatacttgcaaggcctattaaaattgtagtaataattattttaactttgtttttattttatgttaaaaaatttgccaacaatgaaaacaaaccaaaatgtctatttctttaagtacactcctcaaccatttgacctggaatgcattaattggtggaaatttcactgtcctcctaaatggtatattttaataaagatttactagtattttcaataaaatcaacacatttttcctaaactttcatataaattttaaatgcaaatagaagtcaaacattcaaggaatcctaaattagagttggaaagaatgacagtactcaatgctttcagccttttccaaaatgcaaaaatcttctgtggaaggcacattttccatataataactttaaattgttttaaaaataaaatgtcaacaaattaaaatcaatagtatcaaacacttgatcagtactgcatattaagtcctatattctgcatcgaatacttttagaattggaatcttctctcttgattttgtggtggcttatttgacaaaaacaaaaacaacctattttctttagtgcttattaggttccaagaactaagccaaggcttttagtcatttagccataatgaacctatgaagaagttttcttattttcttgttttattggtatgggatttgaagatcagagattatgtaaattttccaggatcttattgtaactcacttcaattcagtcatgcggacaaagcgaagacattcacccacgactcttgtgctgataatttagtacaattcccagctctgatgatttcactcaattttacataattctttacaacctttcacgttaattagcacattaacatgatagatatacaaacagaacctttaaggattaattcatacatttacatttcagttcttggcatatgtaggttctttgaacactctaactaaaggaataaaagggtttttgatgatatttaaagattaatgaactagtttatgaatttccatgtcattatattactctgtttttacagtagattatatgaaactaaatgaagagaactacttatctaagtccttctatttttacagcattgatattttctgtcaatacctacataaatatattaaaagtgacacagaaattatgtaaataattactggggaaagtgaggcagaaataatgattcttagtaattacagaaaaagatttaaaaatctactgtgagttttgaagagagttattattatgtgtctgtcttcaattattaaactgatttcaagcaatgtaatttccaatttatgcatattgcatgactaattttcacagacatatagaaacatttcttttagctcatgattcctttagttcagaatgttataaatgttatttataacatttcatgagtatgaagtcaatgtattgtgttgtatgtattgtggttcagaaaagaggacattatttgttttgtctttatgagagtgcaagtacctaaggggaggatctctctgccatattaaccccagctctctggtaggcacaagataggcggaacattaagtccagctgatttatctcctgtatttgtggactgtcaaaaatgtattttaatagagtcagcaattctgcacaataaatgaggcagaaatgtaattgggaaatagcttataagtcagaacataaagagaagcagtaatctatcaattaatttagggttcaaaggtagaaaaacttagttttaaatcctgcctccactctaacccttactatgctctgccactttaaagagaactattttacctctttcagactcagtttattcatctgtacattccaaaagtaacagttccatagatttgtcagaggattgcaacaaatatgtatttaaattacttagcatggaatcgggctcttttagacaattcaggctgctataacaaaataccatagattaggtaagttttcaacaacagaaatgtatttcttagagttctaaagattgggaagtctaagatcaaggtgccagcagatgtagtgtttggtgagggcttgctcggtgcttcatagacagtgcctctgtgtcctcacatggtggaaggctgaatatgcttcctcagacttcttttataaaggcacaaatctcattactgagggtagagcccccgagacctagtcaccttccaaaggccccacttcttaatacccccacatgggggattaggtttcaacataagaatctgtgtgtgttgttggggggcggtggggtgagggagagaataaatattcagacgataggattggcaaacagtggcattaagaaaattataaatatcagaaatcagaaatcgtggttatttagctaaaagataagaaaattggagagtcatttacagtcttctagtgttttaaattattttttgtaagtgttcattcaacaaataacagaataatacaagaatagttcagattccatctattgtcacggaaaaaataaaatatttgttttaagaaaaaaatgcactgtgaaatatgctaggtatatttttggggttggggtgggagtggcgatatcaaattcctagagaaatcaaatgaccaaccatccttcctagttatttgtgagagcctagtttataccattatcctagcacaattgttgacaatgtcctgatttaaatggtaaaaaaaatatattttacttaaagcaaatatattctataaaaattacataacctggctgggtgcggtggctcgcacctataatcccagcactttgggaggccgaggcgggtggatcacgatgtcaggagttcaagaccagcctgaccaacatggtgaaaccccgtctctactaaaagatagaaaaaattagccgagcatggtggtgggtgcctgtaatcccagatacttgggaggctgaggcaggagaatcacttgaacctgggaggcaaggttgagtgagccaagatcatgccattgcactccagcctgagtgacagggtgagactccataaaaaaaaaaaaaattacatatcctgtgaatgcatatcaacagatttatctttgatctcttctcagtagaaatgaatgtaccttctatgttatttcataatttaaaattattttttattctaatgacctatgaactgacatgtgaacaaatgtattttaaaaaggtaaaaataagaatggcaaatataatttattttcatatggcaaaatgtgttattaaaaagtaattttatatatttatgattgtctattatgtgtcaatatacacactcattcctccctatggagagtggactattaagattattaaaattaaaacaaaaataaaacaaaaattttgcttatcttttattttaaaaagtattattttcagctgggtgcggtagatcacacctgtaatcccagcattctgggaggccgaggggggtggattacttgaggctaggagtttgataccagcctagacaacatggtgagacctggtcccttttgtattttgtaaaaatacaaaaattagctgggcatggtagtgcacgcctgtaatcccagctactctctatgctgaggcaggaggctttaacctgggaggcggaagttgcaagggagctgtaatcatgccacggccttccagcctgagcgacacagcaagactctctctcaaaaaaaaaaaaaaaaaaaaaaaaaacccccatatatatatatatatatatatatatatatatacatatatatatacacatatcttatttttaacatcacatactaatataactttaatgagaaacaactcaagtcattagaattattttataacctgagattaagtcttaccactcttttttgaatttaatattatgtaatttaaaaaataataaaaattcccagatatgttcttcgggcagaaaagagagtaatttccctactttctatattttctatgtctatggaactctacaaaagccaagcgtcattataattaccctgaaatactataaaattctaaactattaagatatccataattttagatagtatacattctatttaccaatgcaagttagatatactattgcaaaaacaacttcgaaacaataagatttttggctaaccttatgcattttactcattcaaaatgttaccaccaatatttgtgaaagactgaaaaaatttataattttatatttttatacatatctgtaactaatagagtaagaaaaaattaattcatattttctaattcttttgatgaccaagcaaaatatttccagaaaagtcagcttttggattcttaaaagatctctgaattctttacatattggcccagaaatctttgcacaaacttttaaaaataaaaaataatatttatttcaaaggatgactaccagagtctgagaactgtagtggacaaaaacacagagtgtataagatctgccatttgatagcacaacagtgtgactacagtcaataacaacttaactgtacatttggaaataacttaaagagtataattggattgtcgcaacacaatgaataaaaactagaggagatggatatcccattcttcataatgtgcttatttcacattgcctgcttgtaaaaaaaatctcatgtactccattaatatatacacctactgtgtacccacaacaattaaaaaaataaaataaaaggatagtagtccttcataatcccacattagtagcagcagattctatgttcctggaaatatatatatttacttacatccacataaatccatataaatcagtaaatgaggaaattatttagctaattcaacacaaatttttttattgatttcatcaccaagacaattgcaacaaatctccactgatttttcatatttatataaagcatacttattaaattatttaaaattaagtacataattattagatctgaaatttaaaaaattgaaagatgtaaccaatttttatataaactatgtataatcacagatcatacaaatttatatactcaccaatacaagtaggtaaggaatcattccactgggccaaagaattgggcactgtttcacacctaattgctatggatccatggagaatatatcctggattacaatcaaaaagaaccgatgaaccgactgcaaattcattgccaattcttcttccgaatcttggttcaggcacagaactgcattgtgtagaacttgttctaggaacagctgtgtagaaatattatatttattttaattttatatggtagacaaatacagatttcaaaatgtaactgtttaaacacatttttgagaaatcatcactttttatcagaacttgaattaacaatttgaatacattcttaaagttttaaatttcagacagaataaaatataatttaaaataaatattgttattgtcatcaaggttttttattagaaaagttttacttttgattctttaaacatcaacgatttttgttttaccgaactcattaatattacaaaatagttttagttagatatttttgtaatttgtgggatgaaaactgaaagttttttttctttttaaacttagaataccaagttcaaaaaatatgtgtcaggttatatcaaataattttacatttttttcagtatttggttcttaattaaaaacagattttataaaggcaaacagtactttattagtttcataaaatttcacaaacttaatttcaaacacatttgctattgagaaagataactacatttggactaggtagaatatatgtcagacagattaacaacaataaaagtttttactttaataatcatacaatatcagatttgaaattgcttttagattttataggtatgccctttaattgtgccttttttttggtttagtaaaatagaatgataacaggatgttttttctttttaaaacacataacaaatgtgattaaagagattgacaatagcccaaaaaatgatatgatgaattctaaatagattaattcttcttatgcgacttgagtaaatataattccattcattatagtgcctttttgcagtcgtaataccacacattgtttccagggggaagtactacttaacataaaagagtacaggattatagtcaactgataaatggggtaagaaggtttaataggaataacaaatcacaaatgtttatacatttcttagtaataaagtgcaagatacatttgagattaactactatatgaccatatatatttcaaagacaatatttcaaataatggctcttaacttggtttaatgataacgtagaaggttgtctaccacaggcaagaaataaaatgtgtaaacaaacttctaattgcacaaaagtcctaataactgaagaaagttttaattctcctgagagaatgagaaactataattttagaatggaacactgatttccttggcatgtttaagtacatcagcaccaaaatttttatatctttaatttcgagtgctaaactaaattagactaaatagtctagagtgctagactgttagaaaatagaaaatgtagatagtaaaggattgtcaggaaaaaaaagtagatgttttgaaaataatatgtgggaaggaaggaaaatcagacatttaaactgagaatgatgatggaagcaatagattttgtttactttggtcaaggtgacagtgatctagtgatggtggaggggacaaaataaaactgcttaaaaacacttttatctagaggatttcatcattcaaaaactctgaatacatcatgggaaaattatatcattccttagtgtgtttctagactacagggtcacttaccttggtaaacaaagtgaaatcccttagctgttattggtccaactgaagtaaatcgaattgtgatctgattacctgaactcagtggaagtgattctcctactcaacaaaacaaacactaagatatcataaataattttcattcagtaaacctaacaaattatattataatcttacactgtcatttgaaaatgtcaatctatgttctatcaaattactttaaaatatcctacaactaccaatatatttcctttgggttcaacttgtattgcaatctttttctcagaaagctttaattacatttttatacatattgcctcattcttcaaagaattcttaaatattttatattacattaaacaccagagactaagtgattaaatatattatttacttggttacaatcccagagaatagttggttgtatttttctcaaccttctgagttaattttgtttctattctttagaaaaaaaaaaggtgacactattttcagtttgctttatttcttatattgatgatataaatctcaactttcactacaatactaatcaaagtcagtctttaatcagtaactgatgcatggcagttctattaaaggatacctgaatgggatcctgagagggaagataacagagaagattgctgagttggcccatcatacacctcaacaacatcgtggagtgatgtctggaaaaatacaaactggccaaacaccactgatcaacaggaacccggagaagcaaacaaatcaccaaccatccaaaaacgaaaacaaaaaacaaaaaaatagaaagaggaggagagagagaacaaagtattacaatataatagtcattttttttctacctaaaagaggataggtgccaattggttgatattactgacacatgtacttcaggtcataaaagaagtgaccatgacctaaagcaataaaatattaagacaacaattcttaaaaatataaatgagcatagcatttaatttggatcagaaatcataaaattgatgattaatactttatagtaactacttttggcttttctcaatggtggtttgattcttttcactttgtgactctcttctctttttctaattttttacctcctcctttagataagatagacacagttttaattcaggggattttttaagttgtccttaaaaatgttattccattatgagtaataatttcattagaaaaagattagcgagattcttttcagatatagtgtttaatttatattctaagttttaaatgattcctaaacatttattgttaatcttctgccaaaataaagaaatattatttatgattcctcagcaattgagatatcataaaattttgcaaaataattgctcttccatggtaagtacagttctgaagtacataccaacagagctttatagatgtgtctttttcctccatttttacttatcctttaattacatactaaacttacatgcagaatttacccaaactaaaactataaagaacctgtttcaagaacagaaatcagtttgctttgtgtttttttttcttaaataaaatcagtaacaaaacttatccttaaaatatttcattggtaaaattgtggggtttaaaagagtataattttaatgaaaatttaataatgccaaagcaaggtcacttttataaatttgaaatcacatgaatttaaattgttcattccatgagtatatacaaatatatttttcaaatgctgattcaaattgtatacctcaaatgaaggctatggacatcctctggtggtccttttactaacaggctaattcacttgaaacatggttacttttgcatatgaattcaggtatacacataatatggcaaacaaagctatatgtagtttttaggcctgtaaaaataagctggtgatctcagtccagttctttgtggagtaaaagaaaatgaaaatattaacagatacagcgatgtttctttgaacgtttctgaacattggctgtgctaaaatttgtcaataatcctccttaaaatatttcctagaagtcatgaatacaaatttatgtttccacctaaccagacacatgccgtgaattattttaatggtttacaagtcatacaaacattttgaattcagacctttttaaaagatcccaaatttgttccaccaaatcccaagctacttccaaaatactccaaatatatatatatatatatatatatgtatatttgttttctaatggaaagaaagagttaaaggatgctgaattgtactatgtatatacatacatatgtatatatatatgtgtatatatatatgtatatatatgtgtatatatatgtatatatatatgtgtatatatatgtatatatatatgtgtatatatatatgtatatatatatgtgtatatatatatatgtatatatataggaaaggttttgttttctgtttttgcattagattagtgtttggatgatcctgttctcaaatatgtcttaagaagtttctattatataaagcagattgccattgccttacaaagtagccggaaaaaagaaaaaaaatggtattttagtctaatcacgggaattttgttacatcaagcacactgcccaaaaaggctcttggcatgtaatttattctttctcttagctttttgggaaatcattaaggaaaagtacaataccgcatcctttaactctttctttctattagaaaacatgcccaatttccttgcaaaccactatatttacaaacatttaaaacaactaaaatacacaggtatccaagagctttttctgaggaaaaagaaaaaaaaattcatctttttttttttttttttgcctttaggcctcttctcaattattgtttgtatgcagataaaacagttttgcattacctctaaactgaatatgttgagactataactgttaataatgcagccattaaccccacatttttgtatcatattaagtatagaaaactgtagggcatgctcttttaagtgttaataatttgtgcttgtaatttgttgtagttattaactcggttgggagagttgagaaagctaggagtgggggagtacagtgctgaatcttgccttattaagcaatgagcaagccacttttctttaaaagcaatcaactctgcattaatatgggcaattgaaattttaaattaaaagtagctttcaccagaaaaaaagttactctgagaggatatggaatcactatagtaaagacaaaattttaaagtacatgcctagtaagttattttgtagtatgaacaatgaagaacactaacatagtgatctgatttcccacacattatcatattagctattgtctcattaaactgatatattataataatgaacctaatactcccagtcagaagtcttaagaactaagtgatgactctcagatttgcttctccattctgtctgtaaatgtcttaatttatttagttttttaaggtgcaaacagcagtaggtcttctgattctaaaatgttctgaatagccaaaggtatttgcctggttgaaagtgatgcaaggaaaatgtgtaagagattttaaagtggctcaaaagattactggttattgtttttttgaaagaaagttgtccagcaaattgggttacttgtgttaaatggagactgtggtataatgcaatggattattgcccagtgaacagatttattttgtctctatgcatctatttgtttgtaaattcattttaacattcctgattatctatcttatctacagatctatctaatttatctattaaccatctattatttggttatttgaattctcctttgaaccactgtaacatcttactgggtttctcattatttaactgggagttaaataaaatttttgatttaaatatcctttatatttatatgagagtcataattatgctctttttaaaaattacctcttaacactgacctgatgctggtgcctcaatccaatgggtagaacacccttttatttctaggactacaattaaccccaagtctgtgctgattatgccttttgcatgattaacaagctccgtggtggtctgtttcttcatttccaagcacatacagaattccctgcatctcagctccaagcttcttttctgttttcttaagcatatagatttcaaaacgattttgctctcaagatacaagagtaagctgtatacatcaagctatttcttaagggaaacactactcattttttttcttctttaaacataatagatgttaaagaaaatgtttttatctcttttgttgaaaaaatcaatttttatagtggtatatatactgtagtaagctagaaaaaggaaaccagtaagataaaagcaaacataaaaattatctagtttttatgcctgaaactatatctgagcctattatattttcatacattgtattttagaatagagtttattaattccaccagcattagttgattctatgatgtgccaggaactgggttaaatgctagggttaagaaagtgaccagtacagatagggtccctgctctttaactctattaattatatttctgtttattgatgtggcagcttttctttattccacccatgaaaagatgttaggctggccaattaattataaaccaacaatagggaactttgggtacatatttccatgaagagtattgctatactgatcaattaaatccattcttcaaagcaaagcacctactaatctctaatggcaacattcgtggagttctcgaccacatttttaataaatctataacttagattttaaaaaaatcactttaaaagtctggagaaatcacttagaggaaaactaatttatatcacattgctataacctttatcccaattttaaagtattttcctagttcattttctcccccatgaataaattcagaatgagacaaggcagtgtatctatctactctttcttgtagacaaagcaagctttatttgacatctaatttttgaagtatccatccaaataagattgagaggtagggttccattgactgagaaagtttgcataacataaattttcatttaactgtttcaataagcatttgttttctattctctatcaaaccctgtcgaatcctttttcctttggtcacattcatttaatacctgagacttcatccaatttgcttaattaagccatcccaaatgtaaatcaataaatgatgacagtgtgtaagatggcataaagaaactcttgagcattagcatagataactggcagaattctcactacagaccaacagttaccctgaaagcatcactgtggaaacagtatagtgggtgcctggaatatgtcataatgcactaaaatgggttagtgctcacaggggagggcctttgcttagaacatgaataaatagaacaacaagaatttaaagctcccttttccactaaactctaatctgcaatatggttgaaacgttctaccactgctagcagtctctcctcgaacaatgtttaatcaggctcttctgaatcctcttcccaactaggccctgactattttacttctgtgtctgtctttgcattgtccaactttaacaagaatcctaatgagctggtttagccaaaacccccttccctcaatgtctgattaccctctcacctccaccatcccccaggtgatatctgttcaccctggtttgctttcaccaacagtactgttagggtggtttggccagaatccccctcatccctgatgtttcctcttaataattttccatctactgacctccatcctgcttcttgtctataaattcccactttttcttgctatatttgaagttggctcaatctctcttctctactgcgaaacccatcagagtagttcatatgcctatcttgatacttctgaatagtctatttgatacagtttggcttcatcttcacccaaatctcatcttgaattgtaatcccaataatccctatgtccccctgagaggtaattgaatcatggaggttgttttccctttgttgttctcatgatagtgaatgagttctcatgaaatatgatggctttataagcatctggcattccccctgctggctcaccctgtgtcctgctgccacatgaagaaggtgcctgcttctcccgttgccttctgccatgattgtaaatttcccgaggcctcctcagcaatgtagaactgtgaatcaattaaacctttttcctttataaattacctaatcttgggtatttcttcatagcagtgtgagaacaggctaatacagtaaattggtaccaggagtggggtgctgctacaaagatacctgaaaatgtggaagcaactttggaactaggtaagaggcaaaagttagaaagttttgagggctcagaagacagggagatgtgggaaagtttggaactccctaaagatttgttgaatggctttgaccaaaatgctgatagtgatatggacaacgaagtccagactgaggttttctcagatggagatgagaaacttgttgagaactagaataaaggtgattctttctctgctttagtaaagagactggtggcattttgcccctgtgctagagatgtgtggaacttactttgaacttgagagagatgatttaaggtatctggcagaagacattactaagctgcaaagcattcaagtggaagcagagcataaaagtttggagaatttgcagcctgaccatgtgatagaaaataaaaacctattttctggggagaaattcaagccagctgcagaaatttgcataagtaatgaggagccagatattaatccccaggacaatagggaaaatgtctccagagcatgtcagagaccttcatggaagcccctcccatcaaaggcccaaaggcttaggagggaaaaatggtttcctgggctggctcagggctcccctgctctgtgcagcctcaggacatggtgccctgcacccagctgcttcggctctagctgtggctaaaaggaaccaaggtacagcttgagccattacttcaaagggtgcaagtcccaagccttggcagctttcacacggtgttgagcctgtgggtgcacagaagtcaagaactgaggtttgggaacctctacctagatttcagaagatgtatggaaatgtctggatgtccaggcagaagtttgctgcagggtggagccatcatgaagaacttctgctagggcactgtggaagggaaatacgggatcagagctcccacacagagtacccactggggcactgcctagtggagctatgagaagagggccaccgtcctccagatccagatggtagattcactgacagcttgtatcgtgcaccaggaaaagtcacagatgctcaatgccagtctatgaaagcagccaggatgggggttttaccctgcaatgccacagaggtggagttgcccaaggctgacagagcccacttcttgcatcagcgtgacctggatgtgagacatgaagtcaaagaagatcattttggaattttaaggcttaatgactgctctattggattttggacttgtatggggcctgtagcccttttgttttggccaatttctctcatttggaactggtgtatttgccaaatgcctgtacccccattgtatctaggagataactaacttgcttttgcttttacaggcttataggtagaagggacttgccttgtttcagatgagactttgaacttgtacttttgggttaatgctggaatgaatgaagactttggagaactgttggaaaggtatgattgtgttttgaaatgtgagggcatgagattggaagggaccatgggctgtgtcctcatccaaatctcatcttgaattgtagttcccataatttccatgtgtactgggaaggacccagtgagaggtaactgaatcatgagggtggtttccccatagctgttgtcatgatagtgagtgagttcttatgagatatgatggttttataagtgtctggtatttccgcttctggctctcacttcatcctgccaccctgtgaagaaagtgcctgcttctcctttgctttctaccatgattgtaagtttcctgaggtttctcaagctattcaggactgtgaatcaataaaacctctttcctttataaattacccagtcttggatatttctgcacagtagcatgagaatggaccaatacactattcttctattgtttaacaagtacacgaatgatttctttttaaaactgcctaagcaaaccagaaacttttggaagtcacttttaatttttgagccatcaaaataactagctgttacattatatagaggttcactgatttagcaattaattaacttgaaacgaggataatgaaacaaatatggacatgattaccataattcaatgatcaggattggagttattgaattaaaaatgaaaattgaatttatgtaaattaatatttcaatttgtttgtcatttttttctcagaggggaataattctctgagtatcctaatggcatgacagtgtcagaaaaaaaaaactgagacttagactggggcatggttaagggaagagattcaaatcctatgtagaaggtgatggagagttaaaattaaaatacgtaagaggttgtagtgaattcagctttggtttaaacctgtaaacctgttttgatataaaagtcttcaaatttggtggagtaagggcagcaggtctctctggaagcaactctagtagtcagaaggatagtgccaaattaatgaatggtgacaatgacagtgccaatcaaagcttgccaaatgacaagccctctttgttgcatagaagaatggatgaagcaacctaaagattatcagcacttatagctgagcagatttaggaagattaatgttttcaaatgaccaacttatgtgtctgaaatgtcctgtgatattaaggtatttcataaaattgcttaataaagagttaagcattcaatttctggaatcagactctcaaggacttaatccaggattaaccacatgggaaagcctcagtttcctcatctgtaaaatagggataataaaagtacctgacctcctaggattgatgtgaatagcacataaattaatacttgtaaaacattttaaacagcacctgaagcagtaataaatgttagtcaccattactagtaactcagctttgtaaatatatatgttcctaattcagtcagaaaacttactgataggcaaaatttaattgaacttttatgtgagcatatcctctttcattgtctgctttctatacatcagtatttagtaaaaaagatagaactgcctgggtgagatgagtactccagctattttaatcaagcttagtttgtcttaagacttcaagatggctatgcacttctctgtctacttgattttacattctatccttttggatgaaaaaggaaaatgtaattatcagctttcttttggggctaagaaaaggggagcaaggtgagagtgcattctacctttgtttttgtttactccctcaatcttaattccttctgtttcaacttcatcacaaaagaaatagttccacatagaaggaagtcggtgcagaaaaggaaattagaaaatatcataaattcctattagatctatgtttgattctcaacatgcttactactccttttgcaaaatctacacattgttttgtatttcagggtttattttgatgcctatattaggaactgagctggtttgccactttgttaaaaattgtatcacccctgttttgctcaattttcattttattaccaacacagcacagatgaaaatgcacatgtgcatccacagtactgacagaacagaaataaagaaggattcaaatcaaagatgggtagagtactatatttcactatgtgtgaaatcataaaaaattactgttggtaacacaagctcttataatgtttggctacttttatgtgaatttctgactcgtattttcttttttattattattatactttaagttttagggtacatgtgcacaacgtgcaggtttgttacatatgtatacatgtgtcgtattttcatctcatatgaatattttaagacaaaatattagacattttcatgaatgcaaaatgcttcccttttaaatcagtaacatacactgtgcagaactgtttgccctccatactgtatactctgaactgtgaaagtacttattgtataaatagctacaaatttgcattttgggatcattataccacttgtatatcatgattttaaaggctttatcatttaaagattattacaagatgtgcaattaaaacttcaattttatgaaaaacaaataaataaaagtgtagtattatgaaaatttactttcaaaagcatcagaaagccagaatcttaaaaatcagtaccaaatcaaatcaatgagctactgttttttaaaactatcatctagcaatggacaagtttagatagaagttacattaattgattaatgaattaaatatccctaatcccaaaatcccaaatcaaaaacgcctcaaactccaaatattttttggtgctgaaatgacttcacaagtggaaaatttcacacccaatgtcatgtgacggtcacaaatattatttaaaatattgtataaaattaccttaggttatgcatataagaagtatatgaaacataaataaattttgtgttcagatgtgtgtcccattccccaatatctcattatgtataagcgaacatttcaaaatccaaaataattggacatctaagacacttctagtctcatgcataagggatgattagggatacttgactgtactatcaagtgaaacttttattaatagtttgaaaacttttatattttctacatatcagttagattccaggcacttatggttattatcatagtacaatagcagtaaacatactaactcacagtgagctgcgttatgctgatttagcattttaaaatctccatgcagaagcatggctccaccctagaatgctggggccaatcctgcctttgagcaaaaaagtctggagtgctaagtcagcaactcacagagtataatgagaccattctggctctgaaaaataaatatgtgaaaatcttaatatgtattgctattttgtagtaattaggaaatacaatatgttattaaaaaattcaatgatttgactatggtacccaattatccagtaatttggtagctccaggaatctaggtttgctttgaacttaacaacaataaatggggtcgtaatttatctttctgttaacaatttctttgtgtgatacttttgtcaacccataaactaggtttgctgactaaatccataatatctactttcagatttctctaaagctagatttctgtctgtattgtgaccatttgcctactgtcaaaatttcaaaactgcctatttgacatattttaaatgtatagacattaaaaaaccatcttataagcaaatatagtttaattttctttaattgttccaggagcaaatatctattccactgcaagccagaagtttatctgcaatttggcagttgtaacatttcccagaagttgagaattaatttggtgtttaaaagcaaacgaaataaagaaaaacacaataagcgattccattgtatgtttaaaagaattaaaacagaaaagccaaataaaaagtttaaagtgttcaaatatgttattagcacttttgttttgaaccattttcaatttgaatgtgtgcttttatttaatcacctttcatatttttttttacacattttgtagaacatgtctgccaaatcccaattaggtcagaaagattaaagccagaaaaacattctcctatggactataaattaaattactgggatttattttattatgtaaaatttcaaacatataccaagtagacataatagtaaacacccatgaaaccatcacccaacttcaacacttatcaacattatgccaatcttgtttcatgtgtctcttcctatccgacctgtatccccaacctggagtacttttaagcaactccccaacatcatattctttttccataaatgctttggtatttgtctctaacagataaaaactttaaaaaatagccacaatataattaccagatctaacaaatttaatgataatttctttatttcatcaaataactatttcttgttccgatttccctgattttacccaaaaatagtctttttatagttagtttaatcaaatctgaattcaaagtccatacatttcattcgattgatgtgttgctaatgttacttttaatatataaaatctataacccacatcttatttttaatgacatatatttgtgaaaaaaaatgagtcttttaaagcagagagactaaaataggataaaactcaattgaacaaaattttactggcatctagctgttggtgagagttaattttataaggttattaaagaatgtaattcaatttgtaggttacctctagaggtgagagagatactatgtggatatagttcctggcccccctagctcctacttcagttagagaagttttgtttctctccgctttatgtgtgggactttgacacacaatttagcattatgcccagattcaagctcttgctttcattgaattctttaactccactctgcatgttgcctcctacgcacactctgccatgccttttctgcaggcaaagtaccctcaacccctcaactttcaaagttccatttactaagggctctttcattggcagaatgtacagctatttcagaataacaggtggaggggtacaccatatgtcaacattttaaaaaaggttcttaactttgcaaaaaaaatcatcaccagtcatctctttaacttgggctctagctttatgttgagagtcatgtttgcacattttttttttaacagaaggaattccaagcttacttattctcactataaaatgctaccattctttggcacttattttgccagactaggctgggcgcagtgattcacacctgtaatcccagcattttgagaggcctaggtgggaggatcactttaggtcaggagttcgagaccagcctggccaacatgatgaaaccccatctctactaaaaatacaaaaaattaggtaagagtggtggcacgtgcctgtagtcccagctacttgggaggctgaggcaggagaattactggaacccgggagccacaggttgtagtgagccaagattgtgccactgcactccagcctcggtgatagaggaggaccccctgtaaaagatatatatatatgttatatatatgtaatatatttataatatatattacatataataatatatgtatatatacatatgtacacatatatgtaataatatatgtatatatgtaatatgttatatatattacatatatatgtatacctatatatatatattgccagaccaaagtctattaaaaatttccaatgaaagtgagagaatttgctcctggtagaaattgagaaaatgaataaaaaacaattttaaatgaataaaaaacatttttaaaaggtataatattaactagttatcattcattaaacccttactatatgtaatggactgtgcaaagttctttatacatatcagcttcattgatcctcacaaagacctttgaggtaggcactatcatctctgttttgcagataaaaaaacaaacaagacaactatcaaaaaattagtaagctaaaaagggaaagaactaagatttgaattcatagaatatgaatttatcttaagcctggtctcttagccattatcctatagagcatggcatcatggagtgtactggtggacaggtcacattaaaaactactgagaaaacttaaggtcaaacacaacaattaagacacatgataaagaagcagaactgaaagaaaagagtgaattattttaaggatattttgctgaaaagatgggggaaatattttataatttatttataaatacattcatcctaaatggccaaattattatttagtcatcatgaataatagaggaatagatttctattatcttaaaaatacacacatcatttatataaaatgtgttctgaataaataaggtgacatattctgcagacttttagtactttcaggaatagattttagaattcacaggagtagcagaatctattgagtaacttttattttcacaattgttacaaagtaaaacgttagtcatagagagttggggatttgcatttctacaaacccagatttgacaagctttgctacttcctggtgtgtgcccttgaacatgctactaaacttttctgaattgttttcctaatctgcaaaataatacccactcctttggattgttgtaaagattaatctgtaaagcatcttgcccagtaggtagacgaaacagaaaatgtcactcacatgtacactcccaacaaatacaccatattctgtggcatttctagtctgttatcttacaaattcaaaattaatattgattttataaataaatcaaattaaccacttattgtttaactctgtcaaagacaatgatcaacagcaaaaacaagtaaccttaatagaaacaaataagaaaacttaaccctggaaacagataaggatgatagaatatcaatgtgggaagaggttttatcagtcatttggtccaatttctcagatgctatacatattcctttagttacttaaccttctccagagagtacatagacacagaatggaacataaaggagttattgaaataaatctacagaatgtgtattgctgaaggaacacattgatttgcactagcagacaaatggtcttatgtattgtttcagttcgcccaaagactttcctttgatagttattttttttttcttttcagaaacagtcttaaacaatatcatccataaccaaaaagagcaaaaatataataatttatgctaacctgggaaggtgaacacttctaaatacaaccaaagtaacacatctcaccgtggctatttcaatctttgctatcactgttgtcatcttcatcactgatttttggcaacattattgtcatcatcatcaaaagcacataagagtcacctgtaatttcattccaaacagccacatttttattaaattagttactatttggtatgtgcaaagcactgcactaattgctaagaaacttacaaatggaaattctagatatcataaacattgatatatttcaggctagagtgcagtggtgtgatcctggctcactgcagccttaacctcctgggctcaagcaatccacccatgtcagcctccctagtagctgggaccatatgccaccatgcctggctaagttttgtattcttttgtagagacagagtttcaccatgttgcccaggctggactcgaacttctgggctcaggctaaagatacttttgacaagaaaatcatttaggtatactaatatgctgaaagaaagttgagacttttttctttacttggtgcacatgtaaaactaatttggattagtattactagctgacaagcaatgagcctattaatgtttgagcctctacctcttgtcccaaagcttttatatatatatacatatgtaagtattcaagttccatgcgttgtctaggcctggcagaagctgtgaagtatggaatcgttttaaattacttaatatgctataattccaatggaagtttctcatattacattttaacaaagtttcatacttatacacgcaaattttattcatagaattctataaagcatttagcctttaaaagaagctgtgtgaaaaatgttttggattctattcaaagggaaaatggttgaaaattaatgattttgtatctgaatgcaaaaggagctaaaatagcatcacctccactcctcccaacctacttgcaggaataattaacgattcaaagcccagatcgacggccaatagaggaaaaaaatagttttaagatatgattgcaaaaaacaacaacaaccttatctatttactaattggttcctagttaccataccaaaggcaagaagaattaatagtaagttctaaacaaatatttaaaaattaattttaaagcagactcacattatcattatcagtaaaagaaactataaagaacataaattatttgcacatgtgacttactttgtattatgttttggtcttcaatggtttacaaagccatggtaactcacttcaaaacacaaatggatctttttaaaacaatgaattaaaccttattctcaaggtttgttaagactctcactagagaccaagaataagataggtaattccctaaaattattcagtttccctaactatgtcatagcttgatccaaattaggatcagaacattttttcttcttttcatgttcccattcttctattttattttattttacttacttatttatttatttatttatttgaggcggagtctcactctgtcactaggctggagtacagtggcgtgatctcggctcactgcaacctccacctaccaggttcaagcagttctcctgcctcaacctcccgagtagctgggaccacaggcatgtgccacaatgcccagctaatttttgtattttcagtagagacggggtttcaccatgttggccaggagggtctctatctctcgaccttgcggtctgcccacctcagcctctcaaagtgctgggattacaggcatgagccaccgcgcttgacctattttttatttagtaagaatgttgtttaaatgtttcttaaatatcagttattctgaataagtaactacattttacttctcagttgttagttgttaaaaattctttacagttaaatgatgctggaacccaactagtaataaccattaatcaaaaagcctcatgtaaataggatcattatcatttattttacatactatgatattccaaaatagataagacatcctgaaaagctttgtgaaagagtcatgtggctaactaatgttttgaaagatatctagaaggttatattctaattttaaatggtaaatattctgacttcaaattgtgaaccccaatttttttcatgttaatttggacttaatttatagattcagcaactcaaagtcagtggagggtgagaaggagtcttaagaacaaatctaaaggaagcctattgtctttcttgcatggctatatttgctgtactcacttatctgtgaggagtttaatctgtattgtctcagattttacttgtaataacttgagtagtaggtattcttatgcatattttgaggatgaggaaacaggcccccagctaccccaagggagacttatgctgctaacattcatatccagtgcctcttgaattaatagctactcactttcaagcactgttataaacaattccataccaagcatattgacagtcagattagataattttttaacattccccactgtggtaaaactattttcatgaataatcacaaatgaattaataatactggccagaaaataaatatagactgtgaaaattttctattattaaactctgtgtgtgtgttaaaatagtagtaaaaaaatctcaaaataagaaaacaaatattaaagtaccaaaaaaaagatgaagtcatacattcgttacataagtgtatttttttaatgggaagaaacacacactgaagtttggactctattttagtcttctaaattttaagcagaaacaaaaaatacaagtggttacatagaattccatcactgaaataagtcaagttctatttctttgtcttacaattactgttccatcatatactgtctgaatgcacaaatacatagtaaaatggagctggagacataaaaaaagtgagctgcaatagtttcaaatcattaaaactttactctgaaaatgattgtttagcttaattctagtgtgtcaaggacaacaaataaaataagataaaattccattggtgaatttgagtgtgtgtgcagggggtggggagtgagggtgaaaacttttttttaagcacattttaataggtagttggtattgattgtgaaccttctatattttttggaaacaattcatttcatcaaagcaactaaatataaacatagtcatgtttaattattttactgttaagtaagaaaagctgaaacaactgaattattccatttggtaaggaatgcctggccactctgtgactcttcttcctgaaacccatgaagccagacttcacagattgatacccccaagagcatctcctaattgtgatttttctcccacttctctgactttgcttatgctagactatctgatcttcttagctaatgtctattcatctttgaagactcagctctggtgagctatcaccagatactatcattacctcagaatttatctgattaaggtttgctcaaatacttttccattgtatgcactgcttattctggtcatataaattattgcactattttgaaattctgacttacatatatttttccttcactactttagattattcgtgtattccagtaactacttccctggcactaacaacacctttgtgcaatgaatgtggaaactccaattatgtacaaaaaataaaatcagaaatgctaagacaatgttttcactcttttcaggtaatcgtgataccttgcaatcatttcaaataccaggtgttcaaaagtattgtgtcagcatggctctcctttttcattttatttgtttttacccacaagtagtcaatattatttaagcaaatatcaatcatatctgacagagcttccttaaatataaattgagctaccacaagttactttaaagaaataacaaaaatgaggatatttagttcagttcacttgtgattgatggcttcctgtcttgaaggaggcaacacagagtgctacaagtcaaatacaaacaagctgcctgtctacaactaaactcatctttgtctcccaagtctttcctgacttgataaaagatatatgctgatatggtttggttgtgtccccacccaaatctcatcttgaattgtagtttccataatacccatgtgtcatgggagggacccagtgtgaggtaactgaatcatggaggtggttacctccatgctgttctcatgacagtgagttctcacgagatctgatgttttcataaggggtttactgcccctctccttcacactgcatttctcctatgctgccaccacgtgaggaaagacatgtttgcttccccttctgccatgattgtaagtgtcctgaggcctccccagtcctgaggaactgtgagtcaattaaacctcttacatttataaattaccaagtcttgggtatttccttacagcaacatgagaacaaactaatacatatgtcttgtcaccaaattcattcatcaacatttatgatgacctactgtgtttctatgctaggctgtgagatgcagggtcagcttcatggagcttcatcctacagtatatctttccatcagcttcatacatagaagcattcaggtcattactttgtatcttctaaatgtgtcttgattctcatctaccacattctcatgattcccttcattacatcttcaatgcaggcccacaccatctctagcctcgtaagtaaagttcctgtgtacaaatcctgtccaaatccaatttattctccacacttttatggaagtgattaatctaaaatgcaaatatgatcatgtcacttccctatataaggcagttttgctgtggaattgagcagatgggctgcatcaatagtttgatattttcacatttcccccagctatttccttggcatttaatttctaaagtctatctagaatcctggcaccatcactgcaactactatttagaaaaggattcatgtatgctttttaattttctgatgtaaactctaggttattaaattctattagtgttttattaatgcttgttaagcaacaactgttttacaatttcagtctttatctgtaatttagtttctggaaaagggatttggaccaagctaaaacagagtatacaaatgtaagtacaaaaaaatatattctcaaaacagagatatgttaaagatgtattcttaacatagagaaaataatttcatcacagagggtaaaaacttggatataccaaacaaccatgggagatatgatctggggaaaaaaacaagaaaacctgaaaacttgatctcaaatttgcaaccacattagaaaccaggttaatatccaattattcaacaaatatttattgagaactgataatgtacagtgtaaatgaatattcctggagctgagaatatacagctcctgccttcaaaaatttcacaggctagtggaggagtccaatacattagcaaatacttaccaccctgtatgctaaattcagtggtggaaattcttttcttggtgttccattcatgtgactctttacttagaatgacttttctcttcccctctacatatatgacatgtatcactttgccagcagagaataaggctcatctgttccgtggatcctccctgaattctcattattccaccctaccatgttcataaatcacttgaacttaatgggcattaatactggcaccacccattctgatctgcatgtgttgtctttagttttttctttttaattaaatttttttgaattgatagatacaattgtatgtggatatttattgtgtacaacataatattctgaagtttacatgaattgtggaattgttgaacccagtcaactagcatatgcatcacctcacaaagttgtcatttttgtggtgagcacattttacaaccactctcagaattttttcaagaatccaatatatctttaactatagtcaccatgctgtataatgtatctctagaatttattcttattatagaactaaaattttgtatcctttgaccaacatctccccaccttcccaccccactaaatacctcaacccctgttaaccatcattctactctctaattctgtgaaattgacgtttttagatcccacatatgacagatcatacaatattggtttttctgtgcttgggtaatttcacttaacataatatctttcaagttcatccttgttgttcttatttaaaggtgatgtctgatggagaaactctgtgcttcatgttgcatgtggcattggggacacaagcaaaaaagatatatatatatagttcaaggtttcatgaaactgtggtctagcatgaaagacagccattaaatatcaaaacatagacatatgaaatgagtgctatgaccccagagtgtggcaggacaacataaaggtacaactaacatatttttgttattactagtatgaaaagctgtaagaatgactttaaatggctcctcctacctggatttcaattaggcagagagtttgaaaataattttggtcatcattaaaaactgtgtgacacatagcctaaagtcacattgaactttactaatatgcagacaattgataatttaaaatgcttatgattaaaatattaaaagcaacaaactcatttacaaacatgaaagtgtgtaacctctgctggaatagatcatcagaaattttttttctttttttaataaaaacttaaagtttaaaaattatcagtgatttttcagtaaacaacattcacagagaagccactatcctgtggactttataatgataagaagaaattgaggtcaaagtttctgtattttagcaacaggtgggattaaaaaacagtagtgtctggtggtattatctctaatacttcttgcataaaactttcttacaaagacctcttagaatgtatttaattttgtcctacacatccaaggctgggagaaaagcaaacctgtttttgaatcaaatacttgtacgaggaacatcaggtaggaagcgtctacaaccagttttctaactccgcttccatattttccctattattactctctttcccaaacaaatccaagaaattagccataaagagactcaaatgaagagtgacaaaaaaacagattaagtgggaaaaaagaaagcagttattaccaacccccagaaacttccccataactcttcccaaagatagatacattatctcatgtaagaaaatgttacatgattaaattcactcatttaggtaatcagttataataatcactatatatgccagatactgacggcaggcctgaagcatgtgcgaatcctcaactagctgataatttgttgccttttcaaatcaatactatttaattactaactgggatcaggaagaaactgctttttcagtaataaaaattatatatatatattttatgtttaggatatgggatttattatatgaatatcaattcataaaagaacacttatgaactagaaggtaaatatattaagaggtatagtaaactggtcacataaatcacttggaaaaagcctatgccaagcattagtaagtttcagaatttcaactgatggcaactgctgattttggataatactcagttcactggtctagagattgatggtgcggactataaaatgtaatatggagccacattagcctgtcctaaatgtactcaagagagacaggtcaacagagggaaaagggatttaatttagttgttacgggtgtttgtgtgtatatgtgtgtgtgtgtgtgtgtgtgtgtttactttcacttgaggtaatgaaggattctagatgaggataggatcaatttttatttctgtgatttaatgctctgactagttgtgcaagctctgccagccccaaaatgtggctctgaagataactttagaattattgttgtcaagtcattccctgccctcacagatatttaggttaacttcattagactataggctattgaaataacaaaaggaagaaatgaaactgaaagaagcttaaactacctctggatattgacattgatgtctccttttggttttaatgtttaaaaggttaacctgaaagtcagattctactactaaatataaaaattaatttttaagtttaccaaaaatcaattatactttttgaattttatttttgttttaagctgactggcaatataaaaaataggtgaatatttttgttttaagctgactggcaatataaaaaataggtgataaaaaataggtgatttttttaagaataattttctaaaaggtaattttctcactgtatatgtattttatacataaaacatacagtacactaaaagttgcagattgctagtaatgacttagagaaaagggcaataggaaaaatgaatggtgatgaggtatggtgcgtgtctactgttcaatttctttagagaggtcgagcttgaacagcgaaatgatggatgaattctgtatagtgcactactcaataaatatatgaaggccaccttgagctgtgaaatctactctctctacaaagtgaaattatttttagctgacccatgcttgtcaccctgaatgtgaaacttgctgtactttacagctacatactcctttttgaggattgactgcctctgtggcaattgttcatgaagttctacatattgagtcatattcaccacaagcacaaatataccaaaaatgggatagacaatagacaaagcttagtaacttttttctttattttcatactaatttccacacctctatgcacagcttgaaaatcttttctctcctctctcttggagaatctacctctcctaggccccagtcataaactttgacactttgaaggtttttactttcctttcacctctctagttttgtctcccattctctcatcttttgattctacattacacaatcccactgaatcatttgagaactaacaaatacctcctacaggtgaaaaaaaaaatgagtgagcaaagcaacaacccaaagcaaggcagagggtaaagctaagactattccatatgttaataaatattttcctgtaatgcaagagttggagattcatgcctatgtcatgttgtattgttcttcactaaacacggaagattgcacaaactgaaggtcaagattccttaataagttataaaatttattcaacttattttactttattttagggtcttgctttgttgcccagtctggagtgcagtggtgccatcatatctcactgcagctttgaatgccagggctcacgtgattctcctgcctcagcctcctaagtgactgagaccacaggtgtgagccaccacacacaaataatttattattttattttattttatctaaatatagagtctcactatgttactcaggctggtctcaaactcctgggctcaagttttcctcctgccttgtccacccaaagtgttgggattaaagatgtgggccactgcacccagccagaatcaatgtattagatcaggacatgcattgcatttttaatgaattagactagtaaggtataggataggacagaacagaacataggacatctcagaaagaaagagaaagtaagtatgaaccggtttgggaagcaaaacacattttttaatgtgggtctcagttgaaaagtttggatatttggccataggtggtggctcatgcctgcaatcccagtagtttgggaggctgaggtaagaggatgtcttgagcccaggagttcaagaccagcctgggaaacgtagcaaggctccactggaaaaaaaaaaaaaaagagtttgaatttttataatgatatcaggtgctaaactattaatttccaaacagttacaacttaattctgaagaatatgttaactttttttgtaactattaactgagatcaaattacatttttggcatgaattacaggaacagaaaagaaactgtgacttcaattaaattataattccaaaagtacaggctaatcagttcaaacagaagtttgtatgaaagcaatgctatcattgtttatttagaaataaatgtatacagtaggctcatattctgaaaagacagaataacttagcattgcaaacagctacctttcaagggcagaaataacaaagaaataatacttcttttatgtattttatcagttgtgtgggacagaatatctgttcttgtgggaagagatgtctggggacatatttaggtctaattgttacctttaaaaaaaaaaacacagcagggcaggtggctcatgcctgtaatcccagtactttgtgagaccaatccaggaggatcctttgaggtcaggagttcaagaccagcctgggcaacatagtaagaccctgtctctaccaaaagtaaaatgaaattagctgatatggtgacgcatgcttgtggtcccaactactcagagtgttgaggtagtgggatcacttaaacctgggtggtccaggctgcagtgagtcaggatcatgccattgcacttcagcctaagcaacactgagagaacctgtcaaaaaaaaaaaaaaaaaagaaagaaagaaagaaaaaagaaaagaagaagaaaaaaacctacaacaaacctatttgaaaaataatcataactgtttgctttacaaatgactacagcagactttttaatcaagctaataattattaacttttgtatttagtgagttaaaaagcatagaaagccatctattttagtgctaagtttttttttgttagaatcaattacttcttttatttattgtatgaatctcctttatggttattgttgaatttatttgcaaaattccattagtgtgtgcatatggtataatagctattttgttttttcagtgggatatgtgggtttaagttgtcaaggaattgggtaggttttcaaatatactaactccagaacacattcatttgcttccaaaacaaacttggaggtgtttacctgtgcccaagcatttttgaaaagttattccagacagtgtgaagtggtacttgggagtaaaatctgacagatgtgagctgcaaactcaccactaagattccctaacaaagtaactttggacaagttaatgaaataagactaccttattcaattgatataaatattaaataagataatgcaaacccctggcataatgcctggcataagttcataatcacatttgtttttatacaatttacgaggcagagttggcatttataccaaattggttgtttgatttataaatggaaatttcagtctactatgctaatttgctatcatcatcattgctgttgtaagcactctgcaaagcatcttcctttaactttcctccaaaagtctaccagcatttttttctcctttatgaactcttcagtacttataatctatgccacataataccatctaaaatgctgtattgttattaatatttgtactttgctttttcccagaataagattgtaaagtcttccagaagagagaagaaaacaaaatcacgtaattccacttggcagacgtaaatttactgtgaagttaacaaagctcctacctcgcacaggctccttctaagaccctagaaaggaaccatcaatgtgttcacaaggatacattgttttataaaatttgcaaaaaaacactttaacaaattctttttcttaatgagggctccccaagtaataagctttagtacacacaaaacttgtatccattctcacctctggacatgaactcaatgaaaaagctcatctatttgtaaagttgcctcatacttgaaaatctttgacctaatgtttttaaacgaattcaatgacgagttcaccagagtagatcttcagtccatggtacatcttgactgactgcatactttcagcaaaaagcaaggtgcactttgttttatctattcttaagcatggtagagcagctacactcagagttggcaatcaaaatagcactgaagattttgcaggggaaaagaaaccacagacactgttacctttgggacaatgtttttgaaataagcatagatgtgattccagaaaaataaggtatggaaaaatgtagaaaagtagttatttttcttgaaaatagagaatacctttttgtgcgggtagatagcattgaattctcaagtatgccaattataataacaatactttacaaaaacaacaagaataaggcaaagtgctctataaccattatctctgaacaactctgtgtggcaggtattaacattcttgtttcatacatgagacaattgacacttagaattaagtaatttgcacatggctgcacagctagtaagagacaagctagtactagaagctagtctaaattttaaccattatatcacactgtatatgatgtatgccaaaactgaaaatactggcttttaaaagtagaattcatcatgagctcatttctaagattaattttctcaggtacatttcaatgaagtcagacccaggctctggaaactaatgaacttgggtatgatgcaataacttaaaatgttttttggtaagtaatcatttttcacagcagttagtggaatgcctactaagacaaaaacacagatggggcacattttttaacttgtatactttcaagataacttaaaaaatgatttacgtcttagatttaaaaactgtgtctgatatactatgctctgaaaacaatgtgcatttttcctctctgtattttttcactgagttgtcactgctaattggtagagatacaatcttgattatttctcaaaaactctgaaaagatgttttcatttttttgtatttatgaccataatgcatttactataggcatgaaaattatatttacaccattaaatttgaacataatttgtggcaatgccctaaataccagaggataaagataaatcagacatgacacactctcccaaatgacttccagtctaacataatgattgtcaaatagagtgcatatgagaatcatcttggatgcttttaatatttgtgagggagctgtccccagagaagattagttacaaaattgaactagaacctaagaaatctaaattttaattgctcctctgattcctaaatggcttatcctatcttgagaaactgatctaatgaaaaagacatgtgtgcaactaatttccatataaatgtatattaaagtaaatataataaagttataaaagatatttttctatgccttattctgattaaaaataatcagcatattcagtttccatttagaaagagagttactaggacaaagacatgaggtatacaggaaaaggtccccttcttttatccatgattatatgaattaaagtcattttaaaatcataaaacagaaaaatattgatagtactatatactacatcctatactgctaagtacaataaatttctcccagctatagtagtttttctgcttaaagaacaaaatttggaggataagctagatttttatgtatatatatgtatacaaaaaagtgtatgcatgtatacatatttgtgtatacatataaaaaaatatacacaaatacatatacaaagatatgcatatacaacaactgtgtatacatatacagatatacacacacacatttccctcctacttgcattgttattcagtagtaattgtttatttctaggttctatataaattttatgttagcgtagtaggagtctactgaaatgctgacatttcaaatatattattggaaatgaaatcagtctatcaataaaaggaaatgtgttacaaatgcacacaatgcagagacatatggcatttgaatgaatgtgaatgccattgtgagaagtcaactgtggatgctcagtgggaaatcctcatcattttgtatttagtctttatccaatgtggactttaaacttggctaaaagacgggttcttatttgagcacagctagagactgattaagttatgtttttaccataccctaatgaaattcactggatttatataagatttagtgcctaaaccaaaagggatatgaagagatatatcaacattctaatgttaaaaaggaatagcttttggagtaaaatcaacagttgaaagcagttgtatttcactgttttagatgtttcagatgtaaatcactaggtttaattatttccaacatgttccacatgtttctatcaatttaatatcatttccaacaagcaaacacattttgttacatttcattgattttaaatgtcataaaaagtaagagtaaaacagtagttcaatgtatacttatttacagaaaaagtttatgatttgaatatgctctttcagaagacgaaattgcagacaacttacatagcctttgtcacgacggaatatgtattcactaaatggatgaactaaggaatctctggattcataaacaaatatgtcaataaagcatgggaattccatgtgaccatattttcctctctttggagccatatatatatgtgtgtgtgtatgtatatatatatacacagatctgaattatatgaacaatataatttggatattgaaagcttttcttttataacaaaatatactctttttttcttttgtcagattttagtgctcttgaaaaacaatagtacaattggtagctttccagtaatttttaatgttaattcttacaaaaatgtcacaagtatggtgaattcagtagcattattcagagcaaaaatagcgaatgtttcaagctcgtatggctacatgaaagcccaagagagctcctctaccttcaattaacttatacgtcagcgatgtctctctcctttccctcccactttatttgtggtccattctatattacctagcacttgaggatacagttttatttaaagttttctatttgctgagtctcatctaccccacattattaaccctcgaagggcagaaacatgaacttccctcacaattctccatcatatctaacctctccaactatgcccaagcaattaccaggaccaaaataattatctctgatatgtttcttgcttctgcctttttcattccattcaccttgaaattttcatagcatttcagtgacaggaaacaaacaacaaaaagaaggcaagtgaaaatttacccatttaaatgtaagagcctgagactagttgttgccattttaagaggtgactgttgctgaaaacagttgatcaggaggtagaacttcttggagataaattttgatttctggttataaactctaacatgtgacagaatgctgacagttcagaattctgctggagtcactaaggtggtattttgagttcactgtcaacttctctatttaaatgactaaattaatctcattgatgtctcataatgtcctaaattttcaaaatgctgacattagtactaatttcagcatctcttttaacaaaattttctgactttgtcttggatttgctatttgaaatatgaagcaactgggtatggcagagcaatagttactttaaaaaaaatagtaaaccaagagaaaaaactctactggctttcaaaaaaatcttttataaaagatctaccatataaatcaaagagaacctctaattttctctagacaatgttaaattggccaacagggtcatgaatcatgttatccatctagatatagctagtgctcaacaggaaagactcataaaagggtagttagcatttggttaaataaatgaaaaaataattataaccccatatagctactaccaaattcagtataattgtgtaataagcttttacaccacatttctaatgagtttattaatactctttctgaatcttttccaaagtaggcactgaattctgaggaaggaagaatgagaataggttttagcccttagtcattgtcttgtactcttgctaattttacaagctgttgaacctccctgcttaaattttctcataggtaaattgtaccaatcatacttcctctgcatgcttcacagatatattatgataataacatgagattctgtacctgtaagcactttgaaaaatataatgcagtgtgatatacttttgttttgtttgttttgtttgagatggagtctcgctctgttgcccaggctagagtgcagtggcacgatctcatctcacttcaagttctgccttctgggttcacgccattctcctgcctcaccctcccaagtagctgggactacaggtgcccaccaccatgcctggctaattttttgtatttttgtagagacagggtttcactgtgttagccaggatggtctcaatctcctgacctcatgatctgcctgccttggcctcccaaagtgctgggattataggtgtgagccaccgtgacatacttttaaaataataattccattttggagaacaggaacttaataatgatagcataaaggcatataatctgtaggactttatatatttatatatacctttgtatacaaaaatacaattaattttgtactagtccattctcacactgttataaagaactgcctgacactacgtaatttataaaggaaagaggcttaattgactcacagttcctcatggctggggaagcctcagaaaacttacaatcatggcaggagaaagcaaacacatctttcttcacataatgtcaggaagaagaagaatgaaagaagtgcagagcaaagggggaaaaggtccctcaccaaaccatcagctcttatgagaactcactcactatcatgataaaagtacaggagaactgcccccatgattcagtcacctgccactaggtccccccccgccaacatgtgaagattacaatcagattacaattcaagatgagatttgggtaaatacacaaagccagaccatatcattcaagtctgaccctggcccctcccaaatctcatgtcctcacatttggaataacaatcatacctttccaacagtcacccacagtcttaactcagtccagcattaacccaaaaggccaagttcaaagtctcatctgaatcaaggcaagtcccttctatctaagagcctgtaaaatcaaaagcaaattagttacttcctaaatacaatcgggttacaggcatttagtaaatgtatcagttccaaatgggagaaattggtcagaacaaagggactacaggccccatgcaagttcaaaatccaatagggcagttattaaactttagagtttcaaaatgatctccattgactccatgtctcacatccaggttatactgatgcaagggttggattcccatatccctgggcagctctgcctctgtagatctgcagggtatagccacccctcctggctgctttcatgacttggtgttgagtgtccatggcttctccaggcccaccgctcaagctgtcaatggatctaccattgtgggatctgcaggatggtcgtcttctcacagctccactaggtagtgccccagtggatactctgtgtcggtgctcagatcccacaattcccttccatactgccctaacagagtttctccaagagggctccacccctgcagcaaacttctgccagacgatcaggtgttcccacacatcctctgaaatcgaggcagaggttcccaaacctcaattcttgatttttgtgtacccacaggtccaacgccatgtggaagctgccaaggtttgggacttgcaccctctgaagcaatggcccaggctataccttgggcccttttggctgtggctggagctgaagcagctgggatgcaggtcatgatgccccaaggctgcatatagtagggaggccctgggcctggcccatgcaaccatttttccctcctagacatccaggcctgtgatgggagaggctgccatgaacgtctctgatgggccctggtgatattttccccattgccttggtgattaaccttcacctctttgtaacttatgcagatttctttagctggcttgaatttctcaccagaaaatgactttttctttttacttaattgccaggctgaaaattttccaaactcttatgctctgcttccccttgaatgctttgctgctttgcaaattcttccaccagataccatatatcatctctctcaagttcaaagttccacagatctctagggcaggggtaaaatgccaccagtctctttgataaagcatagcaagagtcacctttgctcccgttcccaacaagtttctcatctccatctgagaccaccgcagcctggacttcattgtccatatcactgtcagcgttttggtcaaagctacaagtctctaagaagttccatactttcccacatctttctgtattctgagccttcccagtttctaagaagttccaaactttcccacattgtcctgtcttcttccgagccctccaaactgttccaaactctgcttgttatccagttccaaagtcacttccacatttttggatgtctttccagcagcacaccactctttgtagtaccaatttactgtattagtccattctcatgctgctataaagcaaacactgggtaatttacaaaggaaagaggcttaattgactcacagttcagcatggcttgggaagctttgggaaatttacaatcatggcagaagcaaatacatccttcttcacaagatagtaagaaggagaagaatgagagaagttcagagtgaagggggaaaaggcccttacaaaaccatcagatgtcatgagaactcactatcctgagaacagccagggggaccccccaccacccaccatgattcaattacttcccatgatgtccctctaccaacctgtgggtattacaattcagattacaattcaagatgaaatttggtggggacacagagccagaccatatcagattttttttggtaaacatttgagtaccgtttatgaagaaatgtgtattattccatttgcattgctataaaggaatacctgagactgggtaatttataaagaaaagaagtttatttggctcatggatctgtaggttagaacttcaggaagcttataatcatggcagaaggcaaaagaagaataggtatgccacatggcaagagaaggagcaagagagaggaggtagaggtgccacactgttttaaacaaccatgtcgagtgtgaactaatggagaaataactcattcattactgaggagggcaccaagactttcatgagggatccatccccatgacccaaacacctcctactataccccacctccaatattgggaatcacctttcaacatgagatttgaaggagacaaatatccaaactatatcagcatgaagtgtagtagaaaaactacaaggtttagggacataatcatcattatcatcagccttgcaatattgaatttacatccaaactctagcacttactagctgtaggatcataggcaaatttctctaatccttgatatctccatcttaaaattacatgatttttacctctgtatcacaaagatatttttcttttacttttacttcttttcctttttccttataactgagacaacttaatgtcccacaatatccattctcccctttgtctttttagttttaagtagggcaaatgatcatccagctcgagaatccattctctgaactcaactccctgcagcctaacgtgtttctctgactcagctctcatcaaaaaaatatgagcagaaatgattggtaaaacttccgtgtcccattcttaaaagaaaaggactttactttgtttcattcatttcacctttcccacaaacaggaatgcagatgtgatacaagtgagtcagattcaaacatgcagacaaggccaacagcctggcctaagggatgtcagagcagaataatccctgtagcacctgtctactatggaactgttatacaagagaaaaataaacttctgttttgtttaacccactgtttttgggggtctctagggtgtactttcttagtctctatcctaataatataatcccctttttcctttttctttgtccttctcattctaatgttatttcttgagtgcctccctggtgccaggaacttaggtatggatttggttagaaacttatgtaaagtgcaaagtggagtgtttaagacactagtgttaagtgaatgctgttcttccctcactaaatgccaagaactatagtgacacacaggagacatacaatgaataaggcctaactctgattcgtgaaccttacaggtaataaaacatacagtagcaaacggttattttgaaatgacttatctcatggttatttgagtataatttggccaaagtccaaataggaagaaagaatgaatgatacattaagagctgagaaatatgaatttttatagataaaagactatatttcaacaaaatcaaatttgcaaaatatattcatacaaaaaatctatctcaacagttctgaaaatgtccacaagaaaagagtaaaatatttatctttacactgtacaggggtgcagcctatacaatttcttggtcaaagatgttaaacatatagttttataatttctttttatgtttttttggttcatttgtttataaaagaagggaaaaaagtaaaatgagtagagaaaatgccctagttatctttatattaaatgtctatctttttgttaaagtcagccatattgatttcattgagaatgagcttcattaaggacaggtaatatctggcttaataatttttctctcaaaggatggcaaaatgcctggcccttaatattaataatagttacaatgctatttattaatttaatttattattaatgaattaatagtactaatattgctcattgattgtttattatgtgtcagaccctgcatcattatgttgacacatttaatcctcataacagccctataaagtaggtacaatatctattctcattttgcagaaaagaaaaatgaaaacaaagagtttcagtaattttctcaaattcatattgtattacaatgtagtagaactgagtaactatttttgaatgcataagttccacattattttttggattcactcaattgaattattcttttatgtatgtaaaaggagcatatgggaaaaggcttcaaaatgaagtgtaaggacaggtaacatctggtttaccaaacagaatggctgaaattaaaaagactgataatattaatgagcatgtggagcaaatcaaattcacacactgttagcaagtgtgtaaaatggttaaccactttgggaaactatttggcaatttttatgaagtttaacatacaccttccctgtgacccagcaatttcattcgtaggtattgactgaagagaaataaagagaaatgacaacaaaaagatttaaacaacagtgttcacagtgatgtggttcaatataggctcagactggaaataactcaaatgtctatcacaaggacaatagataaatgccctatggtgcatacaatgggatattacccagaaatttaaaaagtagagcaaactcctgatgcacacaataacatgaatgaatctcaaaaattttatgatagcaaaaacataaggcaaacaaaatagtgcatacagtaatatttcacttgtgtggcattcaggaaaacatcaaactaatttagcagaataaaatcacaactgtgcttcccaaggaatagaagggagagttggggaagctgatggcaatggggcacaggaaacttttggaaataacagaaatgctctttgtattgatctgagtgatggttataagagtgtacacacttgtcataagtcactgagctgtacacttaagatcactgtatttcattacatgtaaatgatatctaaaaatgtatgattgaaatgaaaaagaagcttaaaatagtaagattcgttttaacaaagaaaaatgttcaacaaaagacatagcaggccaattgtggtgactcatgcctataaacctagcactttgggaggccgaagggggcagatcacttgaggtcagaagttcaagaccagtctgggcaacatggtgaaaccccttctctcctaataatacaaaaattagctgggtgtggtgatgtgtgcctgtaatcccagctactcgagaggctgagacacgagaatcccttgaacctgggagacggaggttgcagtgagccaagattgcaccaccgcactccagcctcgttgacagagtggagtgtggagactcaaaaaaacaaaaaacaaaacctggacattgttaataagaaagggagaaatttttgctccatttttgttgctatgaaggactacttgaggctgggtcatttataaagaaaatagattcaattggctcatggttctgcaggctgtacaggatacatggcgctggcatctgcttctggtgactgcctctggaagcttccaatcatgacggagggcaaagggtgagaaggtgtgtcatggtgacagtgagagtgggagcttggtgggggaaggtgccacattcttttagacaaccagctatcacatgaactcagaacgagaactcacttaacaccaaggagatggcactaagccatttataagggatctgcttccatgacctaatcacctcccaccaggccccacttccaacatcaaggatcacatttcaacatgagatttgaaggggacaaaacatccaaaccacaacacagagaaatacactgagtcatttttctgtgatgagatatatgtggtacagcctaaaagcaactaactgactttaacaggatacaatttttatgaaatcaagtcccaagccaagtgtatatttcataatctagtgcctactattttaattccttctgtataccacaaaaatgcacttaaagaatcaaaattttaaatcacagagaaggaactaatttcagcatttgttagttcttttgtaaacagagcatatattattaaaactttttcttaaataattctagaaagaggtaaacacatatcttttcttcaagaatattttacaaaacttagaatttaatattttctatattttattcttgagtcaactgagactcagagagatcaatgaacatccatgataacacatagctaagaagcattgggagcagaattcaaaattctgtagtctagaaacacagcttgtactcttaatccattaaactatcttgtgccccttgactacaatgtgtcccctgattgcatgcccagtgacaaactgtcttacttaaacaagcactgtataaatccttttccaaagcatcaaaaatattgttaaatatggcactaactctagcacagtggcatgctgatattgccaaaacttgagggtgacaataatcaatcacattatataggatttataaatcagctgactctcaaacttaaatgcacataagaatttttactttaaataggcagccaagtaattcttatgaaagcagttcacactttaagacatactgctaaaggcattttaaaatttacatgcaagaatagattagcattcagtcctatttacaacatactggagcagttgctcatctgatttctacctatggcatgaaggcttcagaatgaaataggtttgctgatttttgtagtttttaggtttttcattatttttgtacacttttggtcttttcaatatgttcatatagcacaagtttataattgcatatattaaatttgcataaaatgacttcaatatagtttgctttcagggtttactggaggctttttgctttcgaaaaccagattatgaaaatcatgttttctctgtggagactgggcaatgggccgggtttcagttttgatagcctcctgttacaggtctccttgacattcccttgggctagttcttatcatttggctgctacttcttccatcataatgtaagtatttattggtctttcagatatttctgttttcagttctattgattgaggttgttgttcatagttattgtaattagataaaggatgaaaatgtgggaaccaattattttaaagagtgtaatactcattatatctccctactgatcattttaaaaataaaatatagtagcaaatttatcaaattttatgtcagtaatgtattttttagaaattaagataagtctaacaagataaaaatctctttgagcctttggataaatattcaaactaagtgatatgtcaggtatttttctgctttattattttctgaagtcttatatttttaaatttttataatggaaaagtttatacatgtaagaaaaataaagaacagaataaataaaatgaaactcatgtagccattacccagcttcagcaatttttaattcatggcctattttgctttatctatgaccacatcccttggtgtttcaaagatcacatctaaaatattttaataagtctctttaataactcctatcccacaaataagatcactgtagttcctgaaactcagtgccctttttaaccttcatataataaacttagattttggctctatgatgacaatacaatcataagaagtatatagattctttggcagtctctctaagtgctccttttggatatttgttttaggctctgtggacctagctatctggaaataggctattacttggtataatcttacaaaattcagtctttgatttaatatatacatgcaaaaatacatgcaaaataccatttgtgcacaaaaataactgttgcccaaagtttgaaatgtattgaatttatttaggacttatcttttgctaccacatactaaggtgttaataaattgaaagcctggaatgtctcttttttaacagaaacacattgtcataacacaaatttcttagaaagatttaaacaataatataatcttctggagtgaattgtgtccccccaaagtgtaagttgaagtcccacccagcatacctgtgtatgtcaccttatttggaagtaggatttttacaaatgtaatcaagtttagatgaggccatactagaccaggctgtgtattagttagctcaggctgccatacaaaatgccatagactgggttgttcaaacagcaccaatctttcctcacagttttggaggctaaacatctgagatcggggacaagcatggctaggctctcataagggctttcttcccagcttgttagactactgccttcttgctgtgtcctcacacagtagagagagaacattgatgcctcttcctcttttcataagagcaccagttctattggatcagggccccacctttatggcctcattaaaccttaatcacctctttaaaggccctatcccccagttccatgggggattagagcttccacatatgaaactgggtggacacaattcccactcatagcagggtgagccctaaatccaatggctggtgtctttataaggaaaggaagatttgcacacgtacacacatacaacagaggaaagatgttcatgtgaaaacagaggcagtaattaaagtgatacagctacaagctaaggaatgctaaggacagccagcaagcaccagaaactaggaagagacaagaaacagattcttctctacagccttcagagggagcatggtccagatgatacattgattttgaactttcagccttcaaaactgtgagagattacatttctgtgttaagttgcccaatttgtggtaatttgttacaccagccctaagaaacaatccatatgagtcaaatactttgggagtacaatctattaaaaaaaaaaaaaaaaaaaaaaaccaaaaacctctactggagttctaggattaattggtttcttacagcattacattgggagacagaaaggaattcaggttaatcctttaccgctcttcaaaacaggccaaagtgctagaaagttgagggtggatattcaagctgttctttgataggaactgaaagggatcttgagatctggaatctatacatggaatggatacatgttgttttgtttgctactctagttctgattatatttcttcaattaaagggtactttcagggtttttctttgttttgttgtttgtttgtttgcattacaaacctcattctcaatctacacgatttgggtgagaatggttctatatccaagccagcagtaacctgaattggcttaagtgaatcaatattccccattcactagctttagaaggcagttcaaggatgattaaaatgtaaccccatcttagcataggaaatattttgaggtaattcatgagaaaggaaaaaagatttattttgtttttgtgtttaaaacaaaacaaaacaaaactagaagcaaccctcgctcttctaatggtgtggtataaattcatgagatctagcatcaacaccattttaccgccaaaatagaagagcgttgagttgtggtgtctgggagtgaggttgggggcagggtaaggagcattgacaggagcctgatgatgaagctaaccctaagaaaagctgagtgcagagacagagaatatgcgccgagtgctatggttttatctgtggatacagaatcacctgacgcctgtgccctttgcaaatcccaattttattcctttgaattttctaatgtgcaatcatatcatgtacaacattttgctactttcttccaatattcacacacctgtctcatatcttatggtatttctaatataagattaaataatagtgctcggtcatcattgttttgttctaaagttctaataggaatgttctacggatgtaccatttggttacaggctggagtgcagtggcacgatctcggctcactgcatcctccgcctcctgggctcaagtgattctcctgcctcagcctcccgagtagctgggcttacaggcacccgccaccacgcctggctaatttttcatatttttagtagagatggggctttgccatgttggccaggctggtcttgaactcctgacctcagcttatccacccgcctcagactcccaaagttctgggattacaggcatgaaccaccgtgcctggccaatcattcctattacacagtaataaaactgatcatagttaagaattattgaatatttcctacattctgggcatttgtgtttaattatttatattgacaatcctctcaataagtctataagattattcacttcatcttacaaatgaggaatttgaggcatagagagtttgggagacttgtccaatgtcatacttgagattggaagtcagattttcaaagtaggctgtgtataaatttaagaaccatactatcaaaggttaatatgatttctgaaaaatgcacaactaattgcattttcttacattgtaattaatatacagaatggtgtatatcacaaatagtttgatccaccagaaaataggggttttaaaaatcttcagatgttagttttctaagaagactttccagtcaaaaagagaatgcatttgcttgctaaaattagtattatgacctacttggcacatgtagtatgtaaattaacaacatgtcatctgattcatacatcagtatcttctaagggtggttggagagtttgagtccctacagaccagtacaaaccttacatcggaaaacgcagagctgaggtgtgaccttggtgagtttatccaggtatgagcaactcatgaggcttctatggaatgtcttttttctcaaaaatttaattgtacaaagtgctttgaatttatagcagactgcccttcagtttctatctaaatgccataagctttgtttcaagggatcagttggagtcaataatctgggcaatttcttacactttcttgagattgtaaattggctagacctctctggaaagtatctttaaaatatgtatcaagaatttcaaaaatgtgcatgctctctgatctggaaactcctcttataggaatctagtctagaaacaaatcagagatgccatcaaatacatatataaacatgtttattacaatgatatttgcaaaagggaagcaacttgaatgtctagcattatagaaatggttaaataaacattggtacaaatatatgatgaaaaaaatattatggaactattaaaaatcatgatgatgaaaaatatttgatagcaaacaaaaatacttaaaatacaggtagctacaaatttaaatataaatgatggatattttatatttgctatttcattacaattaaatacaaaataccagagagaaaaagcacaaaggttaacagtagttatctctggatagtgaagttataaatgactttaaaaaagtgaattctttgtattttttagaacacacataaaaatatttaaaataagaggaaatggcacgtgtttttaaaagattatggaagtatcatggaaacatgaaatgaaaaaaaagaaaaaataatagagcattattcttgaaggttttaaaatgcattcaatatgatttaaaagtaaaagttttttttacatgtactttcttttttgagtctgattatatggtcttttaatattgttagtaaacaaaattaacaattataagtacaaataatcttctcttttttttttttgagacagagttttgctcttgttgcccagggtggagtgcaatggcaccttctcagcttactgcaacctccgcctcccgggttcaagcgattgtcctgcctcagcctcccaagtacctgggattacacgcatgtgccaccatgcccggctaattttgtacatttagtagagacgggttttctccacattggtcaggctggtctcgaactcctgacctcaggtgatctgccctcctcggcctcccaaagtgctgggattacaggcatgagccacagcgcctggccccaaagatttttaaatgtagatttaatggtgttttatttcattttgtgtaaagatatttattatttagatttttttaaaacaaaggttgagataatttattgttttgcttagatactaacgtttcccataacatctgttcatttggtttacatttccaccactgaaccagtgactgaaattctccccagctgtgatttatgatctgtttatatacagtctgccagaccatactgccataaagccttcaagattcccaggtaggaagaaagtgaggttttacaatctatctcagacttccttatgttatatagtttaaatcttagcaaactacaaaattgaccttgaatataaataatcagaatagttataaaacaacctatctttggacttttcgaaacatattttattcagtactggattctagtttatactatgctgttggtggggacacatttaaactatgtacatcacaccaacacacagtgtcctgaaaatatgaggatccctaattgaataataaaataattgatgtaaaaacaatagtaacttttcatgtctagtttacattatttctgaaaatgtgtacatgttgattaaaaaaatttagagtagacaaaaatgaaaccaggtgttctaggctagtaaagttctgtgattaagtttctttaaaatttcttttaaaaacagggaaatgactatttaatctaagagatgtaacttccttttcaaagatgtagaagtacctacctactggtgaatagacaatattttattgcctttttaaggaattttcaatgacaatttaactctataacaggttttcagagttttcacatagcaatggattatttgattacatcactcatctgttgcttatttaaataatgcattttttctttaattactgaattgagcactcaaacagctaacctacacattctaacacagctaacctacactccatccttctctgcaaattataaaaatcttcctgaaatattttgtagaattctgaactgttttctgaactctgatctatgaaatacactgaaaagaatcacaaaacaaatcaactacagttaagagaaaagcaatggcctaaatgatgttattgcaaatactggttaaaattaattgagcgttttgcaaatggcgtgtactgtgctcaatgctttaaataaattatatctcatcagattcctgactcttggtaaaaaggcaagaagctggacaattatttcctcaaatgaaaaaacttgaacaagtaactttatcaaagttaccagtaagtaaatggcagaactgggatgaaaatccacctctactaacctccagattagtcaagagaaacagaatacaatccataggtcaaaagtatgcttattctcaccacccctacccaacacagttctgaaagtcccagtcagagcaatcaggcaagagaaagaaataaaaggaatccaagtaggaaaagaagtcaacttacctctctttgccaataatatgatcatacacctacaaaacaccaagaactctgccaaaatgtacctagacctgataaatgacttcagtaaagtctcaggatacaaaatcaatgtacaaaaatctgtagcattcctatacaccaataacgttcaagctgagagccaaatcaagaatgaaataacatttacaatagccacaaaacaaataaaatacctagaaataatctaactaagggggtgaaagatctctacaaggagaactacaaaatagtgctgaaataagtcacagatgacacaaacaaatggaaaaatattccatgctcatagattggaagggtcaatattgttaaaatggtcatattgccaaaagcaatctacaaattgaacactattcccataaaagtaccaatgtcatttttcacagaattagaaaaaatattctaaaattcatacgaaaccaaaaatgagcatgaatagctaaagcaatcctaagcaaaaaacaacaaagccagagtcatcacattacccgacttcaaactctcctataaggctacggtaaccaaaacagcatggtactggtacaaaaacagacacatagaccaatggagcagaatagaaaacccagaaataaagctgtacttctacaaccaaagtcgacaataataatcaatgggaaaataattctctaatcaataattggtgctgggataagtggctagccatttgaacaagaataaaattggtctcctgcctttgaccatatataagaattcactcaagatggattaaagatttaaacgtaagacgtcaaactataaaaatcctaaaagaaaatgtaggaaataccattctggacatcggccttagcaaataatctatgactaagtcctcaaaagcagttgcaacagaaacaaaaattgacaagtaagacgtaattaaactaaagagcttctgcacagaaaacagacaataaacaaacaaacaatcaacagagtacacagacaacctaaagaatgggaaaaaatattcacaaaccgtgcattcagcaaagatctaacactcataatctataaggaaattaaataatgcaacaaataaataaccaataactccaccaaaacatgggcaaataacatgaacaggcatttctcaaaatatttaaaaaatgctcaacaccactagtcatcagggaaatgcaaatccaaactataatgatataccatctcacattagtcagaatggttattattaaaaagttaaaaaataacagatatcgatgaggctgttgagaaaatggaacacctatatacagttggtgggaatgtaaattaggtcagccactatggaaaacagtttggagattttccaaagaacttaaaaatacctagataggcacagtggctcattcctgtaatttcaacactttgggaggccaaggcaggaggattgcttgagcctaggaatttgagactagcctgggcaacatgatgagactctgtctctacaaaaaaaaatctaaaaaactggactcagcatcttttgtagtgactgtgtctctacaaaatatttaaaatgaccacgactgtggtctcagctactcaagaggctgaagtgggaaaatgacttgagccaaggaggtcgaggctacagtggtcagtattcacaacactgcactcgagcctgagtgacagagtgagaccctatattaaaaaaaaaaaaaccaaccaataaacacaactaccatttgacccaggaatcccattactgggtatatacccaaaggaaaataaattgttctaccaaagagacacatgcattcatgttcatcacagtactattcacaacagcaaagatgtggaataacttaggtggtcatcaatggtggaccaaataaagaaaatgtattacttacacatcatgtaataatatgcagccataaaaagaaggaaatcatgtcctttgaagcaacatagatgcaactgtaggccgttatcctaagcaatttaatgtaggaggagaaaaccaaataccacatgttctcacttgtaaattggacctgagcagtgggtacacatggacagaaggatgggaacaaagaggaagagaagccagagctgaaaaactacctattgggtattatgtttagtacctggctgacagggttatttgtaccccaagcctcagtgtcaaacttaatatactcatgtaacaaatctgcacatgtagtcccaaatctaaaataagagttgaaattataaaaataagtaagtaaataaataaataaataaataaataaataaataaataaatcaaagcataatcaatgcctaagtcagggaaatttacagtgaaagattttcctagcatttttttttcaacgtgctcattttacagatgaggaaactgagacccaaagacatcaagtgacttgctcagtttcacagagcttcacatagctcttagattacacagcatgttgcctcagtgggaaaactgtctcatggcaattcctcaatcaactgtagatgatgcaagctgggatttaaaaaaaaaggaaggcataaattttatagttattttttgtctcatatttttgaaaatgctgctggaagttcagctgattaaaaaattaacacagcaaaattttttatttatcaatggtctagttttattcatataaaccacactagccctatactctgaccacctgagttctacactggaattatttggaagtacatccagacaacacataatttcctcagtaaatgtaaaacaaaatttggaagccggaaaaaaaatgtggaaaaggattatgtttgaaatattatagaagaaaaatgagcagtagagaactgaaagaaaatatctaattatatgctttataagtaggtaagaactatgaatgtggaccttatttttcaaacaggaaatccacagaaaattatagcagaaatcagcaaaaatgaagggagataacttggtaagttttagaatttagcaaataggtgtgaagggcaatcaccagacagaggaaacttagtagcagcagtttgtggaactcaggtttcattaattaactgcaataagcactgagtagaaataaatagttctatgaaatactattaagaaaacataaatgtgctttctgaagagaggggaagcttattatctaaagaaaataaatggaaaaaatacctgtttagtagtacaaaatatacttaaaatcatatttctaaaatgtcatatttcttaaaattaaccaacaagaaaacaaaatattgaaaagctataactattacatttcttgttgatacttacaaaaatgttatggtttagggtgggtcagatataattatctcttttttatagatgagatgtcagaaagaataaataacttacatgagattacacataaggtctataattaatactgaaagctagattatatagctataaattttgtccttttactgcagggtacatgttttaggtttgaacaaacatgtctagacacaaaccctcatgaaatatgattacaaactcaaacatgatgcaaagaaacccaaaagagctattaaagataaatacaaacattaacttatcagtcaaatatgaattataaaatggatgtgttcctgagaaattataggccaaattaaaattcaaatataaatctcttttacaaaactgatttatatgtcatgagataatattatgtgacattcattaatgttttctccctctacccacagaaccttggactttgcatccttcttcggataggattctaattctagtgcccctacctcattttagaagtaacagaagagaagacacagtcaaattcaagcttcaaaggggaggtgtgggcattaatattgaaaataattggacacatgcttggctagtcagatggagtttttcctctgccctatttattttgtaccaccaacaccctagatagaagtttccctgcatggggaatggagtgaagagaattcacaggcgagtgagagaactggattgttcagaaatagtaagcctgtacaattttatcaagaatttacagtctaaactgaattcttaaaaggtataatgctactagaatcctacagcatgctctgtgacccatatttcctgcagaatgatatttcagttaattctacggagaaatgtcttttaaagctcttatatgaaatgatacagttctcatatcacaaatttaaatgttcaagaaatgtaatttctcatcttatccagagttttatctaaatgtctaaaatgtagagaatgccaggccagagtaaagttgaggaatttaggagcagggaataggtgaagaggaactgggaagaggctaaaatgaagcatttaggcctcctcattcctttctaatctcaaagtgtcagtccagagtttgtggctccatactccttatcttggctgtaagataactcctggactagcttctcccagctgcatatgaatgtctaaatgcttaggactgtgtcaagattgatgcttacccacattttttccaagaatggaggagtgatcaactaagcaaacatttggttaatgattaagctaataccttggtaaataaatatggtaaataagtatctggaagaaacatagaaaatgtcctcctcacccaggataaaggattacttaattcattgattaattcaattgtttgcattttcagtaaatacatattgagatttgttttaatgtgcaaaaaattgtcaagctcttttattttttcaataataaaaaaatacaacctttgatcacaaagagatgacatattagcgcagtattttcattgagctgcaactttgtaaagacagtccccttcaaatacgtacacacacacacactcacacccacacacacacagagaaacagagatagagaaaatatccatattggcttattaaagacacttagcatccttagagaaaataagcctaaaatattttttaaaccccatgtttccaaattttgctggactttatgtccctgtcctctcacccagatatgttagtttaccctcccaaagtcttgggtaaagttggtttagtgaattctaaataaagaaatgtctctagagtagataagaacatttcttccagctgtagtagtttgaaataaacttttcattagtacatcacactacttcctggtatccttaaatgtcaataagcttgtgactataatttttaaagtaattatatgcttttgtccaaggagtagttatttccaccaacatgaagcgttctaggcaaaaggccaagactgccaagcttgccagatattctctcacaaaaagagttggaaattggtattgtgatttataaatcagtccctttgggtttgatgagtggaaaacaatgtgaacctgtctcctgaagtgtgaatactttctgaggtagctgacaacactgaatttctgaaactgcaaagctggtgattggacactgaattcatatctcaagtctagacatcaggaagggctttgacagcagttctcaaggtctttgtaatatcacttgctcctttctactcatgtgcctgctgccatcattagagaccatgaattacactagaatattgacatacacacatactcaggcacatacacagatctcactcatccctactatcttctacaaacaatgaatgcttcctcccttctccactgcctaaattaatcccctcattgtttctcatccatacctctgaaacaaccactctctccctgccacaaataatattaactaaaatgtccaacgggttttgttaatcccctgcaaaatagcttaattagttactatggtacaggagatacatttcaacctccttctcatccttcgattttcagcatactgcagttttcactcatctccctaatctaaatttgatcctcctgttatcctttctcattatactttgggttttttttcctcacccttcatgctcactagccaaatttgtgctcataattgtgtgtgtgttgtgtgtgtgtgtggggggggggggtttattcaattatgtttacaaggtaattctcaaaatatttaatcagtatgacgtgggtacagaagagtcaaaagtgttgctaggctggggaagggccagcggccagagaattatggagcaattttagagattggaaaagtggctatttgtcagtacatgtaaatgtttcaaaattctaacaactgaaaattgttgtgcccttaagtaccaggtgaatattatccctgggttatctgactactcaattagacaatatactaacaagaacaattaagcatttctgtttcattgggcattaggtagcctcagcctagcaaataattctctgaagcaaagtgagaacacaataagcatttgttgaattgatttaacatggcataccaggcacttcataatctggtctctgccttctttaccagtttcaagcatattagttcctgactagtactttgctcttcaactagagataaaaatatatagtccctttcagaaaacatatgccatatctctacatctttccttgtgttgttctttttggctggaatgtccttctccagctaacaattacacattcattaagacttaggtcatgtgccatctcatcagatcaatgtttctgtcacggttatccccatttctcaaatcagccaccagcctgccttagctgttcctcctctgtttacccatagcatgcttacaaacggtagtttcccacatcgtagtttatagcagtttccacattcttcctgaataaactgtttaattttctaattccttttcctgtgatctcctagagggcaggaaccattgtttacataacctgaacattcagattctagctcaaggctggatgtatacacacagtgtaaataaataattgagcaaattagtgaataattgccacttacaagcaatataatatagatctttacccacaatgaggttagaattatttatagcacatttctacaaatttagagatagtaaggagaagcaaaggggttaagtaaaagagaaagcagcatgaagtttccatacccctacactaagaacagcaaacatactagattgaaagtcaaattcaatctacagctgagttttatttagtccatactgtgttttaaatgttatagaattaaactaccttcaagaaggcatggattttttagttcaccactgcacccaccatcccatatgatctctgtccagatattgatttcatttatgttatctaccattgaatgaaagattttaatttgaattttaatgggcaaactctgttacaataaaataaatattatagaagattgaaaaacatttgttatataaaatattgctaaaataagcagtataatagatgaaactttgatagttagtctggtattttagtataaaccacagcttcagtgaatttggaaaatattccagttaaatctctgttcgagtttctgcttctcagcaaaagccgctaggttgaaatgttaagggtttataaagttataagagaatactattcaaatccctctaactcagagactggaatcacagatttttagtgtgtgatgtgcaccatatgtttgtataccaagcacaaaataagcactatcaatcttctaacctatttgaaatataatttattgagttttcaaatacattatttcaaaatgcaaatgttagcctttgttaagtctaaagtaggtaattaaatcatatgagtcaccaaaacagaaaaaaacaccaaacatgtgtgttttaattataatcagcattgcattgcagtgttaaacaattagagatcgttatactatcctaaaacatcagtgggatagtgtcagaaatgatgactattccttgtttacaaaagactccgcctgtggcatgctgtgtgcttttataaatcatttatcttctagctttaatctgtcatggtatgaaatattacaaatgtgattctgcatgacagaataatgaaatactaaaaaaggctgtatgtaatgacttctccataaaaagttttccagaaaaagtaatgcatctatattaatatatatgtataacttttttctttttattatttcaaatattttcccatatcaacatcttaaagagaagaccaacaattttatagtgaaactttgcaagaaatgtttactctctatatgaatattcaggctcattcaaggaattattttgtgcctaaataccagcagggaaacaaagtagaaagtcaattttctagcatttgtaatgaattgaaaaatgcaaagttatcttggaggtatttattacactttaatgataagagtgagaaagttaaaactgaccatcacggatattccgatgcattaaaaaagagaaaagaagaaagaaaattacagagaagaatgtagcatgccattgttatataactaatcttacttttgcagaataataaaagattcagaatttaggttaaatttatagttatctttggaatttaatgaaattatatgaatccatgtacttctgtaagcagatttttggtgcaactttcccatactttaattctctagcttccagtagcatactctttaaattcaaaagtagatttcacctattttttaaactaggaagtcccttggggacaaaagtttttattttatatatcaagaaaatgaggaccagaaagcttaagtaatttgcttaaagtcacatggccaattagaggcaaacgactgcaatccagacctttggatccccagttcaccttgtttcccactatttcgcagtaaccgctcaatcttctcttcagtttacaattgttaccatcattgactttatgacattgaacctcatgtcaaaataatcttcggcagctttatgccacctggtatgaaatagcctaacaggacaactgcagaacttatcacattggtaaaatgaagcaaaaactaaaaacaaccataaatggggaaagtactaatatgttgaaatgtcataaccactgtttaaacaaattgttgtaaaatgtctagcttcatgttcctgcactatatttttcagctttcttctgaattattaagcataacttattttctataactgccttacagcagcagaaatatgaaacataaacatcggcacttatacacaatgaatgtgaatagataaccatcatatgaatctaatcgattatttgacagttattttgaaaattcagctaatcccattctagagcatattatagtgaaattcttgcaagttgaaaggaaataactttgcttaaaatggaaagataatataataacaacagaaagatatatatgactatatatatgatacacacgtataaattacagcttatattaaaacatgtaaaatcatttttaatgtttaactgttgacaactttcaagccccaccactcctccttcccctctgcctcatatctgggcaagctgattaggtcacctgagtgctgcctctttgccaccagtggtaagtttaaatcatgcaagcactcacctgtacacagaaactctcaccccactgctactccataatcacaataaaactccacagtcaatctcccttctctgctctctcacgcattttgaaactgcttggcagtttgccttgctctccctagaaagtctcattttgtgagtaacacggcttttcatacttccttgtgcttgtgtggtatcagtcttgaaatccaaaccagggctgggcgcagtggctcccacctgtaatcccagcattttgggaggccaaggccaaggtgggcagatcacaaggtcaggagttcaagactagcctgatcaaagtggaaaaaccccatctctactaaaaatacaaaaattagctgggtgtggtggcacatacctgtaatcccagctactcagcaggctgagacaagagaatcacttgaacccaagaggcagaggttgcagtgagccgaggtcatgccactgcaatccagcctgggcaacagagtaagactctgtctcaaagaaagagaaaaaaagaagtccaaaccaactgcagagtgactacaacaatgaatgcaatgaggaagatgtctaagtgatgactacaaccactagaggtctttcttctcttgttttctcttggtaactggctctgctgtctgctggcaaacttgcacttagagctatgctgctttgtgctgcattttctgagtttttccaagttatcacagttttaaccaatctacatcagatcttttaataactggcatttagaaccaagggttgggtcctcatcaaagtgaccctgttgtatgttgtagcctggacttatctgtgtactttataatgaatcacatatcttgattccagcaaaaactgtgactaatgttaagttcagagaaacaactcttactgtgtggctattggttgtgtgtgtcaagcagtcaccggccccttttctagagaagacccagggaaaatattgataccctgtgcaatacatgggctcactggatggtggattgtgagaaagaagagctaccatatggtgtgctgagttctaacctcctaaaagaagatgactcactaaaaccctataaaatgcctttgctggctgggcgaggtggctcatgcctgtaatcccagcactttgggaggccgaggcgggcagatcacgaggtcaggagatcgagaccatcctggctaacacggtgaaacctcgtctctactaaaaatacaaaaaaaattaggtgggcgtggtggcaggcacctgtagtcccagctactcaggaggctgaggcagaagaatggagtgaacccaggaggcagagcttgcagtgagccgagatcttgccactgcactccagcctgggcgacagagcgagactctgtttcaaaaaaaaaaaaaaaaaaaattgcctttgctgatattgctatccaggtctctgttgtaacaaagaatctaatcctcaggctttagaggaaaacacatatggcacctatgtggaacaactgatgagttgatgaaaacttaaaataaacccagagttcttaaaccttataaagcaaccattgtttctaaccttgaagttactaatttgagatactttggaggaagaaatttattaattatgaaataattatgattaataattaatataagtagggtaaggagaccttccctcctctgaagttacatatagtaacccttaaagcagaaatgaaaacaacaataaactacatacaggttgaagaaatacaaaattaaaagagaaggatccacaatttgacccaactggaaatccaaaatttacacaaaaacttataatgtaaaaatatgaaatgtctctgattggtttttatgtctctacaatatgggttctaaattaagtgcaacatctactgagatgcaccacttagcaaaccttcatggccttaatctatacagaggctcagatacagttattcctggggatcccactaaatttcaataaggcacaccctataatctaaaggagatatgaaatataaaatggtgaacaaagaagtatgcctcattttaatcatcagcgttattgccttacctaaatatcccacagtggtcatggaagctctgaccaaaaaggtagtaaaattaaataaagtctttggcacttacaataggcttgacaaattaggactctatggacttttatcttcagttaaaagttagttaatatagcccagtgtaaaataacatagggcctttaaacattaaaacccattttagaaaaagtatttagagaaggggtgattatccccactgtgtctccatttagtagcctattttagctgcttttaagcctggaaaaaattaatgccccctcgtggtgaattactgcaactttcattctgtcgtctcacatattaaaggcctcaaaatcaatactattgaaattactgactccatccaattatcagatagtaaatattctattatcactgatttgaatcatatgttctgtttagtgcctgttttaacagcctctcagcctttgccttttatgggatagaatactgtggcccacagccttacctcgctacccatgggttttcaacagtctttgaaatgtaggtggggtgagaggcagatcatgttcaaccaaatggccaagccatggcttgagatctaattatataaattataccctccaaattaaataatataatcataagcacacatgataatcatatttcccttctctaaaatgataggcttaaaaaataggggtttcctttcttataggcacacaaataacatagtaatttctgctaatttacattaaaacaaccatcagttagaaaaaaagaggctgggtgtggcggttcacacatgtaatcccagcatgttggaaggcccaggtgggtagatcacctgaggtcaggagtttgagatcagcctggccaacatggtgaaacctcatctctactaaaaatacaaaaattagctggatgtggtggtgggcgcctataatcccagccacttgggaggctgaggcaggacaatcacttgaacccaggaggcgaaggttgcagtgagccgagatggcaccactgcactgcagcctgggaagcagagggagacaccatctcaaaaaaaaaaaaaaagagttccctgttcttttcgattgctccaaatctaaaaagtaatgacaaatagtaaacgcaagttttgaataaacacacatattgtgaatatgtgtcattgttagataaattcagtatttaaaaaagagtaataattggttttaatgcaattgtactgttaaaaagtgaagtgtcatatactttaagtaaaaaatacataaaagcctttattgatcttcttaagtattcattcattactgaaaatttcatactggggaaaataaaatgccaataaaatggtttactgattgaacaagcaaacaaaagtaatctaaaaacaatctgtccctaaaatatggagaaaattggtggcaataaatgattgaattaagcataaaaagaggtaaccacaacatagactgtgttgctgaattgttaaaaaaaactcacagacataagaccaaagagtaaatggtcaaatatatgtgtgaattttaaggaaaaatatacacaaaatgaactgctattatttttaacataaaagatgagaataattcattaatacatatccaagtcaaaactacattagcatgtatttaaaagtccagatgcccaatggaaaaacatatatgtatacatttagagatagtatgtatgcatcttattttcaatccattgttttacttttttcttctgaattacaagaatacctaaattctcagattaccatttacaggttaacaatttatgcagaaatgtgaaagatgtgatattgcaaaaacaaatcacacttaataaccactatgtaattacctaagtctatcagcccaaaataaaatacatttagtgaatataataaaaattaatgaaatagttgctacttatcactgttttaacataatactataatagagctatattttttaaaaaattataatcttataatgtgagtaatatcctaaggaaagatgtttctagattaactggaataaaaatacttcaatgagaaataagaaagatagtggttgtgaataagaaataaacaaaatacattaaagtagaaaagaagttcaaggcagtggcagctacttttttaaaaagcctctcctacagcaatatgcaaaagggtttggtaactctgtgtgccatttgcacatagtagactagattgacaattacttcagatgatttagggattcatacatttgaaacatgcaaccaagagactgtgccaataataaaagataggtgagaaggcagattactggggcaaatgtaaggtttttatgcccattttgaacataccaagtgtgaaaactagtcgggaaagaataagctctgtacactaacaaatatgtcttcggggtgtgtcttctaggaggtagagctatctggaatgctaaacatgaaattaagtcaccatcgactatactggatatcctcaggatgttttacatgttggaattttccaagaaatctgaatgtcagtttgcagtccacacagctgatgcgtgctttatacagcaacttatattaagattttctacataaaattatgtatatatatagttcaccctttatagtggattgaatagtgttccccaaaatttatgttcaccaagaagcccggaatgtcaccatatctggaaacagggattttgcagatgtgattagttaaggatcaagatgatatcatattggagtagagtgggccctaaatccaataggtggtgtcattataagagcaagaaaaaacagacagacacacagaaacagacagttaggagaaacggtcttgtgaagatgacgtcagagattggagtaaaccagctataagcccaggaacctcaaggcttgctgggagtcaccagaaactaggaagaagcaatgaaggatgcttctctagagccgccagaggaagtgtggcattactgacacattgatttcaggcatccagtctctagaactgtgagagaataaaatgaagccactaagcctgtgatactttgttatagtagccttaggacatgaatacatcctcttttacagataattcctagaaagtaagaagaggatgactgaagagagatagaggtgggagaataggaaggaatgataattccaacaatatttcatgtgaatatttcaatatttcatgtgaaattaatccagatattttgttgctaattgcaaattatttcttctgaattataaagaggtcttccctctgtttttaaaatttcatctcctccaattgcctaaagtattttttttttttttttttttttaccaattgatccacctcatatcttcagctttgtcttctctactgtgtctttctctttgggctttaaaataaataccccagtatctgctggagtaagagaaaataaacaaaaaccaaacattacctgctgatttatactctactttgactgtcatcctatatatttatgtttcttctcagccaggattgttaaaatagaaatctacacatttattcccaaattttactaattcctccctccccgaaatcttatttggactcctatactctaggtataatacatattaacaaaaaattttccctctgacaatgttaacagttctcttacattctaaagcatgttatctatacgaaatgaaaagtaaaataaaattggtcttccatgtttctgacacttaaatataattcataaagtcttaggcaactaaaccataagaaaaaacaactggtgattaagcattgaaaaatgaagaaaaattaaatatattttattgatagataagtaggattttttaaatccaaaaagccaaatgtattagtcttatatgtagaataaggagagtaaaatattaataaattctatctaattgatccagaactgttatttttctgagagtaataaaacaagtagaatcctgcaggatgaatatttccaaaatctgaccccaatacctgaattcaaatgaaattcagtgatgctcatgaaaacattatgaattgacatttgtcttatttataaaaactaaaagatggcaattgactgacaaagagtatttactcaatcaaccagtaaagcgaagtaatattatgcacatatttattaggttggtgtaaaagtaattgtggtttttgccattaaaagtaatggcaaaaataacttacaggcatttaattctacaccaggcaaaaaaaaaaaaaaaaaaaaaagtaatttggtaccacatgacctgtaagaaacacaagtagttcatgtggaattatctgaaaactgtcatctgttcttacattgaaggaataaaaatgttctgttagactatttcagagacaatatggcatatgtaaaatcatgtagatgatctttcatgggtgatttaatttattttcatgtgtaatgttggttatatgtgattttctttttacataaggatgttagagccttaacccctatgtaaaatgcaatccaatgaatgcactgagtgtatttgacagacgtgctaaatcagtggttcccaacctttttggcacgagggacaggttttgtgaaagacaatcttcccatgggatggtttcaggatgatccacttcagatcatcaggcattagttaggttctgataaggagcgcacaacctagatccctcacatgtacagttcacaacagggtttgcactcctatgggaatctaacgccacagcttatctgacaggaggtggagctcaggcagtaatgatagctcacctgccactcacttcctgctgtgcggcccagttcctaacaggccaaggaccagtaccagtccatagcccaggggttaggaatccctgtgctaaacgatgtaaaagtcatgttctaagagcatctgtatatgaaacatatagaagaaggaatgatcataatttgggataaatgacagaaaaagaaaaaaatgtgagaagtgatatgtgatgaagtaatactgaaaagtaataaatatagctcaacgtggcaacagaaaaaaattatggcaaagtgagaatgagaggaagcagaagcaaaatagaaatctgatttgtagagatccagtaactactgcttgaccatctgtcatcaaagaggtaaaggaaggtaatacgaagaagtcaacagtcagtatttgtttactaccattatcctactcccagaaaattgtacgggatcattagatgattgaatagtcactgggatataaaacccaaaatatttgttttcatgctttaactaaataacacaaataattgttttattttaaccatgctatttttaagaccttagttcaatccaataatgcatgtcatttaatttaacctttttcgggggtggaagaggggataggggaagttttatatgaatgtgaacataaagaagaatgtgtatatgtgtacttgtgtatgcatgtgacttactatgttattacgccaatcactcacatacatcaaattattataaaataaccacataaggtaggtatttatcattgctactttagagatgtgtagggttcaggctgacaatgggacttgtccaatgaaaatagcaagtaagttaagttgagcctgaacccagaaatctgacttgaaagctggcattcgttaacccaatgatattaagcatgaagtatgttagacatacttcacatgtatatatatgtatataatatatatatctcatttactgctcacatctctaatctataaacaaaatgataccaaatttacaaataaagaggcagtctcaaagagattacgtaacttgtccaagggcagatagctaacatgtgacaaggctgaaattagaatacaggtgcttaaatatatatgtaacttaaaatgaagaatgatgcaacatttgtaaaataaaattagttttttactaataaatcaaagtacactttgttttgtccacaaaaaaaacaagaagattcatttaaaaaaaacagttttaaaaaccaactattattggctcaacgtagcagtttttttatattaagaggattaaattcaacttatattaaccctacaaaactatagatttcattctttaggaatctgttaatttacttttatttcaattagtactttttctttctctttttgagcatacataggctacagtaatacatctccaggatgaccagcatgtctatttgtcaggacattaaatggctaattttcctctttctcattcatttggccacatggcctcccaagaacagagtataatacgataaattaatggcttccgaagaggactcagagagccatgaagttttctggataatcattgttaggattctgtcagcaaccatgtaacatttttttgcatctggggagcataaaactctctagcaaaggaaggactcaaaaggcaaaaaataaacacagttaagtgaatgatatttttctttctaaactgtcgttttcttcactatcaaagacctaacctttgattcaaccgatcaatatgttaggggaaagaaatactttgtagagtacaaaaacagacactttgctaatgctggcatcatcactctatttcaatgttaaaataaaaggtttagtactacatttctgatgacagtactctcaaataagttgaagatcttggacttgtttcagaaggatgaaaaggaggatatataggtagtatctggttataagaaattggactggaagcatcagcttattttatatctcagcagcagaaatgttaagtcaagatgctattcagctatctctaatgataaaatccatgtccttctgctgatatactgagtcatccaggcccagacattcctcatagttataacaaatcctttactatgtaacacaatgctgtaaatctaaattttagaagtctgtgaactttcagcctctctctcacactttactgctctctaaatttcccttgcctatccatctgtgaacagaacttaatctaggttagctccagctggatctcagaaccaaaacctttaaaagccagataagtgacttctaagacgtgtgatcagaaagatgtgaaggcagcaaaggacacattgtcttcttagtgccaatgcagaacagattgtcaggttgacaagatgagctgaaatgtcctttgctgtctttttatatttattgctgccccagaaactagatgcttaaaaccaaaaactcttctttctggaaatgtgttaataaactataaaattgatatgattgctttgtaaatacttttgttactattgtaatagttcaatatttgacttaatacatattttacagagcagccttggctttatgctctggtaatttcccattttataaaattccaatatgaaggcacttgcaaggttactgatatactcatttttaaaaattaaaaacaatcctgttttcatttttgtattgttgttcacctgtgtacttgactgtaaattcagattgagtaagatgacctcaaaattgtattattacaaaatcactatctaaaaagaattgcatagtaaaatactttatggatagcacgtattttcatttaaaatttttgaatagcatgtagtgaaaaataaagcatgtctggatgaaatactacataatgagtcgaatcttacttaccaaactcctttggaactgctatagaataaacacaattatgtcccacactgtaattttttggatagtttggtgatagaacagtgccttctgaacctgttgaacgacttccacagggcgctaggaaaaaatggcaaaaatatcatttttagaaaaaagttttaaaaaattcataccatggttatcttcttcatataaaaaatatatggctaatggaatttaaggtgtataatttatttgcatcttataataagatcctctagtgttaaatatttgaaaaataaaaaagtgtacaaacaaaactttataagtattcaaatttactgttctcagaaacaaagtatgtaatataatgttataatggtgttacctagaaatataatggtggcccacctttcatttgtgatgagtgtgaaattaatcatttttataataatgataaaatacatatgcaagtgggaaattgttttacttgctggcaggctttggaattctactcagattcaacactgattatgtgtgagacatggatggctgtacaaatacattcacccactcatctaagtattctattttctcatcaatctttatctgcatatataatttactttgaaatcacaggagttgttgattgtgccttgaggcagacttattggctacctcaggcccaatgtggtatgttaaaaaaaagatgagggtgaaaacaatgtttctgataaactgtatatgggggtcctgttattcacaagacaggggatgcattaggattcatagttctagaactcaagagagacctgagataaatggagatttagtaccgaaagcatacggatggtaactggtattctttaagcgaataagatcactctgaaaagtatgtagaatgagaaaagatgggcaaagaggaggttctaggagacaccaaaggtttaaaatcagataaagattgggtagctacagagaaattattatcctgggggtcaagggagaagagtttcaatgaaaaacaagtgttcaaagaggtaaatgttgcaaagtgattaataaatgcaaaagaagtctgggttgacttggcaatctggagtgtaagagtggagtttttctgccccaggtgtaagtttgcaggaagagggatttttttttttttttttttttaacaccttgccatctggccctgctccttcacccttggagtcagaatgagtttcctgattggtgagccctggacaggaacttgtaccttttttcagattaggagccatccttcttgcagagcacactgtctggtgtgctcttctacactgtaggttttttagggcgccttctgagggtagggctgagcctgttgccgacagctagtaggaagcctgttgtcactgccactcatatttcatcagtattaaagctgatcgtttgatttcctttgaagttttgcaggaaggacagagtacaatttattattcccctcaaacaccaaaaggaggttttttggtgctattaatagagtagtttcaactggagcagctctctgcaagttatagccagcaggccaaatccagcctgtggaccaagaaaggtttttatatttttaaagagttacaaacaaaacaaaaactacagaagaatattcaacaaagatatatgtggccagcaaagcccaaaatagtatctggtcctttacagaagaagtttgccaacccccgaactagagtggggagggggcaagtgggggaggctagattatagatggatggagagtaagtggtatataaacaaatacaaaagtaacaagaattatgactataaattggaggggaatgtataaagtagtttggagatgcaaagttgaatgagtgttctttgtcgatttaatagggaggaaggaatcattacacaaggaaaatcagcattgacctagaaataagatcaaaaacaaaagtggagtgattcccattagatatcagtagtggcttacctctgtgacttgagaaaaggagattagaaatagataggtgtaggttttatactgggaatttattgaagttaatgcctgattttccttttaaagagcactgcatgcagggatgaattaggtacctccagaagagttatgacagtttgaaaaagtaaaaatttgtaattaattattgatcaaagttttaaaatagagcaatacagtatagttaaaacacacacaacacaaacagtacgttgtattgcgttgagtgatgaatattctgccttttttctttaatgttctataaaaaggtaatagttagaattaaacacactaaaattagaattatctagaaaaaacaacaaattgacagtgattataataaccaaagatgcacccctctcatcactcattattgtctgagattagagcagtcaggtgttattcttatttcagcactgataacttcattcaactgataatgctactgatgagagaatcattcaagaatgggcagtatgtcttatgttaattttctttctgattttaaggtgctccagaattaaaattataatactttgaatgaatgtgacaaaaactattaaactcttatttttatatttgggaagtatgatagaaatggaaacttctaactcaagttcagttctgtaacttagtcatgaacattgtgccatcctacattaacacgtgtctgacagccagaatttgttttacatattttattttgtataactgacatttaggacagcttttattaaaaatcatatttagaaatatgaaggctcttttaaactacaaatatactatgaggttgtaatttaatcacatgtccttatggtaatattatgttagattctgttatttgtacttgtaaacataattttatgtttattctgatgagtgcctacagcgtggcctaatttatagtcaataacacagaatattatagtgagtgataattatgcagtgtgttattataaataagggaaaattaactatgctctgagatacacatctattgtaatttgttttaccttaggttggtgcaaaagtaattgcggttttgggcattactgttaatggcaaaaactgcaattacttttgcacgaacctaatatttatataaatggaataataagtcaggccaacttcacagattctcctaatattggtctccagaagctttttatattcttactttctgttttaatgtcatcttattggctaatggagaaaagggcagcttttatctttctggctcttaacaactggttgaagataaaagcaagtcagacctttgggttctattcttatttttgctatttgacatatgccacatatacctgtggaccttttgtcaaattggctgttgtttctcttaaaagcctatattctttgtaatgcattaaacataagaacccactgctcctgattataacttatgtagttaataaatccatatttgcattttttaatttatttttatttttattttttgagaccaagttttgcttttgttgcccaggctggagtgcaatgatatcatcttggcttgctgcaacctccacctcccaggttcaagagattctcctacctcagcctccagagtagctggaattacagccatgcactaccacgccaagctaatttttgtattattagtagggatggggttttaccatgtcagccaggctggtcttgaactcctgacctcaggttacccatctgccttggcctcttagagtgctgggattataggcgggagccaccacgcccggcctaaatctatatttttaatagcatgtttgtagaacatttgaatttaagaagacatggttctatcattaagtaagtgtgggaaatacaaatgaaggacttgagactttagtaagttttagggaatatcatgctatttctcacaaacttatttgaccatgaaaaatttttttacatgtaatatctcacaggacctgcctccttaagaacatactttgcaaaaggccaaagtgatgattctaaaatgtgggggttttttggtaataattttaatgtttatgtaattgataataattaattgtaattttgctgtaccaaagaactgtgttttatgtatgcctatagaacccaataatttagagactgaaaatgtcaaacttagcctacttataaattgccattattctagatttgctctccctgactcttggcgtccaacaaagaatcaatttgttgctcataaccttatgtgatttatcagcttctctatcacctctgcctctataactgtcacagtccagactcccatcaatttctgcatgtgctctttgactctcagctccactcatcaccacaagttcataccactggtagcaatttttctaaaacataagacttatcatatttctcttctcttctcttctcaggacagtgtctgtacatagtaggctctccataaatatctgttggattattaaatgaaccatatctgcaagaccaggctactataaaataatgttctgtagtcagcatataacataaacatttcatttggttgaaattatctcagaaaaaattacttaaatttagtacagaatccagatacaccctctttcaataaatccatataagcctattttttttctttctgcgatggaaattgcttgttctttgcttgattgctgtgctttacatttgggggcaatactatgtgaaagatatgtatctttaaacattagaaatatatccaatggtaagatgcttataatatgactgctatatggattctgggttctattgagggaatagcaaacccatgtctaataccaagcccatagtagcaaatccatgctgatatagtttgaatgttggtgccatgcccccctcaaatctcatattgaaatgtaatctccagtgttggtggtggggtctggtgggaagtctttgggtcatggggacagatccctcatgaatgtcttggtgctgtcctagcaatagtgagtgtgttctcctgagatctggtcatttaaaggtatatggcacctccccattctctctctcattctctatcttgccatgtaacatacctgctcccgctttgccttctgcaaggattgcaagctttctgaggccctcaccagaagcagatggtgaagccatgcttcttgtacatcctgaaaatccacgagccaattaaatttattttctttataaataacctagtctcgaatattcctttatagtaatacaaacagactaacaaattgaaagcaaaatttgactagaaaattcctatcaagctgatatggtttggctgtgtccccagccaaatctcatcttaaattcccatgtggtgtaaaaagaacctggtgggaggtcactgaatcatggggtcaaggctttcccgtgctgttcttgtgatagggaataagtctcacaggatctgatgattttaaaaagaggcgttcccctgcactagctctctctctctctttgcctgcagccctgcagccgtccacgtaaaatgtgacttgctcctccttaccttccaccatgatcgtgaggcctacccagccatgtggaactataagtccaataaacctctttcctttgtaaattgcccagtcttgggtatgtctttatcagcagtgtgaaaacgggctaatacacaaggagtggggtgttactataaggatacctggaaatgtagaaatggctttagaaatgggtaatgggcaaaggttcaaagagttttgaggcctcagaagatagaaagataaggaaaagtttggagtttcttagaaactacataaatggttgtgacaaaaatgctggtagaaatatggacagtgaagtctaagttgacaaggtctccgatggaaatgaggaagtcattgggaattggagcaaaggtcacctgtattattctctagcaaagaatttggctgcattgtgttcatgtcctagtacatgtcctagagatctgtgcaaacttaaagttaagagtgatgtctttgggtatctggcagaagaaatttctaagcagcaaaccgttcaagaggtggcctggctacttctaacaacctactgagagcggcaggaggcagccaaatgcccaagaagataggggtgggtccgtggtgaaaccccaccttcaagcaaaaaacagcttgaaggctgaaagaccagactgctggtcctggatgaaacccgcgacccagagtgagaacttctgttcctgttcgcctgccctttcctaattgattctttctaaataatgtcttttacccaatcgaatgctgccttttccaatagtacctacagcctgcccctcccctatgctgaggccataaaaagccccagacccagctatgcacagaggagagaactgcccgactgtgagattggggtaccacctcctgcatcccctctccactgagagctgttctgttgctcaataaaattcgtcttcaccctcctcacccttcaatgtccagaatatcctccttcttgggttcagtacaagagctagggaactaccaactgcgagtacaaactataacaaaggcaagctgggacacatcagcgtggcccagtgaggcccaggtggggtgtcgctggccagagattcacggctttcaaagtgttggagaagaaaatatcgtacatcactatagttagctacaggagcaaagacatgacttaaagttggagcttatatttagaagggaagtagagtgtaaacgtttgaaaaattcacagccaagccatgtggcaggaaagaaaaaatgcattttcaggagtgggatacaagcaggcttgtggagcaatcacttgctagagaaattagaatgagtaaaagggagccaagtgctaatatccaagacaatggggaaaaggttttgaaggtatttcagagatctttcaggcagcctctatcatcacaggcccagaggcttaggaaaaaataatagtttcctgtaccaggcccatggccctgctgcctgccttgggaggctgctccctgcatcccagccactctggcttcagccttggctcaaaggggtccaggtacagctcaggccacagctctgtaaagtgcaagccataatccttggcagttttcacatggtgttaggtctgcagatgctcataatgcaagtgtgaaggacgcttgtcaacttctgcctaaatgtcagagaatgtatagaaaatcccgggtgcccaggcagaagcctgctatagggttggagccccacagagaaactctactagtgcaatgccaaggggaaatgtgggattgtagaacccacacaaagtccccaccaaggcactaccttatggagttgtgggaagtaggccaccaccctccagaccctataatggcagaggcactagcagcttgcacctctgcctggaaaagctgcaagcactcaactcaaacctttgagagcagccacatgagctgcaccctgcaaagccatagaggcggggctgcccaaggccttgggagtccacccctcacacaagaatgtgggacatggagtgaaagaagattattttggaactttaagatttaatgattgctctgttgggtttcagacttgtgtggagaatattgaccctttctttgggccaatttatcacttttggaatgggaatgtttacccaatgcctgcactactattgtatcttgggagtaaataacttgttttgattttataggctgatgggtggaagtgcatgagtctcagatggaacttatgactttggatttcatgctggaatgatttaagacttttgagaactattagcaggggatgattgtatttttcaatgtgagaaggatataagatatgaggggccaggggcagaatgatagtgtttggatgtttgtccacttcaaatctcatgttggaatgtaatcctcaatattggaggtggggccaggtaggaggtgtttgggtcatgggggaaaatccctcatgaatggcttggtgctatccttgcgatagtgagtgagttctcccaagatatggttgtttaaccatgtagcaccttccccctctctctcttgcttcctctcttgccatgtgatgtgtctaatcccccttcaccttccaccatgattggaagccttctgagaccctcactagaagcatggcagaccacatttcctgtacagcctgcagaatgtgagccaattaaacctcttttcttcctaaattacccagtttcaggtactcctttatagtaatgcaaacagacaaatacacatgctaatatcttatcagtctaaggaatatgcttatttagtgagtgaagttttattcacacagtttcttagttttcttgttctttattcttctatttgtttaatttaaaaaaattatcttttggctgaatttgtttcatttgatttgtataagtaaaatgtgtccatgatccaactatattacatatattcttgttttacccatgaattatgtatgcaatgatacagtagacagatgtgatatttctggagaaatcagaccatcacaccaccaggttttaaggtatccaatcatccactgaaaataccactttgagcaggggtatgtatgtgggatgaaggagcaagacagaagaatagaagaagaaaagaagaaggaggaggaggaggagcagaagaagaaaagaagaaacttatcactgagtgaattagaagaaatttcaaaacatttatgtgggagaaatgctacttgaatgttcaggtatcttagagacattataatacaggcaacatagccttaagctacttgcaatttcacatctgtctcttcacttgtgtaatgcataatttattatcaaatatactctgtaatgaaaattattatataatgtataaattattcacagaaagcaagttaggtacttttaaaagtgatgacttcttgcaggtcacaaaagagcaatgtgatatattaaatcaataatttactagatgtggcctgtgactctttcagtttgaaagaactgctgtaccttacaaaactgctagtatatttctagtaaattacttatgcattgatatagcctgattgaatgtcacaaatcataaatcctagtatagaatatgtttgaaagctatatctctcatggagcattttttaagagaaggctttcctaacccttaaagtctgtgatatgaatttgaattcagacagctactattaccagtattgactttaaaattaaaattactactgtttgtttcttttgttcaaaaatttgatcttagtaaaaatacctaactatccagccattcccttcatgtctttttatgtctcccctataacaacacataattcattttgtttaactgccttaaatgataagcctccaataatgctccattacatgtgaattgactttgtttaaatttcacacttctttttaatactaaaaaaaaaaaattccatatcagtgtggtaatcagtggcttataaaccattttaatgactcaataagtcatgttaggatgtaagcttctacacctgtcatctcactgattgcctggattcattcattagatttccctggctaggaagccatcaccttcatccctcagtgctctgtgagctgttttctccatcagagagtgtgatcctacagaaagagtcattctatgacaaagtcctatgaacagctatatccttgaatagatcttccatgttaccacatacaaattctactactagtaatagttttggagggcatagacagttaatgtatgatactatgtgactcattttgtaccccaattaaaaaattgggatataatttacatacataaaattcactgttttaaagtgtacaattgaatgctttttagcatattcatgagttttaaaactaacaccattttctaattttagaacatttccttcactcccaaaataatttcagtacccattagtagtcgcacgctgttgtcactacccccaagttcctggaaacagctaactttttaggaaactgtatgggaagataatttcttaaaagatctgaattattggcagtttttgaaactaaaatagctttttatcacatagttgatgtcttactgctttttaatgatgaaaaccttttactatttaaagaaattacttaaagcaactaatatattagtttaaaatgactttaaagggaaaagcgctctttaataatttgttaacttctaccaaatcgcctcaaaaatgttgctttcttgggaatgttttctctaatttccagactttttcagaaaccaccattacttttaggacagtaaatgcagtttgtaattctgtatttattttgtatggctatttgattaatgtccatatctatctctagtctataagatctgtcaaatcaaagtttccatgtcttttctgcatactatttgtatctctggagcctagcatagtacctgtttttataataggtttccaataaatatatgctgtattaggaaaaatgacaaaatgtaaattattaatatcttgctattgactaaatacatggagtataaaactcatagatttaaaaaatccttccatttaggatagcatggtagagtacaacataaaactcagcacattggaatcaggtttaggtttaggctgggcgcggtggctcacgcacataatcctagagctctgggaggcagagtccagtggatcacttgaggtcaggagttcgagaccagactggccaacatggcagaattccatctctactaaaaatacaaaaaaattagtcaggcatggtggcaggtgcctataatcctagctactcaggaggcttaggcaagagaaccaggaggcagagattccagtgagccgagcttgcgccactgcactccaacctaggcaacagagtgagactccacctcgaaaaaaaaagaaaaataagagaaaggtttaggtttaaattccagcttcagtctttactgactgagtagccttaggacagagggaaatacaaacttgaactggaacaggaagtgtctgttagatctggtatgtagtgtgggtttaggaaaatgaattagggaactgccctgatctactccagaatcttctgctggcaatataatgaggcttttgtaaggccttaggaaaatgaactaacctcatcaatctcaggaggatacaaagcttagaggtaatagcagaagaaactttcttagtagtttgccaaactgctcccttgacagaggtaggaatgcctttaagtgatcctactttgagcactgtcactctctaggagaagttcatggcttgtattttcttctcttaatttttctctaaggatcaagagcagagtactccatcccaaagagaggaagccatgtcaattcagctgtttctcaatggttgaggtcactgcctggctgttgaaggtcaaggtggatgtggtcctctatttttctttaactctttatcttctagaagcctggggtgaaataagactactagtagcattggctgttattccacctcagacttctaaagaagagaatgtgactcatcttctcctttccgttatattcaggagctcctttccttcttccagaaatttagatgaagaagaaaaatgtctatattttctctagactttaaccgaatttttttctaactgaattttagcatttctcttaattacaaatgtaggcaacaaagcacatgaatagtaaaagttaactgggactttgtcaccagtagaaattatagattttttatactgcattataatcgtttcagatacctcaaaatggtgtataaggtaatgttactattaccttaataccatttgaatcttgccatgactactaacagttactgttatatactttattttcttcacttgtaagaagataattactaagttgattcaacacacccacacacacacacacacacacatatatatatatggtccagtaaaactgacaatacaccaggaaggtacatttgaggtctcacttaaatgtagactacatggtagttgagaatggggcacatcttcgtacaatgagaatccatatgactgtccatctggagatatggtttaaatatgaaccccaagtcaatggtaacaataaaatgcaggttgagcatccctaattcaaaacgcaaaatccaaaatgctccaaaatctgaaatttttgagcaccaacatgatattcaaagttcatgttcaaagaaaatgctcattggagcattttggatttgggattttcagattaggggtgttcaactggtaagtataaatgcaaatattccaatatccgaaaaaaatctgaaatcggaaaaactccagtccaagcattgtggattagggattctcaacctgtatactctgaattataggcattgatttgcaaattacttcttacattggctactccacatagtatgctccagaatccatagcagcagggatttgtttataacaatgttaatgattctctagactagcatccaggaggccaactggagacagagtgtatgtaagactgtcagaaaaatagcaagtgctcactaacattagcatctcttcttgtttccatttaaataataattttcccctatcgtatgaaaacaaaatatgctttggttttatcccaatgcaatgcaaaatacattaaaatacattacgcttctctattgaaaacctttccaacacataatctgtgtattttatccgtgaacaaaattcctgtgtgctgctgatgaaaagcagatatttgatgatacacagacataatttaccactaagcatttgttttatgaatcttttgtctgcatgctttaattatattacatatttaaatgatttcaaatgccaatggctcagtatattagattagataatctctatatgcattgataatggaatgagactctagacttatttcacacccccaaaaaattttgtaaacctcaaggacatttgacataaggatcttagcacaagacaagtcatgccatttaaacaaaatatctgaaataaaagtgtagttatttatttctgaattatatatacccaaacaatatgatttcattaaaagtaaggcatatgaataattggtaaattagagatgactttaaagttggaaagctgtaattataaaattgacttcttattttttggtttgtttcaaagctttctctttaattaacagggtaagagggctcttcttttaaaagcttgtatcattccacatatacttggaagttgaacagagaatggtgccagaagaccgctggatgtctaatcttaacatatttgtgtttaggcacttttgacagaccttagaggtcatcagtgattgagtgacttaaatctttttttttttttttgcataatccagatcttatatcagcatatgtgaaacaaaggtattgaaaagaacagagctagcgctggctaagtatatctatataggcctttgtatactgtccagagttgtatttcagatgaaatacaaaaatgcatttaagatgaaaaattctatcaggtttttttttttttggtaggaatttacattctcttaattctcatacttagcctggaggaagatttcaatctcaccacttattcttagtgccatacatcatttgtaaaacattaaaccaattaaaatattccaggcactctttggttctggagatataaaaaggtcaatacaaagtcctttgcagaattaaccagtctacctatagggcagtgattaagatcatggcttcataagaagactgctaaccatgtgtgactttgaactagtggatgaacctctctctgtgtcttggtttcctcatctataaaatgagaatattaatagtctctacttcatggcattatggtgaaacacaaaataatatgtaatattattattaccagcttgatacaggtaagctgtcatctgtcaacaatcctcctccttatgctcttgttctactgaattacttgaaattccaccagcatttcctatttgctctttacttctacatgtttatatatgctgaaccctagttgtgaaacacataatctctttatttcctgtggctcacctagtttcttcttacttatacttttaaaattctgtttacatatcactttcataaggaagccaccctgatctctcttcacagcaagatcagatgtatatccatgctgtgctcacagtactgtttttatttctagcaatggactttacctatctgtatctcatcagattataaactctctaagggcaaggacaaggttgaattcatgttgttatccccaattttaaatgcaggaccaggcataatggtacttttaacacctgactaaaaggaatcaacaaatgatataatcttttctttggaataattggtgagctagtagttcattaacagtctaaatatgtttattcttagggtcatatattataactgcctattaattggatgctcactgtacgttgtaacaatggaaaagattaagaatatttcatttgtacggtggtcagtactctctagtttaatgatttacatttgaaagttatgaggtcctgaaagtactttgggctttacatacatcaaataaatctttattcaggatatagagttgcaattttagaatagatattgattctgtcctgggagctctgaggagcacggggagggtaaataggaattttcttctagtaagaagacaagagattagatgcctgaagaaaacaagagagctagacagccagagagctggggtaaaaataatccaggctgaaagaacagcatgtgcaaaagatgtggggcagaagtctgatcagtgctttgaggaaatatcaaggagcctggtgtcactcaaagaatgtagcagagggaggaaacaataaagaggtcagggtgtgtatgagcagatgaagtagaactttggattataagatctttggcatttattctgatttgggaagccattggtggattttgagtaaatatgatataatctgaattatgctccaaagatcactctattgtgtttggaagatactatatggagaacaaaggaaggagaaaaactagttaggaaagaggaaaagaggtaagagacggcagatgctctggataaggttagacctgcgccattagataaaataagtcaaggcaacatgattaggtcagataaatcaagcaaataatattaaggggaaaatctggaatctgtcactatttttgttttattacctttacctaatattgagtgagattatggataagaatgatatatgacttctacttttattcagtatgactgtatataagtaaattactacagagttttaaaagatactttttaaagtaagaaaaataaacagggaagaaattattttctaaacaaatttttttaatcacaaaaggaattgtaggcacagatatgctgttctgctattatttaatatatatgacaatatcatcagctaaactgcaaagtttctcatcactgaacaggacttaccacaggatgcaatcattttggatttacttctgacaaatataatctcccagtgtccaacttaagctcttaaaaacattttcttcagatttaacatatacacttaatcctaaatcatggtaaaaatctatcttctaaaatagacaaactttataaattgatttggttcggtttgagtttacagatatttaacaagagcctatttatataaattaaggtgttacacgctaaacacgatattatagcctatgactgcatggagcttatgctcttctagggtgcgactaaggcaacattataagaaaaagcgaaatgtagttgtgttctaagagtctgcagaatatgatcatgttggtatttgcttctacactaaaaaaataaagaataaacaaagaaaaagttttgcttattttcactcctaggaatcacagttaacttcctacgtatgcactcaaaagcaatgcctaccagtcagtcacagtttcatcagagattttagtcaggatacctactgtgggatgggacctcggctgaaaagcagcaaagggccagtcacctaattctcaaacattgataaaattagaaatagaggcgtacacatattaatgtatagcaaaagcaatcactagaataaccccaaataatataacactgaaacattgaagagagggattgtgtctgttacatcatcttttgtatcagggaataataagatattattatctagaattggtaaataaagaaacagatcttcctatgttatatggagttttgggaggggccatcatagcaatcagaactagaaatcagaatcttcagcttctgaccaataagaggatagagagggataaggcagatgaccattgctttaaatatgagctacttttttattattttcttagttatcatatgcatatctcagataaaaataaaaaaattatcttaaaaaaataaaaaataatttgtttttacgaacaatgaaccctctggcttattacacatactttaaatactaaatttgacttttaagtattaagttaggccaggtgtggtggctcatgcctgtaatcccagcattgtgggaggccaaggcgggaggatcacttgaggccagtagttcgagaccagcctgggtaacatagtgagacactgtctctgcaaaaaaaataaaaataaaaaattagctgggtgtagtggcacatgcctgtagtcccagatacctgagaggctgaggtgggagaactgcttgaacctgggaagtacagactgcagtaagccacaattgcaccactatactccagcatgggtgacagagtgagaccctgtctgaaaaaataaaaaagatattaagttattacatctgaaagtcagccagtcctgtgtataagtgctgaagaaaaataatttgatatgtgacattgattaagaaacaaaaatatatcaaattctccttattgtgtgacagtgacagccacagaccaatgtttaaaataagttatttaatatgattttctcaacaaccttgcaaattacacaatatcttatgattagatatactaaataaattgaaaagtcacgcagaaactcagacttttttaaaaaattcattgtttagtattaaagatatctagctctaaaacaggattttttgttttactatactagaaattattggttgcaatcataaacttatcttgaacttcttttctattagcttaaagaattcactgaataaattttattcgatttccataatatcatgtccattttgattaaaagtctaatgatacttaactgatggtaacaattatctcttagggaaatttttaaatactcaacacctgtttttcaggagtgaatgaatgtgtgtattcacatcataatatagataaattatttttaattaatattaaaatgacagaagtatactagttaaccaaaacataacacctgatgcaagatgtgatgcatgtttatcagcactttgcttctcttggaactctgcgttggaaatcacaactcccatatatttatattccaacttttgtcagaaactttactagattctctatatgtgttgtgtttactaattgaatcttcacaataacttactgaattaataactattaatctagttttagagatttaaaagtcaagactcagcttgccttaggtcacaggtgtcagaagacatctatttgaattcaggtctgctgtatgctctaaattgtctgtagatatgaactattcaaccaacattaagtatacttaattgggccataagtgatcctataaaatggttttggctcaaaaggatttttaaaaaaatattatggcacatttcatgttgaaactgacatttctatgacctattggaaaggagtatgattatattaggtgggcatattcttagtgaaagcatactttagtctagtgttcctgactttttcacctgtcattgaaagccatctacttaatcatttatccctgcgattaacatctatcttaataatctatagttttttgtgtcctttgatatttctgcatcatgacttttagttattttgaatctggctcctggaaatttttcagaaattttctatagtttccaaatgatcattgacagtaaaatttgaaaagttattttctatgtttaatatttttttctagctaaattagatttttctaattctaaattacataatactaatttatatggttctaaattctaatatgatacagtgaccctttctcctaaatttcctataaacttccatgccatcaatcactttttctctctttggaacaattaatcccaaagtagttattactctatttattccttttgccttctgatagatgaaccataaatgcaagtcaaaaattaaccagctgttctggtaatgatggaccaatcagaagatgtctaccatttctttgtttcttataacaatattttgaagtaaaaaatgttaatcatctctatttcatagatgagacaaaataaatccagagaagggtaagtcagaaattgggcacatgtaattcttataagtgaatacattctacaactaggaaaaattactatgtgtattagatatcaaaaattgtcatttattttcactgaaattaatagtaaaaaatgcaatttatatcatagaccaattcaaacacttgaatgcatgcaggtaaatatatacacagaggtatatttattgtattttatttatttctttatatataacagagaaaagttccaaaagtaatatgtactctcggccgggtgcagtggctcactcctgtaatcccagcactttagaaagtggaggtggatggatttcttgaggccaggagtttgagaccagcctgagcaacattgcaaaaactctactaaaaatacaaaaattatctgggtgtggtggtgtgcacctgtaatcccagtcattagggagtctgaggcaggagaatcacttgattgcgggaggtggagttgcagtgagcccggatcacgccactgcactccagcctgagcagcagagccagactccacctcaaaaacaaagaaaaaaagtactctctctatgttccttaaagtatacttttttcctattattttattaacttttaatttaattttatttgattaacttctatgtctattataaaaatgctggtcacaacccaatgaattgattttatgattcactgttggtgacctatagctggggaaatctgtcctagatgatatcacttctgtgttaatttttgtacaatgcactaggatcattcaatggattagggagtctctagtaaccctaagcaatgatatcactgtttctctgtttttcctttcttatatagagagagttatatacaagtatatgatttttaaatatgcagtattatatctccttctagacaacctaattcctagaagaaatacatattcttctttatccttattacagataaagatttatcaccagttcttaataatatttaaattattaaatttatctacttgtgttgaaatgttagtttcagtgtgtttgttcctcatgtactcagccaatattttctgagcacctaacgttttcaggtgcaagtcctgaaggcacacaaattagcataacaggcagtaacccagttctcagaaagtttgcctattatagtacacatattgctttagagacacctgggaatataagcacttttccaaaaccaggtctttattgaattcaactttaaaatgtttgataaaatctctgcattgctagtacgacacttgtagattgtatgtggaatagttgatgttctgaaacacagaaatgtctttaaatattttttgattttttctaatcatgaaaattcagccaaaaaatatgttccttaccatgacaacttggcaaggctctattccatccaggtcttccatcatctcccatgatacaggtgagtgttgaataaccttgaagaacataaccagcatcacagtaataggtgactgttgaccctaatttataatccattccaagtctggtgccattcattatattgcctggatcaaagcaggactctcgcagttttgctgtaaaacagtgttagtataacattaattgctttaaaatacagttggcactccgtaatacatgggttctgcatctgtggattcagccaactgcagattgaaaatatttggaaaaaactgtatctgtactgaatatatacagactttttttgtcattactccctaaataacatagtataacaaccgtttacctagcatttacatcatatcctgtattattagtaatctagaatgatttaatgtatgtgggaggatgtatataagttatatattcacatctgtgaatgttagtatcagaaggtttggaaccagttacccagggataccaagggacagctgactgttttttatggacctttaagacatgttcatttctttttctaacccagaaggaaaagcagcagcatcatttctgtctttttgggggggctcaaagtacaaaggagcccttgtgcatatctgacaaattgctaatgcatatttattagtaagataataaataaattctaaagatcttcatagatcttctcattaaatttagtatccaatgcatatagtcaaacatagggttttagaatttattataaatattatgtgctaataatccatgtgtaggtactataaatgaattactttggaaaaaaagaaggagcccttataaaacgtctttatttaaaagatctccccacaagtaatgccatgttactgaacctagaagtggtttttcttcctatgttgagctcagttcatttcaccacctacagcaaaataaaaggccctatttgtctgccctgcaaccatttttcttaccctattttctccagtcattctccacatttttatcataggtctcccattgtaaaatagcaaaatccaaaccacagtattttttgacagattttctatccctatgcaaaacactttcaaaactagaggtaacagacagattaaaaaataaaatcctttcagagcagaggaattgttttcattgtacccagatattgaacaaagagactgacagaataatttgaaaatatgtagagaaatggaaagattagctcattcattttatggcaaaggtactagaacactttgttgttaacagatctggatgaggccttgagattatttccattttgtaattattgattacttaagaaataataaagaaatgtacaacgtaaaggccattacaataaatcaggataacaaatgtagtgattttctacatcagaatttgttttgtgctaataagaaatcagacagtgggtatatctctgaatatgagtcatggaatctttgaaatgtaagtcaacgatatcttggtgtttggctactacaaacatatttttatatcaaaatataattaactataccagtaagaatatgtttctttcattcataaaagtttgcaaggagtttaatgtactttagcatttttaagaaataatgagaaatctgtgctttaagaagaacactatatataatttctcccaattcaactaaagaggaagtggtagaaccacacatttaaataattttaatagaataacagataaatgaggaaggttgcctcccttctttccttccttccttcctctctctctcactttctttctttcttttactctctcctttctttcttcctttcttttgttctttcgttctttctttctacaaatacttaaaggctcacgaccctactattttctttttcttttcttttcttttctttctttctctctttctttctttgttttcttttgtttctttctctcctttctctttcttttcttttgtttctttctctcctttctttctttctttctttctttctttctttctttctttctttctttctttctttctttctttctttctttctttcttttctttctttctctctacaagtacttaaaggctcactaccctgctaactctggaaatgtagcagtggacaatcagaaaatgttctggcactcacggaaattacagtctcttaaagaaagcaattatattaaataaagacttgcgattttggcatgctgtataaagagaagcattcaggaacctcactaaaaagtggtatctaaagtgagcattgagagaataaggaacagattaggtaaaaaggcgatgggaaacctgttggggaggaggtgtgctgacatgtgcaaatagataaatgtgattcctgggtttcaaaccagagctaaatgacttgatcttctcccaagcacacatatacacacacacatggatacacttacacaaaatttgcactccatatattatactcaagctgctctgtaaaaattttgtcccaaaccatggaatatatttctttcacataaaatattcacacaactctttttatgaaagaaccagcagggtaactacttaatttggtcactaagaatgggcatttagtgatgcaagggttgatttgtttatttataaaaaataaaactttacattgtaccttcccttaaacaagcaggaaaacgcaatgtaatttttagacagaacagaaacctggcatttatagctgggcttcgtaaaattaaactaagtccctggagggtagaggaaggatttaaatttctgtttaaaaggattaatctcgttgacaagtctattctcctaatattcatcttttgaaaagtttgctttctccttctttgaagttttcctcaatgtttcaatataatgtcagtgaaactgtaatgcaagcatccggttttttgaggaaagggacacatgtttgacaaatttaaaaataatgcctctgcaacaattttacattgctagcctcaatttgagagaatgcccttatgttattattatgtttacatactgctttaaatccttggtgaatagttttctatgaataatactgtctttatttatatccacatatgccatagcaattacacctggaaattttgaaaacacctggagaatacttaaaaaaatgtctaggcagtagctggaaagtgattttagtttctgaataaaaattatgaggcagacaagttatcagcattatttttatgcataattaattttttctgcttaatagtgatttgcctactgaacagatactaggtaaaagagtattttgcctccttacagtctccaaataagatatatcagaagatatattttagatcgctgcatctaaaatattttagttttcttttaaaattatttctgctgaatataaatagatgtatatgtatatatatatatttatactatatatgttttattagagctagaagtgaacatacacaataaagcttacgtcttaattttttttgtagcccaggctggagtgtagtggtgcgatctcggctcactgcaagctccgcctctccggttcacaccgttctcctgcctcagcctcccgagtagctgggactacaggagcccgccaccacgcccggccaattttttgtatttttagtagagacggggtgtcaccaggttagccaggatggtcttgatctcctgacctcatgatccacccgcctcggcctcccaaagtgctggaaatataggcgtgagctaccacgtccagccacgtcttaatttttaattaaaggcaataacaaatactggtgagaatgaggagaaaagacaaacctcatatacagttgagggggatgtaaattagtacagccactatggagaacagtatcaacagtgtagaggttcctcaaaaaactaaatatagaactaccatatgatccagcaatcccactgctagtatatatccaaaagaaagaaatcagtatatcgaagagatatctgcactctcacatttattgtagtactattcagaatagtcaagatttggaagcaacctaaagtgtccacaacagacaaatgcataaaaaaaagtggcacatatatacaatgaagtactattcagccataaaaaagaatgaaatatttgcaacaacatggatggaactggaggacctaagtaaaataagtcaggcacagaaagacaaattttgcattttcttacttatttgtgggagctaaaaattaaaagcaattgaactcatggagttagagggtagaaggatggttaccagaggctgggaagggtagtagaggtgttggggggaaagtggggatagttaattggtacaaaaaaataattaaaaagaatgaataagatccagtatttgatagcacaacagggcaactatagtcaataataatttaattgtacatttaaaaataactaaaagagtatagtttgattgtttgtaacacaaaggataaatgcttgatattatggaaaccccgtttaccctcgtgtcagttattacacattgtatacctgtatcaaaatatctcacatactccctaaatgtatatacctactatgtacccacaaaaattaaaaataacaaaggaaaacttttcgtgtttttacttatttgtgggagataaaaattgaaacaattgaacttgtagagatagagagtagaatgatgcttaccagaggctgggaagagtaaggggtgggaagtggggacagttaatggtatgaaaacaaagttagatagaatgaatagggatctagtctttgatagcataacagggtgactacagttaacaataatttactgtatctttaaaagtaactaaaagcgtataattggaatgtttgtaacataaataaatgataaatgcttgatgtgatggataccccatttaccctgataatgattatgacacattgtgcacctgtatcaaaatatctcatgtactccataaatatatatatatatatatatatacctactatgaacctgtaaaaattaaaaattttaaaaaggaaaaagaccactaataactttactttttaagtgctatagaaaccaacatgcttaagtcaacatttgtgatatatgttacaaaagacaaagaaaaatatttttactatctagggcctcaatttatatgtccattcatttgggtgtgcatatttttatattgaaaataatgagatgtttgttttacaatgatcattataaacatcattacaagcattgttagccttaagaaactggacaattacagaggaaacatttaccaaaataagaataggaaataaggaagctgataagacagaccctgaagaccctgaagtgggcaatgaaattttcccataaacagcgggggtttgaggaccaggtagaaaattaatgagattggatctcgagaacattattgtaaagaaatatcatctggagtataaaaataagacctggtggaattgtgtctaaatgtgtactggtataataggtgaagacagtgggtggggaagaaggatgtagttaatgggataattatgtatttctctctacctatacttatatttttctttgcctttattctcaatgtaataataacttatgtagtcttgtgtaaatcattttaacaattcgattttcaattttttgctttgtaaaatggggatagcaatacttacaatgctgttctgtaatgtttttattgcatttatacatgcattatctctgtccttcccatacctactcatgaggtctaatcattgaatctagagtagagtaagtgcatagtaaacaacatctctttttaaaaaattacatttgtagttctttatctatgacagcatgaatcttaagtttttggaaatgatgaaaacattgaaattgattaagctggggaaatagggagggacatatattcagctgagataatggcaaataggttttatctcaattgcttaactactaggctttagtaagggctacatggtgtgttacctagagaaagcattataaggtcctgaccagtttccatgagaaataaagccataatcagttagtaccatctaccattggattgctagtgagatactcttgctgcaacttttatcgtagtgatatttggaaatgttttattaatactaatttacagtagaacctcactttatctctacagatttgttaaaaggtttctttctttctttcttctttctttcttttctttcttttttaaacaggtcatatgtataagcctttcagcttgcaggtataagtagctatttctaagccaagttctcatgtataaaatttagaacaggaatcagctccaaggtttctcacatttaaagaatgttattattctaatatttgaattatgacttgattttaaaacagaaaacacctctttacgatgctcaaaagcaatcaagtagcaaactgaataattactgtgtgtaggcactattcttggcacttagtgtatagtggtgaatgaacagataaaggctttcctcttaagaaacttgtattttagaatatgtgtagggggctactggagtgagggggatgcacatggtaagtaaacttaaaaataaataagcaaggaagtatcagatattgacattattaggtagcaagtggaagattttgaaattaggaatacagaaaaagcaaaacaaatatgaagcaaaaaataaaagaaaaaggctaataagtataaatatactaaatccaaggtatcaaaaaaccagaaaaaaatgcaacttatatgcacctgaaagcaggctttcataatatataaacaaagtggtaaagattttaagaaaaatggcaaattaagaatagtagattttacccaactatttcaataattgctagaccgagcaggtcaaaaaatggtgagaagatgaatatttaacaatataattagggagtttattggatgtatataaaaacttgcactcattagatgatacaaatttctctcctagtacacaaggaacataaatattaacgatataatagaccacaaaacaaatcctatgacaagccaaagaaccagaatcatacatatctgatcatgcaagtaaattagaaatttataatataataagttatagatttaaattttattttgatagtttgaaatacttttaagtagcacttcagcaaagaaaaatcataatgctatacttagaaccaatttagaataaaattatgataaatctgtacatatcaaaatgtttgcatagcagcttaagaggttcttaaatgaaaatgtgtagatccaagagaaaaaatgcgaattaataagcagtattggccaggcgtggtggcttacgcctgtaatcccagctcttgaggagggccggatcatgaggtcaggagtttgagaccagcctggtcaacatggtgaaaccccgtctctactaaagatacaaaaattagccaggcatggtggctcatgcctgtaatcccaactactcagggggctgagggacgagaattgcttgaatccgggatgcaaaggttgcggtgaaccgggatcgcaccactgcaccccagtctgggcaacacagcgatactctgtctccaaaaaaaaacaaaagcagtatttatctcaagaaatgagaaaaaggataagcaaatctagagaaaataaaacagaggaaataacatagataaaagcaatactaataaaaatattaaacagtgttaacaaaaatatgcagcagcaaataaagtaagaaacactgtgaatattttcatgtcaatatgtgtgaaatcatgaatgaaaggaactagtttttagaaaaagattttttaaaatctaagataaaaaagctaatctaaatatatttacaaccattaaaattccaccaccttaaatcactgggtccatagtttcagttctagaaaacattcaagaaatagatgatcctatcttatacaaactattctcgatactagaaaattaagaatgctcctaaatttaggcaggtagtgtaatcttgatatcaaaaccagacaaaaagagtacaaggactaaaaattatagcccaatcagatggtactaaatcaatgataatgatacaggagttaataagaaatcacttaggcagatagtaaggttttccttttaatgaaaaggagccatcatatcactttcttttctaacaaagagcagcctgcaaaatggagctgcagacatagccaagcaagccagaagcttgcacaggtgaatgcccacagttgtgcccataggaaaaggctacctgggactaggcatgtccaaaatgggggcttcatctgcccttctgtttgccaaaccatgagtacagtaaggagaagacaatatagcccctgccaggcaaagcctccttttgcataagattagggtggggtgaccagccttccccgcacactatgtaaatgtcatacctggtcaaaccagtctgtgggccctatgtaactcagacaccgcttcctcaagcctgcctataaaatctgacgcagtcaacagtgggctggctttccccttttggatgcccctctcttacgaaacagagagagctgtcctcctttgtcttttttttttgcctgttaaacctctgcccctaaactcactcttcatgtttgtccctgtccttaatcttcttggcgccaaatgacaaaccctgggcatttacctcagacaacatagatatatttttgtaatatagagtaataattcagtggcaatatacaccatagttaaaactcgggaccatagttaaaacaattaataataattgaatgaactcgggaggcggaggttgcagtgagctgagatcaccgctgcactccggcctgagtgacagagcaagattccatctcaaggaaaaaaaaaaaaaaagaaagaaaatctcagtatgcaaaataggaaaaagatgctcaacttaatagtaataagggaaaaggcaataaaaatgacaatgagatatcatttaatacaattagcaacttccaagtttaacaaaagcactggtttttaaaaactggaatttctgaagctctcatcctctgatttttgagtttacattggtacagcctctttagagaataattcggcaatacagagttacattgaagaggttcataccctttgacccagtaatcccactctttggtatacagatgtcctaaaaagaatctcacagatatgttcatgaggacatgtaaaagaatgttcatttcatcgtcattcatttctggtagtaataaaccagaacaacctaaatgtctatcagcagaaaaatttatatattaactttgatatagccatatggtggagtatcataaaggacttaataaattaaagctatatgtttctaattttgataaatctcaaaaacaatttaaggggccaaatcaattttcagaaggatacatacataataaaaatacaaaatttgtatgaaaataagaaatataaaaatatgtgcaagcataaatacatggaaaagataagtatcaacttcaggattaggggaatactagcatgaaaagagcaggaatatctgaaaaatgaccttgaatgctcattatggtttgcctacatggccagctagccaggtccccacaaatggtaagggaattatctaccaggtggttagagtggtgttgtggtcaagctcactctctctaaaagagtttcgaacccatattcccaaggtctaaacttcccccaagcatcttctgatacagagcaggtagcatttgcagaaaaccccaataaacagccaacaccccaaacctcactgtctgtgccaaatggccagtatattttcctactaacaaggccattttcctgctttttcttgtgaaatgagagacttacggagggatcaagctttccactggaatgaaaactatactgttaatgtccagcagatacccttgccctggcatacagttccaagtgatgacagagatatcggaggactccaagcctctgtttcttactgacttgtgagtttcatttccctaaaaacatctttcttacccatatcatgtgttgtgaaatttatcgtgacctcttacgatagccctgaagagactaacccctgttcctatggcaaatgcaaaaggagtttccattgtatatgtaatatttgattttttaaagtaagaataaagagatctgaagcaaatatagcacagtgttaatttttgtcaagttggctgatggatgctttggagttcattactctatataattttccattattgaaaatattaaacaaaaggtggtaacaaatcaaagcatgtgttttcagaaatcagttgataacttgaggtgaattattagtatgccattcatggactcagtaattgaaaaataaatttaaattttacacaacctaaatctaaatctgttcctatagacataaactataaaattttagaaaaatatatttataaatatccacaggcattctaacataattcatttaaacactagcagaagtattctaaaacattataactatatttcttctctttattatgaatattgacatatttaaatatctgtagacattttcttagagacacggtcttgctctcccaggctggcctgcagtggcatgatcatatctcactgcagccttcatctcctgggctcaagtgatcctcctgcctcagcttcttgagtagctgggactacagacgtatgacacccctcttgactaattaaaacaaaacaatgtagaaatctgctctcactatgtttcttaggctggtctcaaatttctgggctcaagtaatcctcctgccttggcctcccaaagtgctaggattacaggcatgactgatggcacccagcttacatattttctgaaatacagttatcgtctacgttgttccctttatcactgaaagtgttcatcaaattaaggtatttgactgaaacttcagcttctacaaaatgaggctttttttgtattttttattttttaatgttgtgtggctccagccaactcctccaatatactaattgttaatttgtttgcctgatacctttcctttggtagtaattagagaaatgctaatttccttcccactaataagaaaattctacagtgagaacgcttttatgagatgaactgtacataatctgcatttaaaaatacacataaaactaaccactaacaatgggccataccaaattattctcctgtataaaatatctataatttaaatcatgatactaacatggaatgttcatatttacctttgtattctagatgaaatccagtgtaactaacagatccatcactccgaaaagccaaatgcattgtatttgagctgctttctattctctctggtaacttgctgtcttgaaaacttccaatcagtgggctattactgtctggtccatcatagatatagaggaagtcatagtttggttctatgctaaaactgaaaaaaaaaaggaaagaacaaaagaaagaaagagaagtaggataattattattaggctgttaaccataatagttatataatcaaacattaattcagtgcttaaaaataataaaagacgctgtcaaaataagctaatataaaaaatcacctggcaacaacatatttaatataaatatcaaataagcaggggaaaaagaaaaaaacttgatatttttacatattttttaagttgacattgtatgcagaggaaatataagtgattgtaagacaaagagtttagttgatgaaaagatacaggatttggagtcagagaatgcaagttcaagccttgtttctgcccttattagtgacatattcttatgcaagttactttatgtggaggataatatgtatttttaaaactttttcatccatatattttgcatcatgaaaacacaaactacttttttcttcatcaatagtactcctaaaaatttaactctacaatcagatatggacaaaagctgaaatcaaaagttgaaatatattatttacatttaaataactcaaatgaagctttgcacattgtattaggcattctttttcctgaaagtaaatatattttcttcttttaaaacctaatgtaggagatatcaaaccaatacattatcagaattaggtaatgtgaaaaaggatattttagcatgtaaatgattcaaatcagttgtgttaatattgcaagatttgcataataaacttgccttaacaaccttcaaaagtataacaattgtcccacaatgatcatggaactcatacatttagaagacaggggacatgcaatcaatttctgtttttcctaactcatactgtggtagagaaatatggggtaaaggatagattcatttaggtcagcaagaaaagtcaaccagtttatgatataaaatgaaaccagtaaaacttgccattgttaaacattcatcagtagaaaaactattttggcaagttttatcatatttgcctgcatctaagcaatagatttgttacgtgaaaggcattatttccgaacccaaagaatttatagaagttaacgttccacaatctcatcctttacatatgcatgtacaagaaagaagagtccagctgctcagtttacttgtgcataagcagtggtaaagaaagaatgggatagtgcagaggttcccagacttttcttatatatgggcccctctaacgtgagaaaattgggagaccatcacactattatattttgttttaatttattcagtagcttcaacacttagttcaattaacttatcctgaaatttttcagtggatctgaggcctgtatttggtaactgttggtataataatatagcagaagtcagaagattaaactttatttcattacttattacccttgttctgagataaaacacaacttctgaatttcatctcttccaacattaaactttgatggtaattacaacttccttttctatatctgttgggagaatcactagaaacaagagctttgtaaatgacacagtagtatttattatgcacggaaggctgaaagcttatttaacaatggaacacagtacatttctttttaatttatagtttgggactaaatcaatacttcaagtattgtaacttctttgaaaatgaaattaaaacaaaaatattccttctaaggaaattttagagtcttagttattacgttttttttctgaaaaactgaaaaaacagtgcatgctaatattaccttatgttttacaaggtactttaataaatattaactcatcttgccaatagtcctgttgtataaggaagagattatgcttttcattttaccaatgtgtatgttaaggctctttaaaatcagtggtctacctaaggtcacataataaatgatagagctagaaatcaaatttaggtcatgcacttcatgtaatatgtccttctaccctcaagttatcaactagaataattttatatgtaaactaagccctgtatcatccattttgatatttctaatgtccgtattgatgtttcctcaattgagaaaatggggatagtaatagtacttagcttgggaatttgtcttacaacaggatcctggcataaaactaaaattatcattgttgttgctttggtattactaattagcaatgtaccactacaaatcacaaaaataaaattttatttatttacaattatgctaaatttttatgagttcaaattatctttacttaggaaaaacaaactggcctcagtacgttagaaaatattgtatatttaagcttaacatttcacataaaaactaaggagctttaacatactggtggcagaaaaaggaattgtgctactagagtcaacataactgattacatcaaccttagataataaagattggggacttttctacttggaaaatcactgagttgctattacctaacacttccaatgaaatcttcagggaaagaggctgggttttgtgatgccagctgttagcttcatgcgggaaaatggaggctcactcaaataaataacttgcccaaggtaacacaaatgacagtggcaaagctagaacaactattagcactgggataagtaaaaaataacaaaaaatgctatatacagaaataggaattagtctagtacaaatgctaaagcaaaatggcctaacaatatatttttttaacgtggaaataaatatataagaactcacctgatgaacgccaaggagataacatagtctgcattgacggtgatagtccagtcacagtctctgctatgcggatatggatgagggaagtttggtgaaagaataaagcctgaagatcctgttaaattgcctccacagggtgctttaatttaaacaaacaaataaaatctctttaaacattaatacaatttattagctatcaatatttttgaaatcacgtctctaaaagagcttatgaggctttgtacagacctgaattttatagtacttgatgcttggatacagcattatgtttcaagaaagaccattaaaatattgaatacatgcatacatacatggatacataaaatttagctgctttattggctttaagagaccaaaaagaatgcatatatacttttctgtctttctattattattttgtttcatgtcaaaagaaaagcattaaaaaagtgataaagatgattttcctctggttaccagaaaaaatcagatcaaagcaaaacaaaacctctaataataaatagaaaaataagacatgagacatatagcttattttcatgtctctcctggcacctttatttagtacagttattacagtttcaaacaaaggtttccataacacttaaatggagagcttcaaaaaattgtcagtgaaactcagagaatagattctttaggggattactgttgaagtttgctaaacagagcttgtgttcaagaaattatacattacacagaaattgacatcttcaaaaaaatagagaaatgaagaaagatatggaggtcttcgtggtgggatgggagagtgggaaatacaaataaatacacacacccaagtgagggacattaagattaggattctcacattctcacaatgtctcctacacataatcagtacatcggcattcttctctcaccttggtttcgaaattgtagttttctgagataaatatgagcattcagttataagggaaattaaatttttttgtcctataaaactggttttgtaaggaagagaattttgattctggcaacatttcagcatttctgttccttgcatgagttgagatatgtaatatcatcactacggtttggtaatttttccattgtcttttgtctggtactgccttcctccatgcacctctgctactcttgtctcagtacctgagtcactctcagaaaattgtctcagctcttactgcattgagaatatctagttgctcagacttaatatattcaccactactttcctgtcgcttatatgtttttgtggtacattataaaatgattagacataaactgcttcgatgttctgtagtcctccatctccaagcttaaatgcctcctgaatatttctctttacaatcccaggatagagtccctcctaatcaagatatcaccgtcaacctggtcacataatccctctcccttatccaaaacacttgttcaattatttgtctcccttacttttcctggctttctccactttgtccacaaacacgctcaggtttctttcatcttaaaaataaaacaaacttccctatgacctacttactttcactttttttaacagaaaattgtttactataaggaaacaccctgccccatataacttagataagactcacttatcatgacctagataagctgtctttgtcaccctcttgtttatggcaagaccagacacagaccctaccagttccgattctttgcttctagctgaactgcttggctcactgattaatctgaataaaattcttgtgaaacaaactttgattacgtttccctccttattctaggctcctgaactttgtcccactctcagctttaagacagcacaggatatttccggagaataggttggattcagagcacaacattctctcatctactattcaatcaggctgccctttcctctgacttcgtacctggttctctctagctttgtttagccttctctaaaaaaagaaaaaaaagccttttcatctaactcctgagataggtgcagatcttacagccttagtattccctgttgcaatagtcccttccctgctccttgcaataatcctgtctgaatcaaagtctcttcttactaaattctgattttttttttaatttggcataactaagctttttgaaggggacatctactctcactgtctctttctgcacccctgtgctgtatgtacctatgggacagattaagatgactaacaagtccaacaaagcagaaaactaaaggaggaaaatgtttcttatgttgtttctcaaagaaaagtgccaaagtattcaacatgacaaaaattatcgtaaggtttaaagttatttttattttaaattacatttagagagacacaataacctttctattacttagagagtctagattagatgtctttttttttttttttttcgatacagggtctcactctgtggcccaggctgctggagtgcagtggcacgaccacagctcactgcagccttgacctcccaggctcaggtgatcctcccacctcagcctccccagtaactgggactacagaggtgtgctgccacatgcagctaatctttgtatttttggagagacagagttttgccatgttgcccaggctggtcttgaactcctgagctcaagtgatgggcccacctcaagcctcccaaagtgctgggattacaggtgtgagccaccatgcttggcctctagatgtctttatatggtcctttctacctctcattctcttctcaaccattgccccaatacaaacatttcttagctagctcccaatacaaacatttcttagcttatacttaagtgacttctgcatttataataataatgaagactttgctgcctttatctttctcttcatatctgtagtcattcttaattgttgatctttatcttaaattcaccatcctagtttctggaatcttagaagccagtgtttctggggttttcttctagtgtctttatacagacttcagtcttattatcatacacttcttcctttacatctccttataactttggtgatctcctaagttccttacatggttctcttaatttctactggtacatttttccttgttgaccatatgtaaacttatgatttttatcttctaatttttataccctgataacacctttccctatctcctcctacagatttcttggctgaactctaaaccatatgccagagtgtttactgaatatctctctctgtagtctattggtacatcaaatatagaatagcctaaatactcaacctcaaattaaattggcttcttttcctaggttcctaaattgttagatgagcataccatccacctgtagtcccaagctagaggcctaagagtcttctctttttttcactgcatccttatatccaatctatcaagaagccctgccaggactccaccctgtagctattttcaaccggtccttcttttcttgcctactaccaataggtctaactcctctctttctcgaattattacaattgataattgaaacgattattccccatttttttcctcagtgaaaacatctaatcgtactatgtatatgcataaaattctgcaactgtttcacattgtctaaaatataatgtcccaattcccatacagccttcatgatctgacccatacagtctttccagtttcatcaaccatcagtgtatacacataaattatactcaaatattatcatactgcttatatttccttgttcttccatgactttactcattttgtttcttcttcctgaaatgcctgtttcccttctacatttatataactctaacttatgtttttagattcatcactgcctccaggaagttttcctgtagaccccagaatgggcactacttcatctctctctaaaccattatggtatccatagtaacctctgccaatctctgttgcttctcttattgtatttgtttttaatattccactcaggtgtcagtattcattactaatatgtaatattaaccctctggtatccatagtaacctctgcccatctcggtcatttctttgactgtattgactgtattttatttaatattccattcaggtgtcagcactcatcactaatatgtaagctagacactctgtctatattttatttattcctagaattcagtgcatactatatatttcataacgtttgttgaattgctagtggttctttatatttgattatgtaaatagtgaagatgactgtagagatggatgcacaatctaatttgtagctatgtgttttaataaaaatagcaacatattttacctttggggctctgaaaataatatgtgaatatgaaaaaaagtataatagcaaatgcgtatacaggcatacgttagggatattgcagtttcagtttcagacccccacaataaaccaaatatagcaataaagtgagtcacaaaacctttttggtttccaagtccatataaaagttatgtttacactatcttgtagtctattaagtgcataacagcattgtgtctaaaaaatgtacctaacgtaattaaaaatactttattgctaaaaaaatgctaatggtcatctgagtcttcagtgagtcatgatccttttgctagtggaggagggtcttgcctagatgttgatggctgctaactgatcagggtggtggttgttgaaatctggggtagctgtggcattttcttttctttttttttttttttttttttttgagatggagtctcgctctgttgcctaggctggagtgcagtggcgagatctcagctgactgcaagctccgtctcccgggttcacgccattctccttcctcagcctcctgagtagctgggactacaggcgcctgccaccatgcctggctaattttgttgtatttttagtagagacggggtttcaccgtgttagccaggatggtctcgatttcctgaccttgtgatccgctcgtctcggcctcccaaagtgctgggattacagacgtgagccaccacgcccggggtggcattttcgtaaaataagataataaagaagtctgccgtagtactggatttccgcgtagcatgtgatgctatttgattgcatttacccacagtagaacttcttggagacactcctctcaaattctgcctctgcttttatcaactaagttatgtaatatttgaagttctttgttgtcatttcaacaatgttcacagcatctttaccagaagtggattccatctcaacaaatcactttcttttcccatccataagaagcaactcctcattcgttcaagttttatcatgagattgtagcaatcctgtcccatattcaggctccacttatgattctagttctcctgctacttctaccacatctgcagtttcttcttccactgaagtcttaaacaccccctcatcacagtcatccatgagggttagaatcaacttctgccaaactcctgataatattgatatttcttctgcctctcatgaatcacaaatgttcttaatggcatctaaaattgtaaattctttccagaaggttttcaatttactttgctcagatgcatcagataaatcactgtctttggcagctatagtattgtaaaatatatttcttaaataatgccactttaaaattcaaaattactccttgatccatgggctgcaaaatggatgttgtgttattggcataaaaacattaatctctttgcatatctccattagagcttttgggtgaacaaaagctcatttgtacattttcaacaagcagttgaacaagcaatgggtacattttcaacgagcagtgatattttgaaaatcatctttttttctgaacagtaggtctcaacaatgggcttaaaatattcagtaaaccatagtgtaaacagatgtgccgttatccaagcttaattgttccatttatagatcacaggtataattcttaacaggcctaagattttcagaatggtaaatgagcactggttttattttaaagtcaccagctgcattagcccctataagagagtcagcctgtcctttgaagctttgaagccagacattgatttctcctctctagcaatgaaagttctagatgacactattcgaatagaatgctgtttcatctacattgaaaactgtttttaatgtagccactttcatcagtgatcttagctagatcttctgggtaactggctgcagcttctccttcagtacctacatattcacgttccactttaatgttacagagatagcttctttccttaaaccttacaaatcaacctatgcaagcttcaaagttttcttctgcagctttttcacccatctatgtctttatagaattaaagagttagggccttcctttggattaggttttggcttatgggaatgttgtggctggtttgatcttctattcagaccactgatttgcttcatatctgcaacaaagctgttttgttttcttatcattcctgtgttcactagagtagaattttcaatttctgtcaagaattttacttttgcattcagaacatgggtaactatttggtgcaagaggcctagctatcagcctatttgggctttcaactggccttcctcactaagcttcatcatttcaagcttttaatttacagtgacagatgtgcaactcttcctttcacttgaatgctcagaggccattggtctaattttaatactgtgtatcagagaataggtaggcccaaggaaagagagagacatggaggaacagtcagttaggggagcactcaaaacacatatttattggttaagttcactgtcctacatgggcatttgtttgtggcaccccaaaacaattacaatagtaacataaaagatcactgatcacagatcacaataacaacaaaatagcaatgaaaaagtttgaaatattgtgagaattaccaaaatataatacagggacatgaagtgagcagatgccattggaaaaaaagtctattaggacttgcttggcacagggttgacaaaaaccttcaatttgtaaaaaaacgtaatatctgtggcatgcaataaagtgaactgtaataaaatgaggtatgcttatatgtatgtatatatgcaaaaaagaccagaatgatagcaaaatgttctttgtgatttttttccacttggattatgtgtaattttggagagggtaggggagtaattttgtttcaattgtccttattttttagaaggaacattggtcttttttattgttagaaacagtatagagatgcatacatacatgtagatgttatatatgtatattccttatcacaaaatatttaagaaaatttattacatatagtaaagtatctattatttagatataagattctctaaaatgatttttattctattacttaaattattgtttttcttctagagacaaggtcttactatgttgcccagtctcatctcaaactcctgggctcaagcaatcctcccatcttagcctcctgagtagctgggaacacaggtgtgcatctatttaaattatttatcaaagatttctcaatatatttcaatgctgtggttgattttgaaaacctacgaaagccaacaagaaaagcagagacattatctgacgtttgtaaatcccaaactcttagtgagtaaagaaaattatctttaaatatactcaactttaaatagcatttagaaatgcatctctatttttgcccatctaaccataaagcattcaaaatataagtcagggattcatgaattaagttttcagtaatttgctctgaatgcagtgttttctgaggcagttatatgggcatcaactattgataactattttaaaatcttcttaatttgtttctcaaattcaattttatttgtgtcttctttctatctcaaaagcccactcacattaatgtctttcctatttaccttcatattgaatgcttctactttcccgggggcaatgtcaaagtaatttacacgctgtcaattttgttggaatgaattttattaactctcttaaagatgacgtccttctgtttggtacttgctataagactgactgtttctatatgcaagcaagcaaaacgctttatgcttcggggtcttagacatagaattatggagtttctaagaagttcagggtttaatctttggcatggtatttccaatcatgaagttctttcttatcagttttagaggtcaagcattctgcagccttagcaatttttcagactttttttttaaggttattttcttccccagagaagctctaatttatatcttcccctcaagctatcttttcctaccaaaaataatacacagtatcattatctatagaaaaacctcacacaacctgcttaacttaagtaagacttagtactcagcttttttttttctagaataggacttgctagctaaagcatattcttgtctaaaaatggaaatttgtaatagcagatctcagaagtttttcatcttttgcaccttggattttagtgttatctagaatttttgtataagccatttaatattttaggattttatgtaaaaacaattgtcatcagttggcccttctggtaattctaataagcaacatcctttagccaaatctaagaatcacaataaagcaagaagttctacagtaagattttggtgttttataatttattctttacataaatatgctcttcatgagatatgtggtcaaattccaattaattagaataagaagttttaatttagttgaaaattttttggttaattgagtagtaaacaaacttgaaaattttgaaacagatacgaaacattatttcaatctctttctttgcaaacatttcttaacagttgtttccccggatcgtatgagtgcacttacagtaaatgtaaattaattgatgtttgttgatttagaatcttgcagtggtacatgaagaacaatatgggtgtgaatagaaatagtgtaatgggagatacagctaaatctgaactgttcaagtgatgccattatttcatgctttataaaagggtctctaataaatttacttctttgtcatttgtcttattttttacagcagagatctagaactgtccgtctactgcctggctggtttgggcctttttatgttgtttggtgcatttagtgttttcttaaatccaactttataaaatagagaaaatgtgttgtaaaacttttttttttattatttcactgcaaagtaagttcataggaacagagtacttttctgtcttgttttattgctaatttcccactgtttagaacagtgcctgagacacagttaatgactaatgaatttgattttgtaattttgtgtgggagttacaagatggggtaaaataaatctgaataattgattgagtttgttcacttctaactgaagaactaacactcttttcctatttccatgggactttcaaaataagtcactgtgaagtttatgggttaggtgtaagtgaacaaaaataagattctccctctaaaacttgatacatttgcatgtaccaaatgctataagaaacacaatgatgaacaagttatggaatcttctcccaagttgcttacagtgtggtaagagagagtatgtaaataaataaaattttcagtagagaaaacatagtttgttcaaaatgtgtcgtaaattcaagatgacacaaatactaaagcacctgaacagaacaaaaaagtttaagattaaactagtttaatgatatagcatattttctaactatttttattccaaaagcgggacattcctctaagtctttctcagaccaaatcataatttgttttaattttctagagtctaacttggagattcaataacagagcacggagacaaaagacagctggaagtatgatccaggcgctacagcttcttagatcttccaaataaaaaccaatattcctttggattacatgaattaaatagaaagacaaagcttggaaattctgacataggttctgacaatattttctttcttaaatgaaataaccattttagagacaagatcaatatgacccattttaatatggggtctgaatccactctttaagcaatggataactatggctacatagtaaataaagggtgatataattttccaagagctttgattcataactgttttagaatcttagaagcattgaaaaaattaatgaaatcatcagcctttaccccatggaaaaataataatcattttacaattttgtacattctgcggaggttaataatcctctgaaatcttagactctcatatagaatctagtctagaatatggttcttaagaacaataccagtttttaaccattgttttatgtttatataaaattttaattgttctttaattcatacctatacagactggtgggctgggctgccagaagtaccgattttctacctgaatgcaggttattctttcctctccttgaagttcatatcctgggtcacattgaaaaacaacagtgtccccaggttctcttccatccccatttcgagtcccattcatggggacccctgggtcacgacacgcagtggcaacagaacctatcaaaagacagagacaaaattttagttttgataactaccaaaatcaatttcatatatccctgtgttttagaaaattaatttttaaaattttggggtcaatttttaaatgctatacaataaacactttctccatattttaaataatttatgtgctaacttatttgaaaaagtggcatagtattttagttaccaaatactagatttactcaacattattaaatgtattgtgaaagacactgaagattatgaaaagaaagcttcatactgggaaaatatatttgttaggaacatatccgcagaggacttgtagctagaatatataaacaactctcgaaactcaaaaaaaaaggaagaaaattagcaatcaatccagttacaaaatgagcaaagacattttaatgaaaacgatatcagaaaacacatgaaaagatgttgaacatcactaactaatagagaaatgcaaattaaaaccacaatgagatactactacatacatttcaaattggctcaattttttaaaaaatatatgataacaataaatgctggtaattatggagaaaacgggatcattcatgcattgctggtgggaatgtaaagtggtaaaaccactctggaaaggattatggcactttcttacgaaactaaccattcacttactatataccacagcaattgcactcttgaacatttatccaaaagaaaataaaacttatattcacatgaaagcctgcacacagatattcataacaactttatccataattgctaataactaggaacaacccaaatgtcattcaacaggtaaatgtttaaacgatggtaaatccatgcaatggaatattactcagtaataaaaaagaatgattcatatatatgacttggatgaatttgaaggaaattgtgctaagtgaaaacaatacaatatcaaaatattatatagtttcattcttttatataacattcttgaagtggcaacattttaaaattagaggccaggcatagtggctcacacctgtaatcccagcactttgggacatcaaggcaagaggatttctaaatcccaggagtttgagaccagcctgggcaactaagtgagactctgtctctagaaaaaattaaaaaaaaaaaaattagcccagcatggtggtgcatgcctgcagtcccagctacttgagaggctgagttgagaggacagcttgagcctaggaggtcaaggctacagtgagccatgactgtccgtctgcactaaatttataagtgaatttgttttgtaatatccatcagtgtttctcagcagagcactaaatggagcatcatgcatcaaagaatctgaggaattatagtcttccactatggatagagatcttttataaaaaatggtgtgtgtgtgtgtgtgtgtgtgagagagagagagagagagagagagagggaaacttactcattaaatttttcttgatttgctctggaatggtttctacccaaactaaaattgatatattgtattagtctgttaacacactgctataaataactacctgggaatgggtaatttatgaagaaaagaggtttaattgactcacagttctgtaggcttagtaggaagcatggctaggaggcctcaggaaacttacaatcatggcagaaggcaaaggggaggcaactacatcttaccatggcagagaaggagagagagagtgaaggggaaagtgccacacactttcaaataaccagatctcatgagaacacactctctatcaagagaagagcaagggagaagtccgctcctgtgattcaatcacctcccaccaagcccctccactgacatgtggggattacaattagagatgagatttgggtggtgacacagattacaattagagatgagatttgggtggtgacacagagccaaaccatatcacctatggattggttttataagtggagagtgatgttcgactaataaaacacatctttgttttattagattttaagtctgccattcatgcctccttttccttaacataaatatgcaaagtaagcagaaattccaacaaagataaagggtcttaacaaccttgttgtctcactcgtaataatatcataaaaggaacatacttgaaagtgaataataggcttatatgttataacatcaaaatataattcgagtttgacctgtaaaatcccatgaaattgtcaataaaagattacttccctttcttgttttctttgcctcaaaagtgctggccaatttcattttggttagtctaggaattatccagtgactagtctgttacacagatgtagactgtactccttaaattagcttaacactcattagaaataataatagtcacacagaaaaagtatacaaatagaagcatatgtcaatagctaataatgctaatatgtaatacttgttgagcactttctacatttaaaacaccatgctatgagctgcctctcgattcacaggaagtctgagtgctattattatccatatttttccattgagaaaatcgaggcttaaaaaggctaaggtgctttcccaacatcatacaattacttagggacagttaaagaacaaatgcaggtataagaccatatccaagggacatttttgaaataaaagtcataaagcctttgtaataaaatgtgcttaagtgttgaatagagcgtaaaactcaacgatatggttatttaaatggaagtctctgaaacatgctattaatctttaagtgtcattttaaaatcagacgagcagttatccacctattattttcactaaagtagtccaaaaacctacatatttataacatcttaaatgtattaatttctttaaaaatatttgcaccgatgtcaacattaaagccttattaaatagggttctattgttatatatcaaattgaataaagaccagctaagaaagagaaactttaaaaaggcaattaattcagaatagagaccaataaaataatgataatagcaataattactctctgtatttagagcatatagcatgcaaagcacttgactagcagctcagtttacactcaagctaaaacacagaatccttacaaagtggtattttcatccccatttttaaatgggtaaaatgagatcttaagatctcagagatcttaaatgcatgttcttagcagagctggaatttgaactcaaccagcagggctcttaaccattatagtgtgttgtctcagcacaaacctatcccattaccagaaataacataaagccatatcctactagtggaactctgacagctgtctattgatgaaagaattgaccaaaaaaaattcgaccaatttgaaatggaaaggcaagaaatatagaacaatttgtatccatttattacacataaaaatatgttgctgcctacatttttactataatggaaagcagaaaagaaagaggcaaggttatatttgtggttattaaaaataatagaaataaaatttattcatatacatatccaagtttagccatatatatgccaaatatatgtcaaataacattttaaagtaactacaatatgaagaacatttccactccaactgctttttcactgtttctccttctcatcccttattttgttttatttccttctttataattttttgagagggtaaagcaatagatagaagcactctcttcttaacaccatcaaatccatcacctcactggtatttacatccatattttgtttccttgtcttttaaaatggagaagttggccttgttctgtaaaaagccaaccctagttcttgtgttgctagtattaaacactgttaaggacttactcctaaatgttcttcatctcctctgcatcactagcacattggatcattctcagtcgcatgtacagtactatactggatcattctcaacagcatgtaattgtggcttctatcttccattttaaataaacaaacaaaactttataatatccccatcctctttcagctgctttcccatttctctgctttctttaatagaaaatctattaaatatatctcctgagagaagtttctatacaattgtctccagttttatcgtcagtctttcctctattccactgtttttaaatccaggctgccatatccagtggtaacttttatggtttctttcaaaaacctttcagcaacatttattaaagctgactattccttccttcttcaagcactgttttttattttgttgttttgttttttggcctccgattcatcagcctagtctggttttctttctggcttatttgctgctctcttttggtatcttttgcttttgttacttgataacctaatgactgagggctggagtaccttaggaattagtccttaatgctcttgtcccttctttccacaatttctcactaaataacttcataagtttaagtattatttttagcttgatgcccctgaaatttgtatatccagcctcaacttttttctgagctcttaaccattctcttcaagtgcctatttaacttctgtacttagatatctggtaggttccttaacttactatgtccaaaatattgtaaaattataaaaccttttaatcttctgatttagaaagtaaaaatgtaaaaaataagtataaaatttcacctatataaatttttcctagacaattgatgtcattgtaaatgtacttctaatttattataataaccatataaaaatatgttttagaaattgttcaaaatagaaggtaaaaatcgttgacataagaaatagagtgaacattagcaaaaatataaaatcttctaatttttacactactttttatgccagtgattttactttgtatgctaccatttatttctaataaaatgagtttttctatctggttgttataataaattagaaatacatttgctatgacaaatttttactttcaaaatagaactgtttctattccactaaaaacaaataactgtacccatggctaaaattctcattaccccgaatgtgaaaaaagatagacatgtaaaagtaatgcaattttctaactgcttatacgtagaagaaacaatttttcaagatatgttgttttattctaattatatataaggaatctctttgaattcattgtaaaagaatgtatgcttatctgagaaagcatatattacttagaaattgtttttacaatgccatcaatcttcttcactgatctaaatccactgaaagagttcatagcattcgtcattaagtaacacgtccttatcaaatctagctttgctatgccctaggaagaaataaattgtccatcagtacaagaatttgaagagaacttcttattatagttaaaaacaaatgaatgaatgaatgaataaatgaatgaacaaaactgtcatttgtcatttcagtgtatgctgaaggtttatttataatatgatattattttgaagccaggagatgtttatttcaagtgtgccataacaatatttacattacattttaatcgctttactctgttatgaataacctagggtttgttcagaaaataaccagatggctctaactactgcaaaatataactgagttctcattattgctactgtcaatatacttctcacttattttatctttgcttccatctagttgggagtataatttcactggaaatatgcacttcacttaatatagatttcacaagccgagctggtgcatatgtagttttcaactgaaatatggatgattacttgaagtcagagataagttgaattaccattgtggtgacaagagcaaaagaaaacacgccggttttcttactgctttgcttggtataacaaagaataaatacactgaaatcactcttaagttcttatgtgtcctttatgttcagaaaatcgactttttggtataaacttgtttatttcaagacctttcaaagaagaaaaatcttggatctcatacagttggatgagtaatgatatcagaagcaggagacttagacttagtgtaccgtattaagaaaagatattaatcccttgtattagttccctgaatctttcctgccttatctgtaaaactggcctaggaatatttcatctgctttatttagaatcagacaaaatattaaatttttattctaacaattatattcataatcctatgaaaatacaattctgaaatgaaaaaacacaagtacactttaatatgctctgtataggttttctaagcagtaattttatattttttgccatgtgtcaggagacttagcaaggtcatgggccaaatttggtattcacagtttctcacatccctctctttcagctttattgccttatatttttgtattggctaaaaaatgacactgtattctccacttccctatctataagaaaatcaagatgggtaatgggaatacttaacctgtgagaaaaatctcatccagagtcaaatcaattagaaaatatttgaaatgcagatggtaacctagaggtggatttcaccctggagaattttgcccttgattgagcccttgctttgtacatgatccatcaattttataaagaatgttcaacatcattattaggcccacactctgccagctactcagaaatgtggctatctttagaatttcattatgttactaaggatacatctaatgatatggcaagtcaggttaaagttgatggcagcatgacagacacattctaaacaacctaggaaagaaacaaagctgcttaatgcatggtatggaaaagaaacctcaaagccagtgttgtaatatacttccaagtatatagaaatctcttttttaaaaatgcatatgcatttattacaccaaataattattgagccaggtattatgcttgatgttggagatattaacagaaacaacacagccctgctttcatagattcttatgctccagtatgcctacaaaagttgttggcattgtatcatatcatatcatatcatatacagtcaatgatataatttttgtggaatcaaaggcttgttaggttgaagactatcaaaaggatctgtacaagaaactcattttacatccaaagattacagaaaatatgagttgatttgaaatagaattctagtatatggggatgaccagtattagtaagtaaaaaaaaaaaagaaataaaaattatgtaaaaatggtttcacattacttctgactgacactatacagtatttgtatgtttttagttttacattattagaagatttacccattcaatcagattcgttaaatatttactaagtaccaagtaccaggtaccgtgccaagttatggggacacaaatatcaacaggatgatatccttacccttcaaggaacacaggctaagaggaatagtagatgtgaacatagttttaaaataataacatgtgtatcaaaatctgatgactttgttattgaaactgaaaaaattattaagcatgaaacaagaagctaaaagtaaataaaattatataattaaaatatgtattgagtaacataattgatattatattgatgtatgtctcacaatagttatacaaaatctattttaaaaataaaataatttctaaaaaattaaaatgacatctgtgtacaaaaagcatcttctttatatgaattatctgaatattaaaataacgtgcaaaataatcatttctgttacacatgttcattctttaattggtttcttagccacatttaatgccctttttactattttttctaaagaatgtgttttttcaatatattcttatttttattagtattgccagaaacatttttatatattttaaactgtcggtagctcgactgatatcatcataagccatactatttttaattgagaaaatttcctctttgtaagtgttagctacctggtaagctcaggtttaattctttgaaatgaagaaaaatttcaattttatttttattttcattaagcagtacgtaaacatttcagctcaaatattttcacatgtactgaattttaacttcttttcagaatacatttttgacacacttttataatatgaaacttgtcaaacaagttttcttaaattatgttttgaaatatttatctacaagctgtataattatatacaaaataaattttatatataaaattttatttatatatgatttatattaaatatacattttcttaactttattctatcccagaataaagtagaagtttaatccaattaaaaataactatcaaaaggccgggagcagtggctcacgcctgtaatcccagcactatggtggaccgaggcgggcggatcacgaggtcaggaaatcgagaccatcctggctaacatggtgaaaccccgtctctactaaaaatacaaaaaaattagccaggcgtggtggcgggcacctgtagtcccagctacttgggaggctgaggcaggagaatggcgtgaacccaggaggtggaacatgcctggagccaagatctcgccactgcactccagcctgagcgacagagcgagactccgtcctcccaaaaaaaccccaaaaaccatatatatacatatatatatatatatatatttatatgtgtgtgtatatatatatgtatatatatatatacacacacatataaaaaatatatatatatatatacagggtctttatatatatagtttttgttttttatatatataaatatatatattttatatatgtatatatattttatatatataaatatatatataaagaccctttaacaagtcaaggcatactaaaatactaaagtttcaaattttaatattgtacagtgtttgaactttcattcttctaaagaaatcacacttaagtgtcttcctgtttattgttttcaataattgctttcaattattgttattgtttcaatttcagttattgttttcaataattgctatttacttaaaattgtaaaaactgaagatttttagcactgtactaactgaatattttaagatattcagtggattttaatgaatagctatcaaaatgtaaacgttttattttcaaaatcattcaatatcatagtagggcattttagtttatttgcaaaatagtacttcaaaaacccaaacctttctaggacttattgacaatgatctggaaaaagagaacatggtactggcatactatgttcttttatttattttttgaatcagctttactttgtctctctctctctctcacacaaccacacccacaacccacaaacacacaccacttagttcaattatttcaactgcatataaaaatatttgtatattttaacaacagttttattgtgatgggtaattattacaattttattggttgcaattatgaattttgtgtatacaacaaccaattcctagtacatttctgttttttaattttataagagctttgcttttattataaggttatgtaccaccaaaatttacatttgtattttatcacaaaataaataattttatctttaatattaaattttaatttgtggcctttgctcactttaaatatttaaaagataatttttttgcttaaagtttttttaaaagggttgtgatgtttataacatatgtaaaagtaagataaatgaaaacatgccccaaagaactgaagaaggaaatggaaatacactattagagggttcttacattatatgtgaggtggtataatattatttaatgataggtttgtctatttgacataatgacaggttttcataagccaaagatacacgttacaagagttagagcaaatgctttctttcctcccaaaagaggtatagctaataagctaatagaagagaaaaaaatgatggtaagaaaaaagtaacaattaacaggtggattcaataaaaaaaatagcaatatggtagacaaactttaaccaagtgaataattatattaaatataagtagtctaatggttaaaagactccaactaagggagagagattttcaaacaataaaaaatcaagatgcaaccataagctatttactagtagtctactttaaatataaagacactgataacttaaaagtaaaaagatgctaaaaggcatcatatgatatatatatagaaaaagtaaactttaacacaaggaaaattaccagagaaaaagagacagatttcatatcaataaaagggtcaaaaaagggtcaaaaaaaacccatagcatccaaaatgtatgcagctcataacatatcttcaaaacacatgaggcaaaaaataaaagtaagagataaaaagaataaatagacaaatgtgaaactgcagtggggcattttaacacttttcttgagtagttgataaaataagtgaagtaatgatattgaataattaacactatcaacaaaattgatatttataaaacacttcaaaaacaatggtaatatacttttttttaggtaggtgcacaaggtattttttttaaaaaaacatgttgggctatggttttctcagtaaaacaagtctcagtaaatttaaaactaataaaatattaatttttaactgaatgtataatatatgtttatctttaacacaatcaactttcaaagactttattttgacttcatgaaatgaatacaaaaataaaacttgcattggaatttaagtatttgaggcaatcaatgttactgattatttgaagcaattgatgtgactcacataaaaatagatttattcaactatttgtgaagttctgctaagggagctggcatattaacactcttcatactttctcagaagagaatttagaatacaaagtgatgaaattcgtatagtattcatctgacctaaatacaaggtcctgctttttaaaacatatttgtgtcttctggttttcacatcatcagtgataacactatggtcctcatgtacattaactaatacactgtatgcaagttgcaagttcatcaccactttttaaaaaaattttaattgagtttttttgtaattagtgtgcagatattattagcagtttatacatactccttaatataagtactaaaaatttaaaaatcatgtagccaatccaaacatctattctaatgatttatcatcttaaagattgtaggcaatttattcattaaaaaaaaccaagtaataatatcttaaaataactagttatacactcttaggtctaaagtcccaacatataccaggatttaaacacagtaaaccaggattcaaacacagtaaattctcaatcaaaatatcccattcttcataacatgctagcaagtaattaggaaaaaaaaacctgttactaacaaagatgtcgtgatgccagtgataaattgaataccaaggagcactttaatttaggaaataattccaataaaaagaacatgacaagtgacatcagcacaatggcaaagtagaaagtcctgtacactctaccccaaaaaaacacaaattcaggaacaaatcatcgacaaatttcctttatgagaaatccagaaactaagtgaaaggctcctgcagcccaggtgaatgtgaaaccagactgaccaaaactagcagagagatccagaacaccctctcgccagactcctcaccactggcacagtgacatataatcaggaagcgattcactcctagctcccagcttctcccagaggagaaaggccttggtttgcacatgtagcaccccaaccattccaagaggactccacaaaggtctggcttctgtcttgccagtcttggatctctgatgggaccagcgcagtacaccagctggggaaaacagagatggaagctaggggcaattgatgcccctagcttcaagcttccctgctgctcagatgtcccaagtcttctttgctgctcagcataacatgagcaacaacagcaaccacaaaaaaacaacaaataaacaaacaaaatcagctctcagcttctctctgagaagaaaaagagttgatctaagcatccaatgccccaactttgccgggattgcctaaagaactggcaactatttgccagtcttagaactctaactggtctgccacaaataagggataatggaaatagtggtttggactggtagtgtcatagtttcccccagtgggtcagcacagagcaaatacacaaaaagcacagttaatgcggtacagtggctcacacctataatcctagcactttgaatatttgaaaggccgagttcaggagtttgagaccagcctgaacatcatggcaaaaccacaaccctacaaaaagtacaaaaattagccagcagagtggtgcatgtctgtagtctcagctactcagaaggctgaggcagaaggatcagtttgagcctgggaggttcagactgccgtgagctgtaagcatgccgctgcactccagcctggatgacagagcaagactctgcctcaaaaaaacaaaccaacaaaaatccagctgtctgtttctccttgtaaagggaaagagttgttggtagagactctagaatctctggccaggctggttgatggtggtcttctctggtacaagcagagtctgggaagacgggatgcagtgtgtataattggataatacacatatgccaatgcagagcatcaaggaaaattaagaatcagaaaaaaataattcaaacaaaggaataagataaatctccagacagcagccttaataaaatgaagctatataatttatctgacagacaaataaaaataactatcataaagatgctcagaaagctcaagagaatcatgcatgaacaaaatgagaattccaacaaacagatagaaaatataagaaagtaccaaacagaaatcatgcggctgaagaacacaataactaaagtgaaaaataactagcgaggtccagcagcagactagatcaagctaataaaaggaccagcaactcaaggacacatcattaaaaataattcagtcaaaagagcaaaaagaacaaaataatgaaaaaagtgaagaaaccttaaggctcacaatttagggaccaatatttacattatgagagtgtcagaaggataagagaaaaagaaaaacaggacagtttactcaaataaataatagctaaaattttcccaaacctggagaatgaaatgaacatccagacccaagaagtccaaagaacaccaaataagagtaacctaaataaatccatactgagacacattacaagcaaattgtcaatagtcatcaaagacaaagaaaacattttgaaagcagaaagagaagaacaacttgtcacatataagggaagctccataagagtagctatttcagcagaaactttgcagaccataaaggagagtgatggtatatttaaaatgtggaaagaaaaaatagcctgccaccatacacggtcaaactgtctttcaaaaatgaaggttggaaaaagactcccaaacaaaagctgaaggagctcatcaccattagacatgccttaggagaaatgccaagaaagttcttcaatttgaaatgaaaggattctacacagcaaacgtacaacacaagaatatataaaactcagttgggactttgcattagaagtccgtgttgatcctaccacaatgtaacacagcattgggcagaattccaaagcccttgactccgagccaatacccacagagggaatacttattcttacaccaggcaagatagaaatctgtagccacagccacggcagaagggcttaagccctagctgactgaaatggtcttgggcctcaaataaatttcagtggcagcaattctgtagtgaccatggtctttgggtgagccccagtgctgcaatgacctggaaggctgtgggcttatgatgcaacccagtgtgacatcagctgcgggggccacagaagtgcctatgtcacccctcccctaacacagttacccctcccctagcacagtgcagagacaaacagagagacatcttccacttgagggaaggagagggaagagtacgggggactttgccttggaaactagtacagtgccaccacagcacaacacagcatgcggcagatccccaaagcccctgatttcaggccactgctcccatcaattcttctagatccaccccatgctagaaggaaatctgctaccctggcaggatggaacaaacccaaatctgagctggcttcactaccagctgcttaaagaggcctgaggctatcaataaacatcagcagcagtcaggccatgattatgggcattgggtgagcctcagtgctgtgctggtctggaaggttgcaggctttgggtgccagttacaacagccacaggaatggccatgtaaccccttcccaaactccaggcagctgagtatgaagagactcctgtttgaggtaaagagacgaaagtgagtgaaggatcatcctggcaacccaagaaattttccatgatctcccaaaagtccatcagaaataagtacatagaagtccactagatggttgcagtgcagttggacttagaatactctctagtactaaaacagctgcagtgactacaagcttggggaactcaataataaatcctatttgaatttttgaaatgttctctgaagaaggatgggtactaacaaggccagattgtgaaaactggaataaataactaactctgaaatgcccagacattgattgacacatgtccacaagcctcaagaacattcaagaaaatatgatctaagcaaacagactaactaaggcgccagtgattaaccttggagtgcccgagatatgcaaccttttggtgcattcaaaatagctaatttgaggaagctcagtgaacttcaagaaactcagataatcagtttagaagtttattagataaattatatatataaatataaataatttaaaaaatcaaacagaaacctagagatgaaaaatacaattgatgaactgatgaatgcaaaaatgcattagagtgtctcaacagcagaattgattaagcagaagaaagaattcatgacatggaagataggttatttgaaaatacacagtcaaaggattaagaagaataaagaaggcttacgagatttagaaaatggcttcaagaaggcaaatctaagtgtcattggacttaaagaaggagtgagaggtagggatacaaaatatattcaaagaaatgataacagagaacattccaaatttagagaaaaatatgaatatccaggtataaaaaggtcaaagatcacaaagcagagtcaatcaaaataacactatcccagggcatttaataatcaaactctcaaatgtcaaggacaaagaggattctacaaacagcaaaagcaaagcaaataacatatcaatgagctatgatacatttggcagtagacttctcagcaagctatgagagagtgtcatggaatattcaaagtgctaaaggcaaaaaaatttctaaccaagaatatagtagtgagaaaaactgcctttcaaacatgaaggagaaataaaaactttcacaaacaaagttaagagtcttcatcatcataactgttttacaagaaatgctaataagagtccttccatctgaaaaaaaaaggatgttaatatacagcaagaaatcatctgaaagtataaaactcactggtaaaattaagttcacagacaaattcagaatattctaatactgtaattgtggtgtgtaacacttgtgtctttagtctgaagaagaaaagacacatctatcaaaaataacaactataacagtttcttaggagatagacaatatggaaagatataagttgatacaacaaaaagcctaaatatggggaggagtatgaaatcaaaatgcagggctttatagatatttctttgtttgtttctgtgcttttctctgccactaaccttaagtagccattagtttaaaataacttgtacaactaaaagattttctttgtaagccatacagtaatcacaaaacatagacttataatagagaaagtaaaaataaaaagcaagggattcaaacatactaactttgtggttaagaaaatcacttaaccacaaaggaagtgaagaagaaagaaaaagaggagttataaaataaccagaaaaaaaagtaacaaaatgacatttgtaagtccttatctatcaataatggcattgaatgtaaattgactcaattttcaattgaaaaacaaagtggctgaatgaacgaaaaaataagacccaaatatatgctgcttacaaggaacatactcatctataaggacatgcatatactgaatgtgaaggaatgaaacatgtattttatgcaaacggaaaccaaaaaaagagcaagagtagctatacttagataaaatagatggcaagtcaaaaaactgaaaagatacaaaggaattcattatgtaataatgaaggggtccatttatcaagaggatataacaatcataaatatatatatatgtacccaatatcaaagcatccaaatatttacagcagatattaatacagctaaagggagagagaaagaacagtacaataatagtgggggacttcaacactccacaatcagcaatagatagatcatccagacagaaaatcagcaaagaaacattggaataaaactacactgcacaccaaatggacctacttgacatttacaaaagattgtatccagctgctgcagagtatacatacttctcattagcaccaggaacattctctgagatagagcataggttatgccacaaaacaagtcttgacaaattccacaatatttgaatcatcttttctgactataatggaataaaaccagaaatcaaagacaaaagaaacattagaaattgtacaaataacatggaaattaaatgacatgctcctgaacaaccaatgggtcagtgaagaaattaagaaggaaattaaaagatttcttgaaagagaaagcaggaaagataaaaaattgacaccctaacatcacaattaaaagaactagaaaagcaagagtgaacacattcaaaagctagcagaaggcaagaaataactaaaatcagagcacaactgaaggaaatagagacacaaaaaagtcttcaaaaaattaatgaatccaggagctggttttttgaaaggatcaacaaaattgatagaccactagcaagactaataaagaagaaaagagagaagaatcaaacagacacaataaaaaatgataaaggggatatcaccaccaatcccacagaaatacaaactaccatcagagaatactacaaacacctaaataaactagcaaataaactagaaaatctagaagaaatggataaattcctcgacacatacactctcccaagactaaaccaggaagaagttgaatctctgaatagaccaattacaggctctgaaattgtggcaaaaatcaatagcttaccaactaaaaagagtccaggaccagatggattcacagctaaattctaccagaggtacaaggaggaattggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaaccgaatccagcagcacatcaaaaagtttatccaccatgatcaagtgggcttcatccctgggatgcaaggctggttcaatatatgcaaatcaataaatgtaatccagcatataaacggaaccaaagaaaaaaaccacatgattatctcaatagatgcagaaaaggcctttgacaaaattcaacaacccttcatgctaaaaactctcaataaattaggtattgatgggacatatctcaaaataataagagctgtctatgacaaacccacagccaatatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagccccaaatctccttaagctgataagcaacttcggcaaagtctcaggatacaaaatcagtgtacaaaaatcacgagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaataaatattgtgaaaatggccatagtgcccaaggtaatttatagattcaatgccatccccatcaagctaccaatgactttcttcacagaattggaaaaaactactttaaagttcatatggaaccaaaaaagagcccgcatcgccaagtcgatcctaagccaaaagaacaaagctggaggtatcatgctacttgacttcaaactatactacaaggctacagtgaccaaaacagcatggtactggtaacaaaacagagatatagatcaatggaacagaacagagccctcagaaataatgccacatacctacaactatctgatctttgacaaacctgagaaaaacaagcaatggggaaaggattccctatttaataaatggtgctgggaaaactggctagccatatgtcgaaagctgaaactggatcccttccttacaccttatacaaaaattaattcaagatggattaaagacttaaatgttagacctaaaaccataaaaaccctagaagaaaacttaggcattagcattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaactaaacaaccccatcaaaaagtgggcaaaggacatgagcagatacttctcaaaagaggacacttatgcagccaaaaaccacatgaaaaaatgctcaccatcactggccatcagagaaatgcaaatcaaaaccacaatgagataccatctcacaccagttagaatggcaatcattaaaaagtcaggaaacaagtgctggagaggatgtggagaaataggaacacttttacactgttggtgggactgtaaactagttcaaccattgtggaagtcagtgtagcaattcctcagggatctagaactagaaataccacttgacccagccatcccattactgggtatatacccaaaggactataattcatgctgctataaagacacacgcatgcgtatgtttattgcggcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcgtaggtgggaattgaacaatgagaacacttggacacaggaaggggaacatcacattctagggaccattttggggtagggggaagggggagggatagcattaggagatatacctaatgctaaatgacgagataatgggtgcagcacaccagcatggcacatgtatacatacgtaactaacctgcacattgtgcacatgtaccctaaaacttaaagtataataataataaaataaaaaaaaagatttcttgaaaaaaggaaatgtaaacaaaacaccccaaataaaacctaaaatatacaacaacagcagtactaatttatagcaggaaacacctatacaaagaagtagaacgtcttcaaattaacaatctgatgctcctcaaagaactagaaaacaatgacaaatcaaaccccaaattagtagaaggaaagaaattataaagatcagaacaggaaaaaaaattgagagtgaaaaaagatacaaaggataaaatgaaaactctctttttgaaaagataaactaaattaacaattttttcttagctagattaagagaaaagagagaagcctcaggtaaaaatcacagccaaaaaatgagacattaaaactgataccacagaaacacaaggaattattagagactattatgaagaagaatatacaaaccaatgggaaaacttagaagtacatgaatttctagacacataaatctaccaaaattgatccatgaagaaatagaaaacttgagcagaccaataacaagtaatgagttcaaagtagtaaaaaaaaaaagtcccccatcaataaaaaactcaggaacgaatggattcactgatgaattctaccaaacatttagagaagacctaataccaattctaatcacactatttcaaaaaactgaaaaggaagtacccttccaaactcattctatgaggccaatttactctgataccaaaaccaaagacacagcatgaaaagaaaacaaagagcctcaaccaaatactagcaaattgaacacaataacacattaaaaagatcatttactgtgatcaagtgggatacatccctgggatgcaactatcattcaacatattcaaatcagtgaacaggatacatctcattagcagaatcatggacataaactatatgaagcattgcaacaaatgctaaaaaaaaagcagtcaacaaaattcagcatcccttaatgataacaactctcaacaaactggttatggaaggaatatatctaaaaataacaaaggccatatacaacaaacccacagctaacatcatcctaaacagggaaatgtcgacagccttttttctaagatctggaacaagacaaggccaagaatgaccacttttataacttttattcatcatagtactaaaagtcctgcccagatcaattaaatgagagaaagaaacaaaaaggcatcgaaattaggaagaagtaatattgtccttgtgtgcagatgacatgatcttatatttagagaaacctaaaagattcaaccaaaatgttgttagaacttataaataaactcagtaatgtggcaggatacaaaatcaacatacaaaactcagtagcatttttatatacgaataacaaaccatctgaaaaaaaatcatgaaataaatcccatttacaatagctacaaaatatataaaatacctagaaataaatttaactaaaggagtgaaatctctctacaatgaaatttataaaacactattaaaacaataggacacaagaaaaatggaaagacatttaagtgttcatagattggaagaattaatatttttataaggtccttactacccaaagtcatttacaaattcagagtaatttcttccaaagtaccaatgccattttcttgctccttggccatcttggtgggtgctcttgagtggggcctgtcctgcacctaaggcaggaagatgggggccacaaagaagatgaaaacctcactggagtcaattaactctggagtccaactcattatgaaaagtggaaagtataggccaatatctcagatgaacatagatgcaaagagcctcaaccaaatactagcaaactgaacacaacaacatattaaaaatatgctaaggtacaagccaactctgaagatgatcagacaaggcaaagcaaaattcatcatcctttttagaaactgcctgactttgaagaaatctgaattagagtactaagtattgttggccaaaactgctatccaccactacagtggcaataacactgaattgggtacagcatgtgaaatatactacatacaatgcatactggctatcattaatccgggtgattctgatatcattagaagcatgccagaatagtctggtgaaaagtaaacaatgcaaaatttttatttagtaaaacttgccagagttcatttttttatttaaaaaaaagtaccaatgccactcttcagagaaaattttttaaaaattctaaaattcctataggatcagaaaagaacgtgaataactaaagcaatttgggagcaaaaagaataaagatagcttagtggcatcaagctatctggctttaaaatatactgcaaagctacagtaatcaagacagtgtgatactgacataaaaatagacacacagacgaatggaagaggaaaaataactcagaaataaatccatacatctacagccaactcatttttaacagatacactgtgaaaggacttcaataaattgtgctgcagaaattggatatccatacgtagaagaataaaactagacccctatctctcaccatacacaaaactaaaatcaaaataggttaagacctaaatgtaagtccttaatctatgaaactaccagaagaaaacattgggaaatacttcaggacattagttctggcaaatattttttgcataagacctcaaaatacaggcaacacaagcaaaactaaacgaatgtgattatatcaaactaaacagcttctgtaaagcaaagtaaacaatcaacagagtgaagagataacctacagaatgggagaaaatatttgctaactgcccatctgacaagggactaataaccagaatatataaggaactaaaacaactcaatagcaaaaaaacacaacaaaacaaactaaaacaaaaagaaacccacaaataatccaattaataatgagcaaatgctttgaataggcatttttcaaaataagacatacaaatggctaccaggtaaatgaaaaaaatgcttaacattactaataatcagggaaatgcgaatcaaaaccacaacgagatattatctcacgccagttaaaatggctatcagaaagacagaaaataacatgctgagaaagatgcaaaaaaaagagggaatgctcatgcactgttggtgtgaatgttaattaatgcagcaactatataaaatagtatggagtttcccttaaaagctaaaaatacaactaccatatgatccagcattaccattgccgggtatttatccaaaagaaagaaaattagtatatcaaagagatagctgcacgtgcatgtttattgcagccctattcacaataacgaaggtattcaatcaaccatcatttgatgagtggataaagaaaatgtgctatatatacacaatggaatgttattcagccacggggaggaaaaacataaaatcatgtcatttacagtaacattggtggagctagaggacattatgttacgtgaaataagccaaccacagaaagacaaatattgcaagttttcacttatatatgggggctaacaaaaaattgatctcatggaggtagtgagtcaaatggtagttactagatactgggaattgcagcattccaatgggatgaagagggtacaaaaatacagttatacagaaggcacaaattctattgttcaatagcacagtagagtgatgatagttaataagaatttattttatatttcaaaatagctagaagagaatatttaaaatgtactacacaaagaaatgacaaatgtttgatataatgaatattccagttactcttatttgataattacatattgtatgcgtgtatcaaaatatcccttgtactccataaatatgtacaactattacataccaataaaaaagagaaatagaaaacacctcaagatgaaacaaaaacacgatatgccaaaatgcatgggaaacagaaaaaacaggactatgtaagaagttcatagcaataaacacctacataaaaaggaaaaatgtctcaagtaaataacctaactttctccttcaacgaactagaagaacaaagaagctcacagttagcagaaggaaggaaataagattaaagaaaatataaaaacataatagaaaatagaaaaacaattaaaaaataaaactagagttggtttcttgaaaatctcaacacaattgagattcccttagctattccaagaaaaatgagataagactaaaataaataaaatcagaaaagaaagaataatgctacagaaataagagacataagagactatattgaacaattatatgattacaagctggataacttaggaaaaaaagtggacacatttatagaaatatacagtctaccaagactaaatcatgagaaatagaaagcctgaacagactcattattaatatggccatttaagcagtattttaaaatctcccaacaaagaaaagcccatgaccagatgacttcactggtgaattctaccaaacgtttaaataagaattaatttctatccttctcaaactcttcccaccaacccccgcaaattgaaacaaaacaaaacaaaaccaaaaacaaacaaaaaaatttccaaattaattttgtaaaggcaatattccctgataccaaagccagaaaaatacatcacaagaaaaaaaactagagatcaatatttctgatgaatacatgtacaaaaatcctcaacaaaatactagcaaactaaatccaacagcacattaaaatgttaaaaggatcacacacaatgtccaagtcggatttattcctgggacagaaagatagttcaatatacaaaaatcaattattttgatacaccacattaacagaataatggattaagatcacatgatcacatgataatttcagtagatgcagaaaaagcatttgacaaaattaaatgccttttcttaaaaaaaaatcctcaatatattaggaatagaagaagaaaaatgtttcaacattataaaggccatatatcaaaagaccacagctaacatcatactgtctggaaaaaaaaaaaaactgagaacttttcctccaagatcaggaataagccaaggatgttcacttcccactcctattcagcatagtactgctagtcctggccagagcagtttaggaaagaaaaacaaaaggcctccaaaatgaaaaaaaaaaaaaaaataggtaaaatagtgtctgctggcagatgacacaatctcatatatagaaaatcctaaagactttatcaaaaaaactgttggaactaataaattcaataaagtttcaggatacaaaatcaacatacaaaaatcaattgtgtttctatatacactaacaacgaactatctgaaaaggatactcagaaaacaatctaatttaaaataatctcataaagaataaaatacttagaaataatttaactaaggaggtgacagacttgtatactgaaaactataaaacaataatgaaagaaattaaagatacaaacaaatggaagaacagcctctgttcatggattgtaaatagaaaaaaaaatttctactattcacatgaaaccaaaaataacttgaatagtcaaatcagttttgcaaaagaataaaaaactgaaggcatcagacctcctcatttcaaatatatattaccaaagtacaataatcaaaactgtatggtactggcacaaacagagacatatagaacaatggaagagaatagagagaccagaaataaatctatgaaacggtaacaggtccacaccataagacagggcaacaaaaaggtgtggacagtggtggaggggtaccaggaatgcacaaaggggagaggatagtctccttgacaaacggtatttagaaaattggatatccagaagcaaaaaatgaaattagacccttatcttacagcctacacaaaaatcaactcaaaatggattaaaagcttaaacgccagacctgaaactgtaaaacttccagaaggaaataaaaaaaagagaagaaagctttataacgttggtattcacaatgatttcatggacatgacaccaaaggcataggtgacgaaagcaaaaataaacaagcaggaatacatccaacttaaaagcttctgtacaatcaacagggtgaaatggcaagctatggaatgggagaaaatattttcaagccatacatctaataatagatcaatatccaaaagacatagggaacctctacacctcaatagcaaatgactgataaaaaacagtcaaaggtcttgaataggcatttctataaaaaaggcatacaaatggacaacaggtatataaagaaatggttaacataactaatcttcaaggaaatgcaaataaaaatctcaataatatattacttcatacctgtcaggagggttattatttattaaaaaaaggtgttggcaagaatatggagaaatagaaactcttacatgctattggtgggaacgcaaaatggtgccagccactatggaaaatattatgaaggttcctcaaaaaatctaaaaatgaaactactttacgatccaacaatcccatttctagatatttatcctaaataataaaaatgaggatctcgaggaggtattagtattcctaagttcattgcagtattattcactatagccaagatgttggaaacaacttaattgtctaatgacagattaagaaaatatgggaaagacacacagtggaatacgatttggtctctaaaagaaggattctgcaatagtcagcaacatgagcgaaccttgaggacactatgctaaataaaataagccagtcacagaaacacaactactgcatgacttcacttatatgaggtatctaaaatagccaaattaatagaatcagagcctgaaatggttttttccaggggcttaggggagatgggatatgagagttactaatcaactggcataatatttcagtttagcaatataaataagctttagggacctgctatatagtgttgtacctataaccaaaataatgtaccctacacctaaaaatttgcttaaaaagtagatctcgtgttaattgttcttaccacagtaaaataaattgaaataaaaataatgtggctgttgaagataggtactgtaaaatgattaacacatatttaatatatcaggtactttaaaatgatgaggatgtatttaatgcattattatggcttcaaataaccattcaatctgatccatattttggcatatattaataaaactgccctcttcactagcctataaaatgtaaacatgatacacaaaataatagtgtttcatttaattcaatgttttactaatttctgttcacacagctaaataaatgatcagtgcatgattttccctcttaaaaaagttttatcacttatctaaataagttttattgaaatgggattatgtgctactctctgctttttaaaaaaatttgtttctggatgtatgaaattcttggatttacaaatagtgattaaaaaactattctggatcattttctgttatctttttggtttcgtttcaattttcacaaggattggtttttgtagaatccttgctgatctctgcttgggtgtttcttgacagccccttcagcagaactgactttccttttggacatcttagtggatatcagctttcttaagaaatgaatgttcagtacaaactttttcattaaacatttaatttttaaaatctcattgctgccataaaggtctattgcaagataataaagcatatttcaatgataaagtaattagttccaaatttacacaataaaataaacagcatatatactcgtggcatgagtattcaggctatattttgtaggtctgtaaatcaactgctcagtctctatttctacacatacttcaagaacacatatttcccatatttccccctaatcctgccaattcatggcctggcagtcttacgtatcattcaaaccacaatacatgctgtagcataactatctgttatacaaaatatctgtcagggcaacaatgtcaaatgctcctcctggccaggcacagtggttcatgcctgtaatcccagcacttgggggtgctgaggcgggcggatcacaaggtcaggagatcgagaccatcttggctaacatggtgaaaccccgtctctactaaaaatatagaaaattatctgggcctggtggcacgcgcctgtaatcccagctattcgggaggctgaggcaggagaattgcttgagcccgggaggtgtaggttgcagtgacccaagatcgtgccactgcactccagcctgggcgacagagcgagactccatctcaaaaaaaaaaaaaaaaaaaaataataataataataataataataaatgctcttcccaccaccatctagggtcagaatgggtgacctgttcatatctaagaatgcttcattttatctctaagtgtcctatgttctatccttgaaaggtaagtgttaatcacctggcatctggaaaaagttgagaaatagatacaagttattatggcaaaaaccacaattacttttgcaccaacctaatagtatttgtctttcagatgtaaccatgcattataattactgagcactgcaaacttatgtcacaaagcggggatctaataaatacactgtggcttattttaatgaactactaatagtgatactttgttaaaaagggaaaatacaggataaatgtcaacacagtcagaatgccaggacaacaggcataaataaggactgtccttagtaaaccagggaagagcagtacatatgtggaaatggaaataagtaattctgtctagtagttcattgctactagaagtagcatttagcctatgtcctggaaaatgactaaaattgtacaaattttgaatgtaggtacaagtgtttcaggaatatggaagagagtttgcaaagcagtagaaacgtgcgacgatattgtcctttcaggacaatttaattagacctctggatgtatataaatgaatagtgaggagtgaagctggcaggtaggttgggacatattctggaggctttaaatgtcatgccaaagtgttgagtttagatttgtgtggccattaaataattttcaacagagaagtgatgtccaattttgtatttcggaaagatcagtcaggtagaaatgtggagaaaagttttgctggagggataaagaagtgagtggctagtcgactgttagagcagtgcagggaacaataataaggatgagaacaaaggcaggggcaccatgcaattggttaaagctggggaacttcaacctctcatggctaagggatatatttccttgagatttttcaacagtattagctacgggcctcagcattttgtattacccagcaggggaagattctcaacagagaggtcaaagagtgaagagcatagaaaatgctctgtcagaatctactattctgtgggcaaatgacagcatgatacccaatgatatcttccctggggaactaaagtggaatgagacaggcagattaaaatgtaagcagaggatatagaagctgactactgagaagtgaggacagcacataggacagcgtgaagtggcaatgttagacttaagtagctctgattaagcaaaagtgccttgcagacaataacaccaagagataaagcaacagactctacaaaggatgaatggatcatgaaataaaagtcatgaggctgccgacagtggcttgatgattatcaagttggtctgtggcctacatttctgttaaatttactttgcaccaagtttggggaaacacgtatcacctgttacattcattggtgaagactgttctgctactattgcctgatttattatttttaattaattattttgactttcaatggacagctatttgctcaaaagaagaatggaattaaattgtactaatcggggaaggggggctcaaataaaatctgacaattaaaacgacaatacttcctgattttgtaggagcatcctggtttgtgcctattgctgagcttaatttttattagcacttgcttttaatctccaaaataccttaagtttggatagtaaattatattatcaccctgtacaaaatatgtgttttatatagacattttaagagacaaaggtatccatgatattaatatatttgggggcgcaaaggcaccataattaaaataccattaccagcctggccgacgtaatgagacctcatctgtacaaaaaaaaaataaaaattagtgaagtgtggtgcacacctgtagtcctagctacatggggggctgaggtgggaagatcgcttgaacttaggaggttgaggttgcagtgagctgtgattgtgccactgcactgcaccctgggtgacagagcaagacattgactctaaaaaaacaaaaaacaaccaaaaaacttctagaacaatgaattgctacgccttttatactggtctttatttggggaaaaagaaatacaactactggaaggagcatgagctagaatagtaagaaaatattttactgaaaagggatcttggcacagagtctggaagaatgagcagaatttaagcacatgggagcagaactaacactaaagaaaaaagaaggtttggtgatggaaagcagcagagagagagagagtgtatgaaattaagagttgcttgagttaatgaaaagatgagtttgagaattaattagtgataaatatgtttaatacctggttcttactagactctcctaggatgaatgagtgaatgaattagcggatgaacatatgaatgaatgggtaggatgaaatagatttatctagggaagaataatttaggtaaagcactgaagtggcaaacatgatcccacgagccaagtttgacccacggtagttgtttagtggcctatagtccatttacattctctttaataccacttgtatactttagaaactagatgactttagataaaatttcttatttcaaattccactttaaaattttcctgtcttcctatagggcaaaatgcttagaaccagagagggcatctgtccctttcagatgggcatgtatgtactccggctttcctccatttcttctcacggtttcactcatatttcatctccttttttagattgggacctttgatgtggtgcttggaattataatcaggaaaccaaattgattaaaatgtagaactccattgcagctaataatatataactgaaagctttctattccccctggcatattaatgcatgtatctagaataataatactgtaataataactactaagcatttagtatgtacaaagcatgacattaatctcctttcagacatgtgagtttcagttatcactccaggcatctgctagttgtatgatcttgaacaaattaactgactttctgaacattaatgtatttctttgggcaatgagaatgataaccatatcttatatggcttttgtgagaattaaatgagattatgtatataaagcatttaacttgattcttggcacccatcaagacttcattcatgaaaagaatattttcccatttcaaatctgaacacttgaaaagctgtgtaagcacatgttttagaaaagatctctagccaagaggttaatttttcattcacaatgtagtaaccatcaatgtaactttatttcaataggttgattttaaggctcagatcaaatttctattcatcttaaaaaaaacttatgaaggcagagttattaaagctctagtatgaaatatattgtttctataactttaatgtgccctacaaatataataaatataaaaatgtactgctattttcacagattatctacaataaaaattcccagaaatgcatctaaaatagtgtgtttccacttaaccagataaggttgagtgtaaagtgtaagttgcatttgcaaacactgagcttgagacacctttccatattactgtatgcagatatttaattgcaataacaatttaagtggaaaacactatgtattactaatctaaagtaaaagcaagaattgtttattgctaaactacaatagaaataactaaaattaagccgctctctgacaaattgttcccacttaaaaaaataaacagtagagagtagaatatacaaatatgaagaatatttcattggtaaatgttttctaattcggagccatttatattcacctattatatgattattttcttattttattccattttctcaaaatatatatttaaagtgcaaatttagagatattgacttttcagtttatacctctctttcacatgaacttgggtcatatagtacaaaataatttgtttgtgttagtagggagaataattgtgttccataaacaaaaagtcagccaagacaattgtttaactgtataattgtttacttaaaacggtatattttgttggcactgatttcaaaagtccttccttcatacttttttaaactatttgtattatttattttcaagacatttcaatgttacatttatttatgtaaaaataatagttcattaggtaccagttatctactcaataccaaatactgtgcacacatgattctgttagatttaataacttatttatgagatgagcattgttattcctacgtcaattagaaaacccagtatcgggtcactaggtaacgtgcccaaaattagcagttagtaaacagccagaatttgaattccgacacatttgaagagtactggttttcactcatagttgatcatagaaacattgacacatttctgttaataggactttttaagactatacagataaaaaatctattagataattttctcaaagagataatgtgcattaacaagttaaaacagcatttaaacattttaagtttttattcattttatccatcaactaaactaaaatttcttttacagaacaacatatatttagccacttagcagtgccatgagaagaaaaaaattagcaagacaagaacactggtaattacttacaaggaatgctatttcattgtcatattattgttatagaaaatctttaatttaaaagccatctgaaatattttgtcaaagatgtctgtgaatacataattaagatatttagataatttttaaaaaacaggaaaaatgtagggttgtattttttgtaatagcaagtagtcatttccttcctcatctgcaaaacttcatattttaaaacttctacttttatactatttccagattataagcttttgtgatgtaattttttttttagctgagtaatttaacaccacttttactttaagaataaatgattttacaggtggagagaagtctcaacaatcaatattcaaagttagttgtattacctttttcccatgtatattttacctttgctgcagaaatataggaagactagaaacacgaatatttaaaatcattaaaattttaaaattaaaattttgaacagtaaagttaacatgactatttacatcaccttcctattttgcattgaagaaattttttgaaaaaacttacttgaaaactgaattgcaaatccagatttgctaatataaaaatccgtgtcaaactggatggttactatattgagggtgctatgaattccttcaggaataagagatccactaatttcctttaaaagcatatcattttctggtggaccgtcccagactcggagtatatcatgtgatgcttccgtatcaaaagcaagaaactgcaagctgtgggagaaccatatttctctgattattttaaacaaggattcaactttaaagaaaaaatagaacaaatgtgcattatgccttttactagatagttcttttttgctatgtgttaaaaatgaattacataaacagcatatattcttaatatatttttcttgagacatataatttgtttttttagaatattattaaatacaatattacatcacctttgcaaattgtagaaacttcaggcatacattctttcccgtgttcatggatttaactagggcaacagcaggggacatttatagataatcttctacatgctaggcactgtgcaaaatgcgttacatatattttatttgtttaattgttataatgacccaatgaaatatgaataatttttatcttaattttacaaatatggcaaatggagtttagataaatgaaataatttcccaaagagtggcatagtcaaaaattgaactcaagttttctgactctacagtacatgcttttgccacgtttcatgttaaatctattctgttttaagtttaagctagacaaaattagaatcgggtgctttttgtgcttggtgcaaaatttagaaatctaattatattgacatgctcaactctacatacaatacatttatgtttgatacatgaatcgttacagctttaaatttaagttgcaatttaacatcaaataatgtttaatttttagaaattgcagaaatctggtgaatttattactttcaagtttaataatatttatataaaacaatgcacgacttagactaaagaaaaataaactggggatgatatagtgtagtctattttcagtttgcacattgccttgcaaaagtaatgtaccaactcacactgcatccatcaatgcatagtagtataccacctagaagcctgtctgaaattccattgtatataaatggaatttatattactactttatataagtagtaattcttaagttttaaagttattgtttgttattgaaaacacaccaagtagctcatatgtcaaggatgattctagccaaagctgcatagtaaggctgggactgagagcctgtgatagctttggaagtcagactggtgttgatttgagataatgactctgtacttatctaaggggtagtaacaatgtgaggaactctgcggaaaagggaaatctaacatgattacatgggcagagagcaagtgtttcacaaatgtgtttagggacaaggacaacaggaaatggtattcagtccccttctattcttatttctcctaattgttaatgaggatgcactagggtaataatttgcaaaactctgtatatcagtcaaaatgggccaggtgtagtggctcacacctgtaatcccagcactttgggaggcagaattgcttgagcccaacattttgagaccagcctggtcaatatagtgagacctcgtttctacaaaatatttaaaaattagcctagcctggtagcacatgcctgtattcccacctactggggaggctgaggtgggaagatcatttgagcctatgaggaggaggttgcagtgagccgagatcgagccctgccttccggtctggatgtcagagcaagactctgcctcaagaaaaacaaacaaacaaaaaatgaaataaatggatattaattttatataggggttggttaggcacttcagattccctagtaatgttgagaaaatgaaattcatttacctgacaatatttccaggatctacctcaatcatccacatgcaacgcaggttattgtcatatggaaaaggatagccaggagataagattcttcctgatgattctcctttaaaacgacctccacattcagctgataaaaaataatagaaatttaagccacaatttaatgccaatcttttcaaaacaatctacaaatttctcatgagtagacaaaagaatactgattttcttgtttctttaaagtatacatttgtataaacttttaaagtatcaattgaagcaagaatatataatacaatcaaataatagagtctcaagttagagcacaaaaaagacaacaaaactgaaacctacttaaagaattaaaacaagacacactcaaaacctctgagttaggattccaaacattttaagatgtgttgttaaataacgataattttaaaagggaaacagatggcaagttgctcactgctaacaaattgcaggctgaataattcatcatcttgctaccccgcctttgagaaaaactaatctttactgcagtccctcaggccttctaaatttcattgtccttttatttcccctttaaatcattttaaaccctttcccttgtactctcccaaaagtcaaaatggcattttttattagattccttacttcagtaaaatctagttaggttttgatttaatgtggtctctaatttttataaaaattatcaaactaagaatgtgagtatcgtcatgcaatataattaaaattttatattttaggggattccttctccattttaatactatttaatactgttgtgataactggagtgattttacgtcagtgaacaacctagaaagagtctctgtactggaaaagagagaaactaagtattttagttagcatattgctctacgtctttaaaccctagaaacaaggaaaacactgtggaatgccttacacatttgaatcttttgtgatagttcttgttatcaggcacttgtgcatgagaaccctccccttatggctttcccagctctgtttgtcagagtttttaaaacaagtgactccattttgattctgacaactttcctattatcttagattaaataactgaattaaactttttatttttgattattattattattagaccaaagaaggtcaaagcaggaaagttttagcatttggaagagacctgataacactagaatctaatggctcaaatttgtaggctgcatatatgttaacttgttttaaaaattttagatactatattgcaccaaactgtgatggatagttttatgtgtcaacttggctgggctattagtgccagttatttaattaactattttataggtatggataacatctacactcagttgacttgtaggcctcatccaataaatttgaagaccttaagagcacaactaagtttcctggggggaaaaaaaagaaattctttctcaaaacttcagcaactcctgcctcagtttctaagctattaacttgccctatggactttggacttatcagcccccaccattgcatgattcagttccttaaattaaataaagctctatagatagatagatggataaggaagacagagagagagagacaaaagagagagacagagacagagagaaagagagatatcctattggtgctgtttctctggagaaccctgactgatatacccatggagggctaagggaatattaccttttattgcaacattaatttaatctaatttacaataacacactcgggagatttttaaattaaaaagatattagtatttaagatgttatcaccatttatggtttttcatttttttctaacaaaaattcttttggacaatctgtaaacataattgtattaattcatttttcatcatttatttatgatttatcactatttgattacatttaatttgagaacagagttgatacttattcttcttgattaatttatagtcaattagagaattttgcactatattgcatcttgaacttaaacatagctgtttccccccatatttctttgttataaaatattacctggcatttttgacctcaaatgagccagtgtcatatgctgtagtactggagttcatattctatataaaacttatgtttgcagaataaaatgaaatttagtgtttaaagaagagatacaggttaaatccttccagctatggtgcctcaaaaactaatttttgtttcatcaatgaataagattcagaaatataattacctataagtaatctaaataattaagaaaagtttccttatttgactgaggctaaaacatagctgtagaagatatttaaggttaatgagcacaggctattataatcataggccaagtgttaaagctattaatcattgcgagtagagaacaccatctaaaatagaatttcatcttctgttatcatcaaattattcagtatcactcaccatatgtccaactgtttatagctgctaaatttatttgatcatccatcattagaattttaataaagaagattaccctacctgtgaaatcttgtgcaatatcaagtcaacatgttttgattttgagtacttgtaaacataaaatgcattgatttgctgcgaacataattaaaaccttctgatctcatactaaatatccttccatttgtataaaacctttccaaaaagtagagaatatcttcagcttgtttcaacacacataaaaatatatatgcttttaatgtatttgtttgtggttttaattttaaaaacagcatggcaagtcaatatttatacatttatggtattgtgctattaaactcttaaagcttttctgaacatatttcataatcacatcagagagaattagtcagtggtacatttttctcataaccaatgccaatgggctgattattgatcatattccagcttttggcaatttaatttgattattattttaggtatcaccctcacaatctctccaaaattcagatgccgtctgaaaagtaagaactgtgattgcattttagttagataaaaccatgttgttttctgcatgaatcaatgttttaataaaccaacagaggtctcatagcatcaaaaccactacgcaattagttgcaaggcctataataactagaatttcatattttctatttgtattctagcaagttttatggcaattcctatgctgaccacatcaaaaaacgacagaaatattctacttttgtcaaaaggtccaggtcttaaaaggtaagtcaaattgcacattaaatatgtgtagttttttgtatatcaattatacctcagtacaccttctaaaaataaaagatttgagtcaattttatccatataggcctgacacagaatggatttctgcctctataaatgccatcaaaaaaagaaaggctgaagaatcactgcatatatgttctctgctggagagttagtgttttgctacaaagttgttttcctttgttgtcctagtattccaatctgacacctacttggtctttagagcagaaaagaaaaagagaaaaagagagatctctatccacacctgtcaatatttgtctatctaccttcccacccccacctacccatctatgcattaactaatctacaagatggtaggaataaaatggtaccccagctatgcaaagaagacagaaaatgatcattctctagcttcacgaaagcaatatatcttatgtcactctcacattccttttcctactgaaattgagtgctatgctgtaacatgcatgagaaaagagaataggttactgttttctctaatccaccttgattccacaataggtaataattttgtaaattaaaaaaatctggccaatgcaattcaataaatgtgtataattaaaagtcttaacattttagtaatgagttccattttatgtcgaggtagcagaaataaaatgacttcaaagagaccatattgtcccccacaaactagaagattatgggaggaataatgaataaagttatgaaaaggaccttttcattttccattaattttcttttgacaaattcaagctatgagttcattaatttctcgatataaagtgttagttctatgaggacagaaagaatttcttaaaaatgcaaagaatttgataaagttttcacagaaatattcaatgaaaatctatgacagtatcctaccaatacaggaaggcagaggatagtcccatgcccttctctcccctgtcatgcacttgagaaggctacttccgtggagagtgtagcctggattgcatccataaatgatggtgctaccagcaaagtggccttggtcactgatcttgtatccaaattgtggaatgccaggatcttcacagtgtgagagttcaaaacctgggacaaaaatataaattgattaaaggcaaaatttaggaggaggatttaaatctatacaaatcattcctttcctttactatttttgatgattacatacttattcttagtcatattgcccttaccatatttaattttcgtatcatacaacaaccatgcagacctttttttttcttgaaaattaaaatgtgttgtgtttttgaagtttatcaatgataccccatggtctatataattaccatggcttgtggtactaagcttcctgtctgcttcaagtgatttagagttaatagtagattctgagtgataccatgatataacaacaagtatatatttgttctttgtccctgattcctggcacagagctcctaaaagtcttggaatttcttgagtgataagagtgagagtacagtttttgttacttatcataagccatccatacctaagtttctataatgaagttgttcctggaggatgggggcttatcgccagagaaaccaaccatatgattagaaggttgtgttggaactttcagtgccgtccccatggccgggtcatatacatacatctccgtggaggggagaaggactgaaggttgagtcaattactgaggagcaatgatttaatcaattatgcctatgtaataaaatctccataataatcttagacagaggggttctgagagttttcagattcatgaacacctccacatgctagaagggtgatataccccaaatccccactccatggggacagaagctcctgcacttgggacccttctggacctcagctatgtacctcttcctttggtagctcttcgtttgtatcctttataataaaccaataaaggtgagtaaatgtttccctgagttttgtgagcattctagcaaattatcaaactcaaggaggaagttatgggaaaccccaatttatagctcgtcagtcagaaatacaagaggcctagattttcaattggcatctgaagtgtgggcattcttgtcggattgagcccctaaactgtggggtctatattaactgcaagtagtgttagaattgaattgaattaccagacatcaagtcggtttcaagtgttggcgctcagaacaatatactccaaagtatggcactttggcatgctgagtgctttgaatgaaaagtgattagaaggcctcagaagcaaggtctctctgcccttcttctgcccttctgccactttctctctcccaaagctagtcatacaagccagaattcttcttccccaagatgcatcataaaaactagaaaacctctcccccaaagcgagccacagaacctagaaaggtcattttcttccttctcccttgaaaaccctcattccataggggtcctgccccataccctggaaaggaaagctccataaagaggtcaagaagaatttgaacaaacaggcttgctgggtttcccattctcaatctattactgatagattataccttttatgtccaattacatttctacgtagctgaccattcatcactgaaccgcagcataaaaacagacagtttttacgggttctttgggtctttatttctgaaggctcccatgtcatataaaaccatgatccaataaatttattatgcttttctcttgtcaaataggaatatcagcatgacacatatgagggtgacgaaaggtatcacatctttctatccctacaccagagagctggataattggtcggtgcgaggaagaaacatacatatatggcgtcagaaggggtgtgagcagagaattgggttttgcattactgatcaacataactattaagatcatatcatcaacattttaaaattaagacaaaatatgtgaaataataactagccaaatgacaaataatgtcaattgcaaatataactggactgctttagttgtataaccttagaagaaagtgaatactctcatatttaaaatatactttatcaagctaatatactaatcagcttgatgaactctaaatttttatattctactttctccggaaaaagcacagttcttagaaattctcacaggaaaaaaaatagaggcttcccacgtgttgtcattctgagatgtagagataatatttctgtgtttctacagggttggggctttctgaatgaatttgctaaaaactgagatcctgggctaagagcgacacttgagaagttaatttacaactgtatgaatagtgagaaaactccagagaaatttatgtaactgtgaggaaggtttatgtttacatttcaatgaagaatgaggcccagaaatttacagaaatctctaggttataaaagtttgagatatgggagattaatatgtcccttaaatagatatatttacattacaaaaggttagagtaagaacacatgatcctttccatccaatctccaaggagcataggtttttctcccaccttccaggagaggagagagagaaagcagcagaataagctcatttgtttttcttcctttgtctatgaagcccctggccacttctgtagaagattttttcattaggtattcatggtgttgcccccaggagtaaggactaggtgaaaggagagctgacacagacatcatcatcatcattatattacttaataagaatctatctgcatcctgaatacctcatttgcatattcaaagtaaagttaataaaggtgaatgctaaaaatcccaacagtcttaacacaacacaattaagattctgaaggaactggaaaaggacacttcaaaagataaaccaaacctgatatgaacaaatcaaaatctaagctgccgtagctatatagtttcttctgtttttaatattttgcaaaatataaaaatgtagggtaaatgatgtaataaatacaccaaggacaattaggtgaaaacttatattaattacagcttctgaggatagaaaacctttaagaatattctagatagttttatgaataaggaaaatcacttaagacaaaaatgctggagaaaaaaaacttttacttgtgtcctaaattatatggtgatcaaaaagagatctacataacttttataggcatagattcttgaccaaattaatctagatttgaattagaaagcaaaaaagtgtatattagctcacttgtgtcaaatcactaatttgcatcattgactttctagattgtcacaacatacataaagtcacaagaacttgtatagttctaagtactaagtttatcctattatttctgtgagttgagataaacattatctctcagagaacattaggagtctttcctagtctctattaaggggtcttaatcacttcctcctctgttaaatcatagaattatttgtacctttgaattcatttgcaatgattgtttcttttccttgtttttgtatagctgaaattctttccttttttcccctccctctttctcacagtacctatctagcacaaatcctgagacaggctagatgctcagtaatgctcagtaatgttcatgattgaatgtggattcttagaaacaattatttctaggagacaactgaaaaataaagtaatgctgataagaaactgaaatttgagagaccatttttaaaaatagtttcaagaatttcctgaatatctcaatttatgataaccccatttgggtgaacatgcaaacagcatcagagacatagccataaagaggttagcagtcattaactcaaatcatgacatatataatgaaatgcaatgaaaaaatagtcaaacaggtcagtctctcaaacacagaagaaacagcagaagtagtactttaaaatttcagaacatattactttgcatggatctgcatacttaatactacatttaaacgtctttgctcaaaaattacaagtttgcatttcttccagcagatataatattcagtttatcattcaagatgcaatgtattttgagttttaccatatatcatttctcaaaataaaaatggaaatcaagctctgttttcaaggtttattgccaaattcatccttccttaatttgaattttctgtaaatgtggttgggcattgctggtgatgaggtaaaatggatatattctttgtaaattaagacaatttataatattttgcattgtagctgaaaatgcacatggacaatagtatataagctacaaagcacaacataattttgtccaaattggtggaattattgttgcttattcataaatatgcagaaatgtcttatctttatggaaacgttcagctgctagtcttttcattgaaaagctcaaatacttgaaactgacaattaaataaagatgtgtatgaaaaaccgtatatgctataaatattcaacactgcttgtgaaattttatacgctggtgaaatgaaaatttctagaacaaaaatgaactgataatccccattacctagatgtttttgattttctgaataccttaaactgagatttcattcctttcctgccaccgtgtagcatatttctccaaagatatctaatatatttgtaagttatttgaaatctacaaaaaaatataaaggatgacaacaaattcaaccactagctctatcagattctagttttgtatcatagttgtgtcagactcaaatcaatgttaattcagattaatattcagattaccattcatattaattcatcttcacgttaatattattattacaaaacaagttaaagattcttttgtactcctccccagtctttctctgtttcttccctgagagctagcaaatattctaattcagtttattattcttgcacatattttttattacatatctatacatcaatgagcaatatatagtgttttgcaagtgttcatacattttataaattatataatggttttaaaaattctgtggcttcatttattgcctggtattgcgttttatctttataattatatacccaggcatgcacacatgcgcacactcacacacacacaaacacattgtattcattttaactactctgtggtattccgttggtgacatattcccaaactaattgattttgcagcatttatattgtttccaattttttactgctatgaaaatgctatacttctatgtctccttttgcacatgtacacgtgtttttatagggcatgcactatttaaagatataaagttcactttgtcctcaagattcaaccaaaatctcctaatcaattacttaacttctgtcttggcttactaaaagataaatagtaaaattttgacctcaacataatttctctcaatttgtttatgagtaactatgtattcacatagggtaatgtcataccttactagcaaaacactaccagtaatacaaataatttacatcatttaaaaataaaagtgacatgtgaaaattcatttttaaatgtaataaaatatattttaagtaacttaaaaagactcttacttgctttatttttttaattcagttaaaacataaatatatactttataagttaaattccagagtatttaacggtcaatgaagatatgttagtttcatgtgctaatagtaaaaacttccagattgctaaataaaaaaagaaatagattgttaaaaaggaaattgggaaagtatgttagctaaatacattagagaaatatgcttgccaaaaccatatatattaataaaagttgatataatgcaaggagacatgaatattatattattatgcaataattttaacctctatagaattgttggtgaacttaattcataatattaggcagaataatttgggggaactatatttaatatttggtgattaaattccattttggccatgagtcttgcaagaaaacatcctattttaaaattctttatatttaagtgaagacctcttcatttatatcaacttttatatcaacttcattatatcaacttttattaacatatatggcaagcatatttctctaacgtatttagctaacatactttcccaatttcctttttaacaatctatttctttttgtatttagcaatttggaagtttttactattgccacataaaactaacatatcttcattgaccattaaatactctggaatttaactataaagcagaatgtcaactgtgccacctcagaattcacgaacagggaatacttcaagataacaaacaacagctgcaataatcctctgtgattgagatataataaagaatataaagggaataaagaaaaaaagaaaatggtgaagaagagttatactctttttctcattaatagaactaataaaaacaaatttgacacaacatgtatttctcactaatcaaactatacaaaaatcaaactttaaagctacaactttagaagaatgctttaagaagacaatcccttccagtttttagtttatggaaattaagaatttaagcaaaaaaagcttgtggaaattattactatgcatttccaattgctttcaggagttaagataaaaggatcttttttttttttaatggcagatgctttcattcctacatataaagttcttactagaaaatacattactgacagactttcctaaattttaatctgttagacataatctagtaagtaatattaaacgggctaagtttgtatcctgtacatcatagatttgtaccacattctaggttggtgatgttcatctttgactgaatattaacttggtcaaaaccaatcagcattgggcatttggcctaaatgtatagttggtgtaatctaaatatatccagaaattgaattttattagatattgccaaattaatcttctaggtgactaccaatttacattccccaaagtttataagtttcaatttctgcaaattgtcatcagtacttggtgttgtacagctttctaacttgtatttactctgtgagggtgtcatagcatcttatttgggtttccattttcatttcttttttctttccatgtccgatgggtaatgtgcagacgttgtaacaaggtttgaggaaggcacatctcacacaagtgtgaaaacctaatcatcacacttttaaactaaaaaagaattgaggaaggcacagctcacacgagtgtgaaaacctaatcaccacacttttaaactaaaaaagaatttttcatttcttaatacctatcaagttaagcatttttttattctgctgaacttccctctactgtgaaattggttttggcccatgtttttgttttaggttattttttttttttcttattgacttgtaggatttcttttttctagagagtgcatgttttccattatataaatacctccttttaaaatgtttcacttctgtttacagtgtccctttctatagggaggttttcttggccctttcctttccttcttcctttccttcttcctctccttccttcttcccttccttctcccctcccttctcccctcctttctcccctcccttctcccttcccctccccttccctctcttctcctctcctctcctctcctttccattcctttctttttttccgggacttggtcgggaaaacagaagcctcttatgtactgtgtgtagctaagattcaaaacaagaaatttgaggccttgatgattttggaaatgcaaagtgtgtgaaagtcagaagaccactgctggctttcaggaaattcagcagttcagggaaactgctgccacatccaacaacctgacagcaccatactcctgcctgtagctgctggtggaaaataatggcttctccatcgatctcacctttcagctctcacaggtctgcctttaattggcagaatctaagcagagatatttgttggcaagagaatctgaaaaatgtagttgccagatttttggtttctacacttcaaggagtgcttagaaggtcagaaatgctactgattattgatgaatttttgcttgtgtatcttatttcagaaatcttcttctaccttaaagacacagcttttctaagccacacttttattttctaaacattttaaagttttgatatttacatttaggtcttcaacttgccagaaattaattgtatgtaacatgtaaattagcaggtccttagatatgtaagtttaaatttactaaacttctatgatgtgaaggctatgaaaataatgatacttttattattctagtatgaagaaatttaatattgtctatgtaaatgacagttaattaagaaatttttctttagtatttcagttagaatactttggactatatcacgcagcattgatcaatacctcccttatcacccagtttattttgatattttaaaaatgtaagaaatgtcaaatgtatctgctaactggtttgtaggacatagaaccacatggaggggctttgttgctcccttgtaatttacttattttctacttgcatttgcattaaatgagttatatagtaagaataaaggtagagttaataagtcatctgataattttttacgatttacattgccaacaacaaaccggtaactaaattaaagactaatttattgtatattcacaaggctagtatgcaagaaaaagcatcacaaattagttaatgcccatctttaatttgaatataaaatttgaaatggccatgctccatgtagattattaaatgatttcaagcaacaaaactggaaggctgagaacatccaaatatatttacagttttctcttgggataatgaacatttctccagtgggattttttgtaaattaaatgtgcagaggagataataagaaaacatctgagcccagagtactgactaatggctgggcaacatgcatatttagcaggtcagcttttgataagacaatagtataatccatcaataagttgcaatttggctctgtaatagatggctgttaaaaatactcaattcctttttacaaaataaaagtagtataactacaagtatatagggctaaaagaatctgtaattaaataatcttcaacaaatagagtttagagatttcatgaacaatatgaatgatagcaggaataagtctttccccgatagtaaatgtaacaaaaataaaaaaaaattcagattctcaaaaataaaatgacaaaagtttctttgggaagaattgcactaacattatttctctctctctcttttttttttttttactcttacctggacagttttaaaaatacattaaatctataaaacttgaaatatatataaatatataacacttcaaatctataaaacttgaaaaactcaaatcttgagttcagagctagtatagcatagtggttagagacatggattctagaggcaaagactctcagttcaatttccatgtctgcacttgttagctatgtgaccttgggtgagtaaggtaactttgctatgctttttatttcctcattttctccctgggaataataatattatctccctctttgggttatgccttgcatctggtaggtggtagataaatgttagctgttgttatttgtaattcttatattgaacattatgataatgaccaaagtctctatgtgccttttaaataaaatccaagcccgtactatactccaccttgcccctaatgatataggagttaagaaattatttaggcagatagtgagggtatgggaattcttggtaagtttttccttttaatgaaaagcggccaccaaatcattttcttttctaacaaagagcagcttataaaatcaagctgcaaacatagacaagcaagctggacacttacatgggtgaatgctggcagttgtgccaatagaaaaaggctatttgggactaggcatgttcaaaatggtggctccttcttctcttctctttgccagccatgcatacagtaaggagaaggcaacatggtgcaggccaggcaaagaccccatttgcaaaataagattagggtggggcagccagcttctggtgtgttatgtaaatgtcatacctggttcaactaatcttttggacctatgaaaatcagacaccacctcataagcctgtctataaaatctggtgtactctgctatgggctggaagtcccatttgggaacccctctctctcacaagaaagagagctgttctctttgctctttcttttggctattaaacctctgctcctaaacccacttcttgtgtctttgacctagattcccttggcatgagatgatgaaccccggttatttgctactgctagtttccaactttatcactcattttgtctcattctccttgctcatttagctacaggcatataactcaagctcagacttcttttaggccttcgcacttgctactccctctgcctagaaccctttgcctgtatgtgattattctttcttatcactcaggtatcaactcagataacatctcctttaagatggagtctgaacaaattagctaaagtggtctcatctgtactatctatcccattgccctgttttaaattacttctaaatgtagttctcttaccttttgttcataactttcttttatgtcttgccccactaaaaagttagtttgttatgggcaggaactttctcttattaattgttctctatattttcaatatataatattccactgggaaaagacaaaatttaagcctatgaccagattaataatttcaataataaataaattagtaaatttcaatagaagagtaaaagggaagatatgccaggtgaccaagtagaaatgatatctctataacttagcctttagagagagagtaaaatacaccagatttagaaatcattcttgaaatgtgtgttgagaggttgaagggatctgggcagaataacctactgggttttgctgaattctgctataggattatggagaacagagtgatgttttaggaaggatactgtattgtgatctcaatttctgatctgtttcccaactctagaaggaagtagtaattttctcttaccctactccctgttctctctcagaagaacaggtatgcctttattggttcctcctcacagggaaattaacaagtaacttgtgtcgcgtaaagtacctgacattatgtctcattcggatatttatttgggatgagtttcagatttctcaaaagcaagagtaaatgacagtaattgttttgagaataatgaggaagattagcctgactcaataagggagttggattctgggaggtttgagggatggaagagcagtgaaatcccctagaggtcataaatatctaagtgtatctcacacatgttttatattcaacagtatagctgtccacactttaattgtcagatcaaaccagagttgactgagaaatttatttgggagaagaatatttccccaaaaagactacatgagatttttcttgacaacgctaaagatgaagactgaacagatttaatttgctttagaaaaaggaatggggctggcatggtggctcacacctgtaatcccagcattttgggaggccaaggcaggtggatcattggaggtcaggagttcgagaccagcctggccaatatggcaaaaccctgtctctattaaaaatacaaaaaaattagccaggcatggtggtgggcgcctgtaatcctagctacttaagaggctgaggcaggagaattgctcgaacccagaagacagagattccagcctgggcgacagagcaaggcactgaaaaaaaaaaaagaaaagaaaagaaaaaagaaaaagaaaaaggaatgggatattttctccctgtctagtgtggtatggtattttcatactaggtatgcatataatttatttgttggtggaagaaggtgagagaagctcacagtcttcttagcatagtagagctaaaaatattaatcatgagtcagccaaatacttttcctttataaacacccaagagtttctgggcttccatgacaccattaatcatagaagcagatattagttcagtatctttaacctaatttttttaatattcgtgacagctgtacattgtagtaaatactgtaagttgtcttctcaatatctcccttcttccttgctaacaactctgattttgttcccagctataatctaacgatatacagcagtgaatcatgatggtctaaagttaaaccaattatttagtcttccacatactgaatattccaggctgctttgctggaaaattaaggcagaaccatatggtccagtttaggatagagacataagagggtatcttacagggattcccaggaaagattttgtatttctgataaaaggagtatatgcggttggcactgcccattttttcctttcttcatgccttaaacatgcccatagttacagtagccaacttgtgaccatgtcaccacaaacatgaaaataaaaagtgaaccctctaggcatgccacagcagaaagacaggagcaaaatccttgttgatcttgttaagtagttgaatcaagatctacctactttctcactcttcactttttcttatatgaacaaaataaaccctgattgtttaggccatggtaaggttttccattagttaaagccaaaagcaacatttaagtcactgtgtctaccaggccatttactatacttagcaattacataataaatggaccaataagataattgaaataaaacgcactttaaaggtctgttctaacatacttttttcattttatctcagccaaatgcagttttatctacccaaaactgaaaataatcagacaatggcaagtgttgctaactcaacaaaatagataatggaatacagggtgactatcattaaatagggcaggtatcatttgataggatggccaaaaacagcctgcttgttctcccactagaaattgtgagaagcatcaagatacgtgggattaatctgaattagattattttccttgaatgttcttcctaatctctgtgtctttcctcattcctttctctttgcctgtaatacttcccacaattatttttctgtgaaccaccaacctgacctttaatacgccctcctttatgaagtcttacctgatcctccctagacaaatgttctcgctcctgttctgattctgtcaatgtgagtactgtgacctcctctgcaatacctatgattctctctgttagatatttcagaaatgaaactggaatcattgtaagggaaatgtaccacagaatggacagggttagagttggccttaggaataactggatatgaggatttaaacacgaaatcctgatgcacattctatcacgttcaggaattgaataattactgcttccaagaattttgtgaatatttaaaatatgtggcttagtagaactgttttactatcatgaaagcattttataaaattcatattcagatgacatcttaattcatcaagagtatgtaaaaagatacaattgaactaaatggactaaagatgctatgaaggaaaatagcgtgttgaagaacgatgcacatatgttcgcaaacaagtataaccacaatgcaatgtgataacggttatattagttgcatatataaactaccacaaaagaaacattgaaacgtctgttaattccagctgatagaatcaggataagcattcatgaataaatatttgagatggatcttgaaggttaattggtatccaaagtcagtaggacatgcacaaaatagaaagtagcctgggcacaggtgctatggttggaaaacaaatagtatatacttggaggatgggaacaaacttcttttaaagctaggaaatctgtgggtaactatttagatagttgcagatatgcagaagaattgccactgtaaaaataagaagtaatatttaggaacaaatacacttaaaaacagatgcatcactatttctaaagccctttccgagagaatacagctcagaacccagctgttggttcacaaaattgtctactgatatgccaagataccttggaagtaggctataaacattttgtttacagatatgatatggaaatttttagttttatctctaagactaaaaaatatttataaatgtatgttttccctttttaagaatgacagctttatactctcttcccacttctgtagtttccagtctccataaacatacatttcctttaatggacaattattaatttttattttattttatttattattttgagacggagtttcactcttgttgcctaggctggagtgcaatggcgcaatcttggctcactgcaacctctccctcccaggttcaagcggttctcctgcctcaccctccctagtagctgggattacaggcatgtgccaccacgcccagctaattttgtatttttagtagagacggggtttcttcatgttggtcaggctggtctcagactcccgacctcaggtgatctgcctgcctcagcctcccaaagtgctgggattacaggcgtgagccaccaagcccagccaattaattgttaattaagaaaagaaatgtgacttcaaatatttgctaattaaaatatctttttaaaaaaattctacagttcacactaatgacaataaagtcaatgatcttactcattccagtcacctgagcaccccataaaatttcaaatataggtatgccctacaatggctactattttgcatcagtaacctcaagttacatagatattatgtatcaaaacaaaaaaatccaggtttcttctgtgaaacccacaaatatttcagacaagcagaaatgcaggctgggcatggtggctaatgcctgtaatcccagcactttgcgaggcctaggtgggaggatcgcctgaggtcaggagttcaacaccagactggccaacatggtgaaacaccatctctactaaaaatacaaaaattagccaggcatggtggcgggtgcctgtaatcccagctactagggaggctgaagcaggagaattgcttgaacctgggagggagaggttgcagtaagcaaagatcgcgccattgcactccggcctgggcaacaagactgaaactctgtctcaaataaaaaaaaaaaaaagaaagaaagaaagaaagaaaataaaagaaatgcaacatgatgcagaacaaaaaccattacgtaaacattgtgtcatgcatttcaatattacttcaaaatcatcagtggcccttttagaaaacagagaaagagaaagaggacagcatatttaaaaaaaaaaaagtttgcccatctgagcagatcacaccaattatatttgagcaatagtatattgctcaatatcattactcaatatcattactcaatatcattacaatattgatattgctcaatatcattacttttagtccatcacataacaatacttgtaaacacaatttgtctggactattatttttccttaggaagactcataagaaatcacattgtacacacagttctgagaatttaaaaatatgtattcagcattcattttgttaatttatgtttagttaatgttagtgatgtaaaaattttaacaggtagaaagaaaagcactgaaataaatagataatctcagtattatggacaaaaatgttttcatacaatgagtcattgtattctcttgtctactatttcttataccattaagatagactctttacacaaattataatttgattcaaattccctttaagatcctatatgattatctttgatactgtaacctttttaacttcttagtttctataataatttccattcatctgacttcttgagaaaatttataggagtcagtaaattttgtcaagcattctagcaataaagatttctgagtattgctacttattttactatacaacattaatgagtgctctgaccttccaagaatcaatttgatctgacagattgtaaatttatcaaatacataggaagtaacacctgttttactcgcactttaatttattagcaaagaatcctgaacggagtagaaaatcaagaaatatattatttgaatagaatttatttttcattggtgtaactagtctgtttcttatataacggtactagtaaaacacatccatttaattcatataacaattgatgaaacccaccctacccctggttcttagtgtttgaacttcaacttatttaaatagtcaaaatagctgactttaacataatgagataatagaactgtgagaaagtatttgttataaaacaagtcaacacaaaagcagaacaaactaaaagctttagttactctttagtgtgaaacaacctgaagtcttttagttatcatttataactgaccaataataatcattgcatctttgcagttcaagatgagagttcaaacattggatttccatctaacaaaagtttcattgtatttcttaaatactggatgaatagaatcctgctacttaaaactacctaagtaaataaacccgaagtcaaaaattacttaacctctgtaaaacaaactgagtcgtttcaactgtaaaatggcaatagctaaaatacctgtaacttaccgggctgttgttagggtcaaataaaattatatatgtagaaaggagctgtaaattaataatcaaatattggatatcatttcaatttgtgcaatgtaattatttaatatacatgcagcaccccagtgtttggccattttactcttctaaaatacttactggtatacacaagttgaaagccttcatctgtcccttcagtatcggaattaaattctagccagagttgatttgaagtactactaagtgtcagtccgcgcatagatgcaccagtaaaagcacctagtagatgagtcgttttatcttttccatcataaatctgcaaaatatatttataattaaaatgtaaatgtgccaataataatcaattcagagcatgtatttgtatctatgaaaaagagaaaagtgtactttttctaaatcagatcagtacatttccaaagggcaactaaatatattggtttctatgaacacaaggttaaggaagttagaattcacatgtataattttaaaattccaagcttagtgtactttaagtaatacttgaatcaggtgatatagcttcttttcttattattttaaaaatgctttttctgggagacaatttaaaattaagaatacctacctaaagattggtttctaaagttggttacttggttacttggctgtttctctgcaactttctcaagatcaaacatttacttttccaacaacatgactaacataaaatatatttgtgtctggtgcaattgtaacttttccatgctctttaacttgtttcatatttgacatttttaaaatattaaattaaaggaggtctaaatgcttttagaaactaatttaataaagcaaaaatacacaaaaatgaaactgataagctcccacacatcattctcatttttctgaaagtataactgcttattgcactctaatttgtttttcttttatcattatagacatctcttcaggtcagtaatatagattcttctgtttgagagatgtatggtgactccatcataacttgctctaccgttcccgtattaatgaactcaagtttttgccactacaagtaatgctgatataaacactcttttacgtgtaacctcatgttttttggtacttgtacttcagcaaaaaagttctagaaatatgagatatctagaaatacgggatatgaaatatgggacatgttcatatatttctagatagtttcctaaaaagtgtgtagtaattaaatccagggtttaccaacaatgcatattaccattccttttcctgtaaggcatgcattctcaacataatcattatgacccccaaaggtgtaaaaattggttcttgggagcaataatattttaggtatcacaatgatttgtggtttcccaaagatcaactctccctgacagactttattccatactattttgtttcatggagtttcatgggcttcttaggtgaacaataacaacaagaaaaattggagaatactgcttgaagttactgatctcttagctcagattgccttacttactcatggcctggtattagagtaaaaattatgttgttggattctacatctagggatcttgccatagcataaatgttcctccataattacattgatgtcacctaagagatgatgttttaggtggtacacaatggaatgttttattattattatattaatctgaataatatattttttcttatactagattgttggttttaaaccgatgatttatttagaacgtttcaatatgatctataaataaaaacttgtgaataattaacctttctttcaaagtaactttattagaatttaatgttaaggttatgccaaatttttttccacggctcctaaatgttctcttctaaccacattaacctaaacattttctacacagaaattctaagtctccactgacaaggcctttcttgcacgctccatttgtaattgatggaatctatagactcacgtgtaccctctaggcttctacagtttgtttacttgttctttacagcagagagagaaggtagaaataagagaaagtaaggaattgagaatcttaagttcaaggcgacatggtcattgaattcctaacagcaaacattacttggtctctctctttttatacactctgtcaagtttttaaaaaatgtacattcactcttgagagtatttggatactagagggctgtatacacaaatttcctaatattataagggaatatcttgaatccctggaggaatctaatttatcatgcaaataagtttctgttttagttatcagcaagaatgtatctgtcttcaacaaaaccaaaccaaatgttgaggttggtagctcaggcatgcatgatttttgtttgattacataacattcaacttttcatttcttaagaatagtagtcattgggataatgcagaggtaagaaaaccttgcttgtggcaaaatataacttgtatgtctgtgagtctgaaatgttcaatattctcaaaagtatgcttctgaatacattcattttatgattctatattacatagtaaataaattctttgtttagagctacacattcacaatcaaatcatttaaccactagatccagtggatcttatttgtggtaatattatcaaggtatccccaaataatattttccttgtgttccccttaacttctcaccaacatataatttaattgctatgaaaaatataaatataaataaaatacaatcaattgtttcttggataaaactatttctctatttatgtgtggatacattgtaagaactttcagtttgccaaaaatagtcaaataaagggagaatataaatggaacaagtaattaatgtaactggggaaataaaaattggatgttgaaatttgtttctaatttctttaaaaagtctttcctaatttttaaaaaatcttcaggagtaatgaaaagcaaaaattaatgatagtagaaactattacttgatacatataaatttttcctatatataacaatgtaaaaactaacaaaataagtcaacatttagttatttagttctaagcctttgttaggtgctgtaactaaaattaaaaaaataacatagtaagacatcattcttaacctgaagatcaaaaacaaattaacacaaaattgtctgtatattagattagaagcacacagcatacattttttttccttttgttttcttttttatttattcatttttttgacagggtgtctgttgcccatgctggagtgcaatggtgtgattatgactcactgcagcctcaacatcccccagttcaggtgaccctcccatctcagactcccaagtagcttgcactacaggcacaccccaccaagcctggctaatttttgtattttttatacaaatgggttttgccatgctgcccaggctggccttgaactcctggactaaaactatctccacaccttggcctcccaaagtgctgggattacaggcatgagccactgcaccaggcagcatacatatatatatatatatatatatgaaagaagctttttataagacacattaaaaaaataatcatttaaagaaagggcatgataaaagagctagtactttcaggaaagaaaaattattttaagtacagctgggtgaatataattcagtaacaaaatctgctaactacaatttatttaacactgttgagtcaaaaggtagaaaacaaatactgctgaagctccactataatcatcaaaataaaatgaaactggatcattcaactgttaaattttggaagcatgcataaaattgcttaatcaacatgaaaggcaagtattaattaggaagcccttaaaaagagaagatttttatagtaatgatcaagtcaatgctatttaactcataaataaaatccttcaaatttagtcaaatatatgaaaacataaaggcaacaaagggagaaagcagtgtaaccaaagataaattacttttaaagtggtcatgaatacaagcatacaaataagaaaacaaaacaaacaaaatatgccttttgttcaaaagtaaataaacagtacagagtgattaaattgggtctgactagagccgtaggacttttatttgagactcttagtgctcatatttctgttctaattaaaatcaagacctttaagtatgtttttgtttatttaagcataatatcccctttctttttgtttaatatgtattattattattaagttgacttaaggattaatatcatgaaagttattgatggcttttataatgttaatgaaattctttgctgagactttaatttgttaaaaggttgcaattgtctgattacttacaccagaacaaactaaaacttaacattgccatgttttaattgccaaaactttttgtaataaatctaggcctgaaattagttatggtgtacagactctcctgaatccagtaggttgaaccgtattacaacaaactacttatcaacactcaaaactcttgctgttgtgaatgatatgataaatatataaatagaaggcatattctaactcatttatctaatgaattagcaattaaggtgttaacatcaatccaagagcaaaaagtaaatataaaagtaaaatgtgaagacagaaattacacatgaacatatgtataatcatataaatctccaatttattcctcctcttggatcctagcatttttacttttggtcatttgttttataggttgatttggaaattaaatacattttctaaaaaggtgaattagatgtcaagtttgcatataaaataaagaacaatttttataatggtcaatcaaaaaagtctctattctaaaacttttaatattctctccaaagataatataaaatagagtagagaacttttgtttgcattcaattatttaggtttctaaaacagctacataatgtattctcaattatacgagctagtatgttttagtgaaggagaaggggcacaacgaaggaccaactttacaggggcattcggttttttgttatataatagagttgaacttccaactctacattaaagttctgcagcttattacaaatcattttattttccttatccttaatggaagaggatgaagggttttatgaggcctaacatagcagtctctacaaattggcactttgagagtgcttttgaagggagagttaatacagaattccaatgaacagcaagcagaattggcagatatgtgtgctggacatataagatcaccggtgtgctggaaaatgtttaacaaccaactctcaaacaaacaacaaacaaaaaactgctaaatgtgtatacttgtacataaggtttttaaaataacatttattgcaatacagagatattgacaaactttttctaagaagggttagataataaaatttgaggctttgagaagcataccatttctgtcacaactactcagtcctgacattgtggcacaggagcagccatagacaatatgcaaatgaatggacatggctttctcccaataaaattttacttacaaaaacaagtgtcaggcctaatttggctcacacactgttgttttccaatccctgattttagggaggtgtcgagcaatgtacaaatagtaataaaatatacaatattcatgaccatacatttcatataactaattgatttttacagaatgcttttattgtttttgccagacttttgtgtatgcaatttatgattgcaactgacaaacaagagtatttcctaaataaatactgcttgatcatctttaatgttaacaaataaaaggaaagtgaaaaatcaaaaacaggattatgtcagaacttcattagtttgtaaatgatatgagcaactaatttggttaattaaataatagttttcaaatactgaaaaaaatatttcttcaatatatagtgctactcataatgtaatgggcacagacacaacccatttccacttaaatctatgtaataagcaaacaacaagttaagccatgttttgtagcatttgccaatttctacagtgtaaatactcccattggctgacatcaagctatcattgaatgtgaatgtgatgtcattgaatgtggagttggttagagaccacagtgtggcatggtatttctaccatagggatacaatatacataaataacctcaaaagcacagataatagtaaaagtattccaataattagaaaattttaaaaattatatgtattgctcttgtttttaatataatttaagttaatttaattgtagtttaattacaatctaattgtaatataacttaatttttggcactggctatgttcaacaatcagctctcaaaattactgaaaatttaacaatagcctgtcataagtgctattcccaaagactcacacatagataggaaagaaacttgaaaataatacactttagaaaacaacaggttaataactttatcatgtctctacaagaatgttattaatcaagtcctttgagtatctaatttttcataaatgtgacatcattcctcctaaccttttctttcccagtttcaaaagcaattttgcgttactttactggcttttctccataatcatccatagtctacattttgcataagaaataaatctttagactacacaattgtaaccgtggtaaaaagattgccttgaattttggaatagaataaattcttttccaaagaataaaggaatgccctgctacattcctttattctgaacattgtccttagtttttatttgaaaataacaacaaacacagcaacaatgaaaacagaaaatagtatttctcattggtattcaattttcattctaccaggctgacaatgggagctatttgatgttaattgcacagagcctacatataataaacccctcttatgaatgttaattgaaagaattaattagattacatatttacaagtaagggtgagggaagaagttcagtatttctgcaatatcctatgccactttgaaaaaaataaaacaatcagaccccaaacaaactagagaaacattccctagatgagttaagcggagaacaaattagttaggttctgatttaggtttcttagacaggaccttgcatcttaccctttttgtaggaggaataatagaatgccaataattagacaatagagggaacatgtacctggctttctatctggagcccagaaaggtggcaaacatgcttgcagaaaagaggtaggaaaaaaaaaaaaaaagatactgggggttggtcaggcaattgatcctgagccagccacatggaattctggtgtaactcagtgtcatatacagagtaattgaaaaatgcttcttatgagcagagcagaatatactacagagagctggtagatgcaaagaggttttgcagttgggataactaggatccagcagtggatgcccaattgtactgctgacttcagaccaagtagcaaatgagagagctcagcagctgttgccacaaacagataatgccctaggacaaaatgcactttttatttttgacaacttgaagtcttgatgccaaaatatgtgcagacgttgaattggcaaatacagaattgactgagtttatcctgaattgacctagattaattttcccactgcccagcaaaaaggttgttgaaaataaaaattaggtcatttatacaaaaatcttttgctacatttcttgcaaattttgatccagactctgaaatgtattcctattacatgaatattcactgaatatttttgcaggggcaggcattgtgctgagtgctttataaacatcatttaatttaaaaacattatctaatttagtcattacagcaatcctgaatttaagtttttattattatcagaatgtttcaggggaggaaggtgagatttagaaatctggagtaattttttcaataattgtgtgactattaagtgacaggtttgagatttgaacctaggtttacctgtccctaaagcccattcttaatgacaaaataggtgtgtagaaaaataatccaaagcacaatatgttttcaaaggttagaataaatttgtgtaatgttgattgagtgggcatgtttatctaataatatatcaccaaatataaccctaaattttattagctatatttggacaaaataacatggcaatgggggaaatatttaaaagtaactatgttttataaaaatatattcacttttattagattagaaacaataacaattgaacttaattagaaaggaaatatgtttctcttgctttacatagaaagtagctgaaattatatagtaaatttgtcctttctagaagaaaagaatgtttatggagcatttactatacgacaagcattgttcctagatgctggagttaaagtggagttaaatagttcctgctgtcttatagcatgcgttctattggagaagacaaaaattaaaggaattaactatgaatgcataatatttcaggttgtagatcagtgctatgaagaagaataaatcagattaataatggaaagagatgatggaggtgagtttaccagtttataggagggcccattgaagactctgatcatatgacatttgagtagagacctgaaggaaatgagggacacagccatgtggttatcctgaggaagaatatgtaagcagaagaaatagcctgagcaaacggcttggtgttagagcatgtgatatggtttgaatgtttgtgccttccaaatctcatgtcggaatgtgattccactgttggaattggggcctggtggaatgtgatggcatcatgggggcagaaccttcgtgaatggtttagcaccatcccattgatataagtgattctctctcagttagttcacgtgagatctgctggattaaaagcgtggaacctgttgtccctttgctctcttgctccctttctcaccacgtaaaacaccagcttctcccttcaccttctgccacaattgtgagcttcctgaggtcctcaccagaagtccagctgatgttggtgccatgtttgtagagcctgcagaactgtgagcccatttaacctcttttccttatatattatacagcttcaggtatttctttatagcaatgtaaaaaaaaaagagggaggcctaatatagcatgcttggtatatttgagatactgcagggaggccattatgcctggagtggagtgagctaaaggaagagtggcaggagaaaatgtcaggcacagtaaaattacgccaaatcatagggctatctaagccatggttagggctttagattttacttataatgagatgaggaacaaaaaaaggtttagagccaaagcataacatgaaaaagggtcacttttgttgttgatttggaaacagtctatagagtatgctatggtctcaatatttgtgtccccccaaatttgtatgttaaaatcctaaccctcaaggtgatggtattaggaagtgaggcctttgggaggctaactggtcatgagggcagagttcgtaaatggaataagtgcccttgtaaaagatacctcaaaaaacttattcatccctttcaccatggagttcacaatatgaaaatgactctttgaggaaggtggccatcatcagacataatctgctagtgccttagtcttgaacttaccagccttcagaacttcaaaaaataaatttatgtcgtttataaaccacctggtctatgttattctgttataacagctcacatgatctaagatggtggaaatagggtgatcagttagaaacaatgtcagttatccaagcaagagataataatttagaccaaggtaatttacaaaggtgagaaatgattggttccggaagtgtgaagaaaagaaccatagaatttgctgaggaataatatacaaagtgtgaaagaaacaaggaagcaagaatgaactctacttcgtccttgagtaactagtttctatctactgaaatagagaaaaatgaggagagaggagatgtgtgttttggactggtgaactttgaaatacacattagtcattcaagtggaaatagttgagagatcatttagatagaaactggatcttatcacaggtcagagcagattttgcactggttgtgctgttctgtcaatgtactttaaggcatatatgtttcaaagttttttttaatgtgaacattaaaggattttttataaacaaaatatagttcatatatctttttatattccttaaagctgcagtgtcaagtgaaatccaaacctacctgtggtgtgtcattaaaattttccaaaaataagtaagtagcacacaagaaaattgtcacttaacccacttactattcctatatgtaaacattaatagcagaaggcatctaaagtgtgagtttcctatacattaatggatagaagggtatatatttgttctatcaccattataaaaacacataatcagccaaggttggtcatagtgaacaggttaaaatacccattaagtaagcaaattgaaaagaaaagatacattcctaaatgatcattttgtaccagttttgttcaattcagaatggatgcagtgaaatttcctttccactttaagtaagaatcacacgggaatttttatttcatttattattactattattattattgctttttcatggctagaaaatgttctgtttgcctaaataggattttctcagatgttattaaaattatttatccacctttgacaaatgacacaaatgaacaaaaatgttttacaaaaaaaaagtttcaatctggtataaagttaatgactcaaaattatctagtaatattgagatcaatttttattatttagagtaacagtgtgctaccttggaagcactacagtaaaatattttgatgtataaactttcttcattttaacactagagccaaagaaggatataatcataattactacattgatggtcatcagataatctggagagctttataaaaatccaaattcccacatgtagaggaactgaatcagaaaacctgggaggcgtgccagtaatcaaaacttaaaaaaaatctagaggagtcatatgatggcttacacttggaactcactggtgtaaactctactggtatggttttaaataaagttgtttatagaaagaaaggaggagagaagaaaaaagacagcagataagtgagcaagtgagtgccatcctggacactgaactctgagataaaagttgtacacgaatgtttgcatggaaatagatgtagatacacacatatattattgttgttattgttatttttgttttggtcagaatccaatatagttatgtcatacagtaaacgaaaccagaaaaaaatctctcctcctaaacttgattctcatataaggattacaagacagtgtcattccaaaaaatataatcaatgctaccacataaaagaaaaagcaatgattttaaattctctcagtcaaggggcagcagattttataatgggctatttgtttttattccttattatatgctagtttaaatatagggatctaactgactccactatgttcgatattgtaaagtactggagatggggattaactttcatggattagttttcagttaggcaaataactttccaccctaagatgactttaggctctacaatttttgagaattaatcatatgtctttttgagggttcatctttctgcttgtatataactaaatgtttccatgtcaaagggtatctttcagctaatggtttctcgttggattaatgggaagaatgaggtaacattaagcatcttacctcttattctggcagagagaccatgaagaagacaaataaggaatctaaaagttcaccctaaattgtctctatagagtggcttgctgaaattgttttaaagtaataattcagaataaatctcaggcaagcctatgaatagaaggataattgaattggtgtgtttctattataatatttagtatataatattttcaactttggggaaaatatattcttggaaaattacagaattcttaaaagttcttgaggacataaattttttaactttttaaacatataagagaaatctgtatttgaagaaatcatttaaagggccttacattgagtctttttttttttctgccttcttttgttgttccctattacatccccttgtgttgtcacttatgactgaagctccacccttctcaaggtagcacatatcagaaatgcatgtggctttactccaaataagtaagaccttttagaaagttttattttattactgaaaagaatcatttgttatcccaaataaattacccaaataataccagtataggaaagaaatgaatgaattttaagcatcacaaagaaatattttaggtagaacaataataggcatgagtgaagatgtgaagaaacatttcctgaattttagctcaccaatgcatgtttattattgttgcttctgcattacagagtagtagctagattagcttacagatcttatctatgcattgatacattttccccccataatttgcttgaaaataaaaagcactgcctcagttctatatacaagcatcctattaatctcaatgttggctccaattgaaaaaacataacttactttaacagaaacacccaaacaatgaactagaggtgggagagttttacatagtgaattttgttgccagttggagaaaaatgcagaaaataagaatgcatatattgatcctagattaatgttgaaattgtatacatctagatacattgtgagaaattttccccaaagcctatacaaatcttataagcatatcatgttattgtgttagagagccatcaattaccatgaaataatatttttttaaaaagaaactaaccaataacattaaaatcaatcattaaaaaagaattctcctgctgcagccaatttggaataacataattttttttcaagatttgtgaaaacagaagtataatgaatttttcacctggctttagaaaaacttaacaattagaaaaaagctacataactattttaaaaacatttaaatgtgatttttggaagtgtttacttttactctaatgataaatataaactatatttaccaaaatatttatattcaaaatataaatcagcaactatgaaaatatttatttgccaaaatgttatctttttagaaaagtagatatttgattatttcaaagtgtttaaataaataatgtttacaccgatagtcattatcaacaaagtatattttttcttaattgatagacattgacttgttaggtttatatattcataaaatgtatccatagtcataaatgcaaaagattcttcacgtattaacaaaaataaataagttacattatagacaatagaatacaaatagaaacaagtcactattatatttcttaaagaaatgactatcacattacatgacggtcatttgatgatgttttatatataataatttattagacaagatatttgacattaaagttttcttattttggtattattaagacattaaaatttatgtatcataaaacaaaaatttaccttttattataaaaaaattggaaacaaaacatactatttcaatgaaaacaataatagaaaatgagaattaatgtataatttgaatgtgtgaatggtagaatcaacttacggttaatactatatacatacacatatatatatagatgtatatatttatctattgatgtatatttaatgactaaaaatgaacaatatacaagtatgtctgagttcacctaccttaagaacatctccttgtgctaaatgaaatgttctggctgaaatattgattccctttcctgcttgaacctgaatactataaatgcattcatggttgttttcatagttgagtggataatttggagacagcaaaattccttcattattcgttgcagatgcaccacattcagctgcaggtaaaacagaatattgaagtacagtttaatagatagcagtatcattttcaagcaatatcatgtatggaagtgttatgcattttattttacctaaagcctagtagaaaaataatatacagaatggctttatgttgtaaatgattaattccctcctcaaataacatatgggtggaagagactacagcccatggagaggacactgtgtacaaatgaaaatatacaatagttgtagtaattttccccctggattaaaggatagcataggaaagggtgagagcatgaacttaagaatgtattttacatttgtgatttctgataaatgtaatacatttaaatttataatttagctcttttaaatgaaagggttttgaataattctaacttcatcttttaaaacatttttacctttttaattaatttgacccttcttttttctcctaatactcagtattccgctgacacaagaatttcaataataaaaagggaatcaaatattacattatctttgaaaactgatataatagttaaacccccctggtaataacaattaaacaataattgtaacaaattagggatctttagaaattatatcacctttctcagtatagaaaattagactagattaaggcattcttataatagataaaatggtactgctaaaccttcaggactaattttgcaaaatttgaggaactgtctaaacatttaggaaaatgtgagaatttctcaacaaatttagttcgaacttaattttaatgtatttaaatataaaaagcttgtggcaatattgcaaaagaaaacaataagtccttcaaattcttaaatatgtttcagaaattcaataaactaagttttctatcttatctaataaattacttcatattaccaaaccatagggcagaaatatttacattttcaaatatttaactgaaaaggaaaaaaaaaacaagttgttattttctagaaataagattttaaaaataatgatttatgggaacagtcagagaaagacaacaaggtgaataatgaattgctttaccttttaaatgcttaaacattaacaaaaataaggcaaaggaaacaaaagcctaatgaaataaaaatgatcaaaaagaagcactcagtataatatcaacattgtgtgaaataataataaaaactaatgttatggtactaatagccagtattacacaataaaagttacccctaaattccttttaaagaaaaaaaaaaatcaaagttccaatattgatttaaattactttattttaatgttacttaagcatgttcaaaaaatagatatgtccttatgcttttagctgcgtacaattataataccaaaaccagtttacaaatacaggaacaaaatgacaaaaacaataaaataaaaaatagcaacatgtatctaataaggcataagattttgttttcctaaaattaaatcgcctttggcaatgtggatcaggtaacagctgctccagtgtaggcttttgaagtttgttatacctttaattactctatgctgtgtaacaacttgattctcattcatactatgcctctgtgaactgctgagaaactttcatccatatagtgcaacataatgccaggcgtccatcacttagtggaaatcatttacattttaattctcctttatttttttctactaggtttttggaatacaggtatgtttgtggaggcatgaagacaaatgtaatctggattacacaggtgatctaaaatgcacatatatttttgtcaattagattatttagaagagaatgcaaattattttgaattattttacagagacatgaagttttgaaaatacaaatggttttagttcttctctgtaataaactgacacaatatttttcaattgcacgtctaatcttgcactttctggttaaaatacactgatgatcagcaagtcaaaatccagagaatgtcatacaaggccatttacaatgcgatcccagtgtgcctgtccagctattacctacccttctctgccatggaccttgcaatttagctgccctgagctactactggcccttggccacagtctcacaatctgagcctttgaatgtgctattttctccgcatatgaacaccacctctggtcccaagagatgtgaataaagaaaattaccacccataaggaaaattacttgatatgaaattaaattattatggttcttttcagtatccggtggctgtgatggtatattaaattgaaaaaagcaacaacccattaaaatattacggataattctcacgaataatagtcatggttccatgcttatgaatgcccagcaaaaatatcataacttcaagattttcattatatataacatgattagcacagcaagttttcataaagcttatttaaactgagaagataagtgttggcaaactgtgactgaatattcttaagatatgttaaaattgagaaaaggaactagcagcagaacagctaaccacaagagagaagcatggttagttgatacaaggaagacaagggcatatatgaaaacgtcaactacatgagaaaggagtttgagtaaagcaagtcctaacgatccaaccggtaaaggcgagttgaaaaagttatctgtcagccatagtgacatttatggagagtataccgctatcactgaacagtaacaaatgtatgactcagaagattatgtcaatgttaaggttttcagtcaggtgctataaggaatagcatatgtaaaataaaacatgcatgtgaaaaatatgttacaataaaaaagctacaaggtcactgtaatacaaacaatttatttgcttggttgagaatgtactgtaagatatttgaagtggctagaggcaaatgatagaatgctctgatttggaaaaaataaatttataggttgattccatagataattatgaaatatttattatgtactgggtggtgaggggaatagttgaagctcctatgggacctactttccagtggaaaggatggatgtctatcatacaatcactcaaataaaaatatagtatgtgaaagcatataactgagagccctgacctgtcctgaatagccaggaaagactctctgaagtactgcaacttgaaaatggatgagtaaattaaaggtgaagggagaagacaagtggggtaaaagaatattccaaacagaaggaacattatatctaaaaacattattggagggggtgggagacaaaggagataatgacaggttctaggaactgaaagacctgatatgaaaaagctttctttgtgcaaggttgatctagaggtagatctccgaggatgtttatctggtgtgatagcagaagaaatgttctttcttaggtgtgtatgaatggagaagtcattaggtgtgagctgcttgttcttgtgatggggaaatacttttgtctttaaggcttggaatgttggttgcagaatttgaagaggaaaagaggagactgaatgaggtacatttataaaattttttgagattttgggtcagaaaaccactgcttcagggtttaggggttgcaatgttttctggaggtgaggtaagcacacttcttcctaccttaacataagcccaggatcttgtttctctcatgtcttgatccagagtgagttttaagttcttgataactgatgctactaactgataaagcctatgtttgataataaggatttcctacaaaataataaatgtaaagctattaataggtagtaatgtttcctctctctaatttgaactagggggtggtgtcatctttaaatcataaaaattaataatatgaaaacattacataatttagcagtgttaggaaaatgtttggagaataagtacttagtgctctttttagcatataaatattttctgtgcaatttccagtgtacacattgtatatgatgacttttctgaaaaacaagtcctattcatataaaatatttttttatttaaatgtacagattaagatatctattcgagttaccaatatgaaactctttgctgaatatgaaaataatatgatgataaatgtggctttagttggattgaagtgggaaagaaatgtgtactgaaatttgatgataagagtcactgatacagtgaagaattcactagagcagggatacccaaaaacagacaagacatgcatcattaatctccattactgggataagaaaatctggtagcatctattgtacacatacagtcatatagttttagataaactgaaaaaatgcttttcagcaatttgactggatatctgaaaaatgtctagatcagtaaacttcatagttacttttttaaaaatgtgcattacaactgagtctttttatttttaaactgttttgtgaaagcaggcaaaatatacttgatttagattgttcaaaaaacttagaatgtttttaaacataaacatatggtatgcaagtcaaataaggagtagcattaagcagaaatatatttttccatatgtttaattattaccagaagaaaaataataatacatgattttgctcatagaggatcataggaggatcaaatccaaatcaatcatttcttttctgcatgtgaattcagattttttttcatttttatcagctattttagcccattatgttccaaatataatttagatttcatttcattaagttaggacaccattgattataaaaggcatctttatgtgtccctaaaaaagcaaaaatgttgccaatacactataatagtcattgattgtgagatacacacatatttcacagctgttagttttttaaaatggggcatctaaaaattgtgaaatatggtaaaatgtgttaataagattaatttgtgtgtgttttttttagcacttctcctaagatgccttctcaacttggcagtattaataacactttgttcttcagaaatttttagtcaaaaatattttattttcttaaataggcatttcaataatacttggattttcagaagtgggtagaaattgtagggtagaaagatacattaatttccttatgcccctactgagaatatgagaatccattggtattacttgcatacagtcttattttttctttcttttgttcttcttaggcaataatagtacttaactggctttctccttttagcctctctaaatacaatacatgtatgtatccaagggcaaactagtgctactgaaagttattttaaaaaaagagtttaaacattttttgaagaatttcaaaaaagtttcatagctactttttccccttaaacatttgtttttaatgcattttctataatcattttttaccatacagaattagggtaatctttattaccatgtggaattatatttttgtgtgtgaattgcagtcataattgaaacgcttaaattcaaaactttttaaaatcaattatatcattttctgtcaaaaatattgactatttcccataatctgacattgtcttttcattttttcttctttccatgaacagctactgaaggtctactgtgctcagttatttattaaaaataatgttcttaataaaaataactatggatatgcctgataccgtattaggtcttggggataggtcctcttcctcatgtgatatgtactccaaaaaagaggcagacatggaaactggtacatgcactaacatgtagtctctagtatgatacaagttcatgtaataggctgagatggcacaaatgaagaagtagtatattttaaagaagccacaagagaattacattaaggcagacttcatgactgtgtttttcttgatttgagaaagaaatgtggttccaaacgtaatcaaattgtacaaagaagggattccaggcagagtgaaatacttgaatgaaagtataaataggtaaaccaaattgatactagttagaagaaccagtgattcatacgccattctaagacatttgaactttatcttgtaggcaatggagattcatagaagagttttaaaaagagaaaaacatgaccaactttgagaaatccattagggcagctctatgaggaatgaattgtagtcttgggttactagaggatgaaaaccctagagaagattgttgtagtgctacagacagaagatgagagcttcaactaaagcaatggaggaagaggagatgccaaagtaaaagttagaacttggagacaagttcgatgtgggggcatgaaagagaggaaaaggtagagaagacaatgagtggctttgattataatgctgatgaatgtatttttgcacaagataaatttggtatgcctgttggacgtcaagtaaagtactccaagcagctagacatatttgtacccatgagattgatcttttaaagccacagacaaaaaggtttatccagagaatacacacatatatatgtacacatattgagaagagaagcaaaataagaccaaggtacactcagcaagagaatttaacaggtagacaaaagggacattcaaagaaggtagtatcatggaatagtaaagagaagatagttttaagaaaataattgtcatcagtgttaaatcagagttcaattaaaatgaatactgagagtacattgatttgggcaattaagagtttgggaagaaaggaactataatattgtctgtaaagggtcaggggtgatacaggtttgaaggaagggtctttttgttttttgatgtttttgtctttggttttgttttgttttttggttagttttgaattaaaaacatttcagtacatttatattttaagtgaaaggaatagtacaggggaggagccaagatggccgaataggaacagctccggtctacagctcccagtgtgagcgacgcagaacacgggtgatttctgcatttccatctgaggtaccgggttcatctcactagggagtgccagacagtgggcacaggtcagtgggtgcacgcaccgtgtgcgagccgaagcagggcgaggcattgcctcacttgggaagcccaaggggtcagggagttccctttccgagtcaaagaaaggggcgatggacgcacctggaaaatcgggtcactcccactcgaatattgcgcttttcggaccggcttaaaaaacggcgcaccacgagattatatcccgcacccggctcggagggtcctacgcccacagagtctcgctgattgctagcacagcagtctgagatcaaactgcaaggcggcagccaggctgggggaggggcgcccgccattgcccaggcttgcttaggtaaacaaagcagcctggaagctcgaactgggtgtagcccaccacagctcaaggaggcctgcctgcctctgtaggctccacctctgggggcagggcacaaacaaaaagacagcagtaacctctgcagacttaaatgtccccgtctgacagctttgaagagagtagtggttctcccagcacgcagctggagatctgagaacgggcagactgcctcctcaagtgggtccctaacccctgaccccccgagcagcctaactgggaggcaccccccagtaggggcacactgacacctcacacggcagggtactccaacagacctgcagctgagggtcctgtctgttagaaagaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaatggaacaaagctgaatggagaatgactttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagtcgatgcgatcaactggaagaaagggtatcagcaatggaagatgaaacgaatgaaatgaagcgagaagggaagtttagagaaaaaagaataacaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccataaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagacaagaattttcaacccagaatttcatatccagccaaactaagcttcataagtgaaggagaaataaaatactttacagacaagcaaatgctgaccgattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcaatgtgctgtattcaggaaacccatctcacgtgcagagacacacataggctcaaaataaaaggatggaggaagatctaccaagcaattggaaaacaaaaaaaggcaggggttgcaatcctagtctctgataaaacagactttaaaccaacaaagatcaaaagagacaaagaaggccattacataatggtaaagggatcagttcaacaagaagagctaactatccaaaatatatatgcacccaatacaggagcacccagattcataaagcaagtcctgagtgacctacaaagagacttagactcccacacattaataatgggagactttaacaccccactgtcaacattagacagatcaacgagacagaaagttaactaagatacccaggaattgaactcagctctgcaccaagcggacctaatagacatctacagaactctccaccccaaatcaacagaatacacatttttttcagcaccacaccacacctattccaaaattgaccacatacttggaagtaaagctctcctcagcaaatgtaaaagaaaagagattataacaaactatctctcagaccacagtgcaatcaaactagaactcaggattaagaatctcactcaaaaccgctcaactagatggaaactgaacaacctgctcctgaatgactactggatacataatgaaatgaaggcagaaataaagatgttctttgaaaccaacgagaacaaagacacaatataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaagcaagaaataactaaaatcagagcacaactgaaggaaatagagacacaaaaaagtcttcaaaaaattaatgaatccaggagctggttttttgaaaggatcaacaaaattgatagaccgctagcaagactaataaagaagaaaagagagaagagtcaaatagacacaataaaaaatgataaaggggatatcaccaccaatcccacagaaatacaaactaccatcagagaatactacaaacacctctatgcaaataaactagaaaatctagaagaaatggataaattcctcaacatatacaccctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaaccgaatccagtagcacatcgaaaagcttatccaccatgatcaagtgggcttcatccctgggatgcaaggctggttcaatatacgcaaatcaataagtgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgtcctctctcaccactcctattcaacatagtgttggaagttctggccagggcaattaggcaggagaaggaaataaagggtattcaattaggaaaacaggaagtcaaattgtccctgtttgcagatgacatgattgtatatctagaaaaccccattgtctcagcccaaaatctccttaagctgataagcaacttcagcaaagtctcaggatacaaaaacaatgtacaaaaatcacaagcattcttatacaccaacaacagacaaacagagagccaaatcatgagtgaactcccattcacaattgcttcaaagagaataaaatacctaggaatccaacttacaagggatgggaaggacctcttcaaggagaactacaaaccacttctcgaagaaataaaagaggatacaaacaaatggaagaacattccatgctcatggataggaagaatcaatattgtgaaaatggccatactgcccaaggtaatttacagattcaatgccatccccataaagctaccaatgactttcttcacagaattggaaaaaactactttaaagttcatatggaaccaaaaaagagcccacatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagaaatggggaaaggattccctatttaataaatggtgctgggaaaactggctagccatatgtagaaagctgaaataggatcccctccttacaccttatacaaaaatcaattcaagatggattaaagacttaaacgttagacctaaaaccataaaaaccctagaagaaaacctaggcagtaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttaaaagaaaaaaaaaacaaccccatcaaaaagtgggcgaaggacatgaacagacacttctcaaaagaagacatttatgcagccaaaaaacacatgaaaaaatgctcatcaccactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatacacacaaaggactataaatcatgctgctataaagacacatgcacacgtatgtttattgcggcattattcacaatagcaaagacttggaaccaacccaaatgtccaacagtgataaactggattaagaaaatgtggcacatatacaccatggaatactatgcagccataaaaaatgatgagttcatgtcctttgtagggacatggatgaaattggaaatcatcattctcagtaaactatcgcaagaagaaaaaaccaaacaccgtatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacacatgtaactaacctgcacaatgtgcacatgtaccctaaaacttaaagtatatatataaaaaaaaggaatagtacagaggtggagggtgactggggttttaaaatgctatctctgagtcagaacacccaaaaatcgaataacttaaaactaggctaagaagtcacttgaaaaaaatctatgtgatttttaaatataataactcaagacatggatttaaattccatgtacactataattactactatagaacacgatatatataataaaaaatgctaccaaaaatgacaagaaattctacagtagttttcaaataaatggctctttatttaaaattcactgaaaaaatatgaacattgtgctcaaaatagattgctttgttttcattattttttgaatactgcatattgggccaagagtattattgatttataacgacaagacctttagagagtagacctttgactacctcatttaacgcaaccgataagaatggtattataataaatatggctatgtcaaaaatgtttctatataaatattccttcctccttaaaatacattttatacatttttgtgatgcaaagagaaggcaatcctttatgcaacagttttgttttcatgtcttttagtcaaacggtcaaaccaaattgtagtgttaagtatcctgagagtaaggaaacatgtcataatatttcttatatctcatgatttttttttcttttcttttctttttttttgagacggagtctccctctgtcacccatgctggagtgcgatctcggctcactgcaagctccacctcccaagttcacgccattctcctgcctcagcctgctgagtagctgggactacaggcgcccgccactacgcccagctaattttatgtatttttagtagagacggggtttcaccgtgttagccaggatggtctcgatctcgtgatccatcctccttggcctcccaaagtgctgagattacaggcgtgagccaccgcgcccggtccccacgatccttatatacttctctagaccctgtgaaaacccaataaatactgctaattcaataacaaggaggtaggaatactaagaaaaagagagattcattattcttggaagtgtgagaagcagtaattgctgaaaacaagaacaaaatatacttcttttatctaatagatattttatctagtatagattttttaatctaatagattaatttctctgcatactatatgcacaccttatctgaaggtgatatgagcaatagcaatagctagtagtagttgtgaagtgcttactattctaattctttaaatgcacttcccggtgaagtaaccctgtgttttggaggataaatttaaaaatgtgagtggtggaataaggtgcccaagatcacataatgggtgaactttaagcacagatagttctgtctccaggcccaagacactcaaccccttcatgatatttccactcagaggcgaataagatacaaacatacaatcaaggaacttcactttctcaaggactataggaatttctataaattactatactacaaagcaaaaggtgcaagaaagtaagagataatctgcacaggtttaaggagatagatattgcttctgatgaaaaagtcagagaatgcttcatcaagaaggtagcattttggttgcactttgaagaattcaaagtgggattgtgattggctgagaaaagaaaagacagattcaggggaaagaaggcaattcaatttaaacatattaattttcctggtattggggaaaaagggaaaggcaggagtaacttttagttttacttagttcaattaatatttttatatagtgtcccttctaatttcataactgccttggcaccatggaaatatgctctctacgatgagttaattaaatacttaaaattatacttaatcctaaaccataggtattagggatgttaaaaacaatttttctatttatagattgaaatacaagtttcaggttaagcataacgttaataaagttctctagcagggcagaggaaaaagagaagccgatgggagcagatagcttcctgtgcattttcttctattactttagagtggtcactgtctaacaatttttaatgaaatgataaggaagcaaataagccaaacattcttaaatattaggatgatttttatgttattgggagacccccaatatctaattcaatgatccaatgttatagcaaacaaaacttttaaaagatttttttcagcacatttaaagaaaagtttataacataatcagcacttgaacaaataaagggttaggggattgactctctatgcatttgaaaatttgtcgcctgtaaccccagcactttggcagggcaaggagggtggaccacctgaggtcaggagtccgagaccagcctggccagcatagtgaaaccctgtctctactaaaaacacaaaaattagctgggtgtggtggcgggtgcctgtaatcccagctattcaggaggctgaggcaggagagtcatttaaacccaggaggcggaggttgccgtgagccaagatagtgccattgcactccagcctgggcaacaagagcaaaactctgtctcaaaaaaaaaaaaaaaaagaaagaaaagaaaattagtgtctaacttttgacttccccaaaacttaactcctaatagcctattgttagcccacagcatcaccgataacatagtcaattaatatatatttagtatggtatatgtattatatactatattcttacaataaagtaagctagagcaaaaatgttattaagaaaataataaaaaatatatatttatagtactgtatttattgatactgtaagtttatgttattggcttccaagatgaatcaaatgtctgaaatggtaggcaatcacagctgcagacatcagtctatggtacatatcaagcaattcacatttttgggtagtggggtggggagagagacaaagtcttgctctgtcatacaggctggagtgcagtggcactctctttgctcatgcctcagcctcccaagtagctgggactacaggagcatgccaccatggcaggctaatttttgtatttttagtagtaaagggcttttaccatgttggccaggctggtctcgaactcctggcctcaggtgatacacccacctcgccctctcaaagtgtcgggattgcaggcgtaagccactgcatctggcccaattcacattttttcttgtaatgtagtgacatttttctgcttcttggaagtacttccagcattgctagtgtcacttcattcccatggcattattcagtttattgtattgcattaaacaacaaaaaatatctgagaaattacacaaatcaaattttactgcactatgcagtttactggagagacaaattgctgatgtggagatgactgatgctacatggtactttaagcaatacttgcaacacttgggctcaccataatagcaaaaagaagtggctaagaaattattactctagtacagtatgtactgtagttaattttgtgcagttgtgattttatatggcatctttatatttatttacattcctctccactgcaaattgtgccatgtatggtctgtaagtgtttgtgtgggtaagtttgaaaaaatgttaattttttataatagatttgtggacattttatggtagtaaatgataaaatagactgatgtatacatatattttatgcattcatgacatatctaagtttttctctttttttatgttacatggttcatctgtgagttctttcaaattgtcacaaatctccaaaaagttttctaatatatttatccaaaaaaattgcatattagtgaacctaaatagttcaaacttgtattgttcaagtgtcaactgcatgatgaatgtgtaaggaatatattaggtaagttaaggcactggtaacaaacaaaaatcaaataaaaccaggtaagaagttaatttatgagaaataaaatcttcattatgtaaatctagtcacttaaactgaatattgattcagattttattgaataaataatattaattttttttcaatttaagatcatcatccattcccacttatgctctccaaaactaacattgtttaacatttttcaaactgcaatttgcaaactttcagttaaatgaacattttttcagttggaaggtagaggggcaagggagatttttactgcattactcatagtaaatattcaaaaagttcagaagaccttaagaactgtttgcagtagagtttgaagccaggtagtgtgatgcctccagctttgttctttttgcttaggatgtcattggctatttgggctttttatttttgcatcaatatgaatttttagagtagtttttttctaattatgtgaaaaatgtcattgatagtttgataggaatagccacagatcaatacaatgaaaacagcgtggtactgatataaaaatagaaatacagaccaatagagtaggttagagaacccagaaatgaaaccatacacctacaacgatctgatctttgacaaagccaacaaaaacaagcataagggaaaggattctctatgcaataaataggtagtgttgagatgactggctaggcatatggagaagattgaaactttactctttcccctttcatcatatacaaaaaccaactcgggatggattaaagccttaaatgtaaaacctaaagctataaaagttctgaaagaaaacctaagacatgccaatacctagctcctggcaaaggtttcataatgaagatgccaaaagcaatagcaagaaatacaaaaattaacaaagaggacctaattgaactaaagagcttttgcacagcaaaagaaagtattaactgagtaaacagacaaccgacagaatatgagaaaatattcacaaaccatgaatctgacaaaggtctaatatccagaatctctaagaaccttgttagcaagcaaaaaaacagacaaccttattaaaatatgggcaaaggacatgaacagacacttctcaaaagaagacataaatgtggccaataagcatataaaaaatgttcaacttcatgactcattagagaaatacaaatcaaaaccacaatgagatatcatctgacaccagccagaatagctattaataaaagtcaaaaaataatggatgctggtgatgctttaaagaaaagggaatgcttatacattgctggtgggtatgtaagttagttcagtcattttggaaagcagtttggatatttctcaaagaagttaaaatagaaccattatttgagccagaaagcccattactgagtatttactcaaagaaatataaattgttctaccataaagtcacatgcatacatatgttcattgcactattcaaaatagtaaagacatggaatcaacctagatgcccatcaatagtggactgcacaaagaaaatgtgatacatatacactatggaatactacatagtcataaaaaggaatgaactcatgttctctgcaacaacatggaaagacctggagaccattatcctaagcaaattaatgcaggaacagaaagccaaataccacatgttctcacttacaagtgggagctaaacactgagtacacatggaaacaaagaagggaacaataaacacaaagtgaagggtgggagggcagagggtgggagtagggcaaggatgaaaaaaaaaaactacctattaggtactatgctcgttacctggaaacaaaataatctgtacaccaaacagccatgacatgcaatttactcatgtaacaaacctgcacatgtaccccctgaacctaaaataaaacttggaaaaaatacctgttttcacggctcattttacacaaatgtaatcttaattaatttatattatgtttaattgtgattaatttatcacaaagaatttctagcataatctgtcaatcctgcccttcattctaataagtttaggcctttaaagcagagatatggctctgtaccttacacttaaagcaacactagctaattagatgcacaggatggtgaaacaggagcttctatcatcatcctctgaagcagcctcaacttaaacaagtatctacaaacaaaagtacctttgtggaaatctggaagtccagtgaagaagttccagcagactgtggcatcataaaatccaaaaactgacttatcaaaggaagaacagtatcaggttacctatgtcgcctgtaccccagggtggcacaggttgatgccaagagaagcccctacagcccatgatttctcctacatggaaagtaaaggcatagtgactgagtgcctgacacctccagcatgcagaacactgcctaatagactcacttctatcttgcttcacctagaatcctgaagtggttgacactgctcagtaactgggagaggctggaaagagagaagggaggctgcagaagctactaatagctccactgactccatcagagacgctaccatgagatgtatgggatgctttgcctccagaaccccagatcatccaggcagataatcaacaaagaaacactgtacttgaactaccctatagaccaaataaacctaacagatagagcatttcacccatcagcagcagagtacacattattcttaaatgaacatggaatattcttcaggacatatcacgttaggtcacaaaacaagtccgaacaaattcaagaagactgaagttataccaaggacctttttcaacttaatggtatacaactagaagttggtaacaggaggaaaactagaaaattcacaaatatatggaaattaaacaacatgattgtgagcaataaatggttaaaagaagaaatcaaaaggaaaatttaaaaatatattgaagcaaatgaaggaggaaacatacaaaaccttatgggatgcagcattgtccaagagagaagttttcagtgataaatggctgcatgaagaaaatagaaagatctcaaataaacaatccaactttacccctcaagctatgaaaaaaaaaaaaaaaaaaaaaagctaagctcaaagttagtgaaaggaaaaggacaaagatcagagcagaaataaatgaaatggagactaggaaagcaatagaaaagatcaacaaaccaagagttggttttttgaaaaaataagccaaatttgtaaacttcagctatactaaagaaaaaagagagtctcaaataaataaaattataaatgaatcgtatcataagagactaccatcacaattacatgctaacaaattagataacctagaataaatgaataaattccaagaaaaacatgacttacaaagacttataaagaaatattaatataaatagattaataatgagtgagaagtctgattcactaattaaaaatctcccatcaaagaaaagctcagaaactgataatttcattgtagaattttatttaacatttaaagaataattaacaccaatctttctcagactcttccaaagaactgaagaggagagagcacatccagattcatttaaaaggccaatattaacctgacaccaaagacagacaagatactaccaaaaaaatttacaggctaatatccatgatgaacatagattcaaaaatcctaaaaaaattttaacaaaccaaattcaacagtgccatgatcaagttagatttatccctgggatgcaatatgtttcagtttactgtacagatactaataaacatgatatattacattaacaaaatgaatgacaaaattatcatctcaatagatgcagaaaaatcacttgacaaaattcaatatcctttcatgataaaaatttccaaaagatgaggtaatagaaagaatgcacctaaacacaataaaagtcatatatcagaagcccacagctgacatcaaacattgaaaagctaaaagcttgcccaacaagattaggaacaagacaagaatgcccactctcactaattctattcaccatagcactgaaagttctagccagagcaactaggaaagaaaaagaaaccaaaaccatccgaaacataaaagaagaaggcaattgtctctgtttgcagatgacgtcatcttacatatagaaaactctaaagactccaccaacaaaactggtagaactaataaattaattcagtaaaattgcaggatataacattaacatataaaaattagttgtgtttccatatactaacaatgaactattcaaaaaagacattaagaaagcaatgccatgtataatagcataaaaaagaataaaatacttaggtagaaatttaacgaaggaggtaaaaggtacactgaaaacaataaaacattaataaaaaaaattgaagctatgaaaaaattaacatcctgtgttcatgggtgagaagacttaatattgtagaaatacctatacgttccaaagcagtatacaggtttaattcaattcctatcaaaattccaatagcattttacacagaaatggaaaatcaaaccagaattcatataaagccatatagctaaagcagtcttgagcaagaagaatgaagctgatggcatcatacttcctggtttcaaattattacaaaacaaaacttatcaaaacaatatgataccagcacactggcatgaaaactatatatatatatatacatacacacacacacacgtatgtgtttttatataatttatatatgtatatgtgtgtgtatatatatttataatagaaaacctcaaaataaacccaggtatatatggtcaattaatcttcggcaaaggctctaagaatatatgaaggggaaagaacagtctcttcaataaatggtgttagaaaagctaatattcaaatgcaaaaatatgaaactggctctttatcctacacatatgaaaaatcaactccaaatgaattgaagacttaatcatgagacctgaaaccttaacacttctaatagaaaacagaaaaaagtgctctataattgtaatttcagagatgattttttggataaaacacaaaaatgcaaacaataaaagcaaagataaacagatggaactacattaaactgaaaagtttctgcccagcaagggtaacaatcaacaaaatgaaaagacaacacatggtggcgcatgcctgtaatcccagctactcaggaggctgaggcaggagaatcgcttgaacctgggaggcggaggttgcagtgagccaaagacgcaccactgtactccagcctgggtgacagagaaagatactgcctcaaaaaaaaaaaaaaaaaaaaaaaaaaaaaaagaatagaagaaaatatttgcaaaacatatactcgataaagggttaatatacattaaattcaagaaactcatattattttattttttaaacctcaagcaaccctattaggtaatgggctagacgtttcagtagacatgtctccaaagaagacatacaagtggtctacatgtatatggaaaggtactcagcatcactaatcatcagagaaatgcaaatcaaaaccacagtgagataccacctcacatctgttagcatgtctattgtaataaagaaaaaagataaaaaatgttggcatggatatggagaaaggggaacccttatacattgttggtgggaatttaagttggcacagctatatagaaaacagtagggaggttcctcagaatattaaaaatagaactaccatgtgatccagcaatatcacttcagggtatataaccgaaggacataaaatcactgatatctgcatcctcatgtttattgcagtagtgttcacagttgccaagatatagaaacaaccaacctaagtgtctattgatggatgaatgggaaagaaaatgtaatatatatatatggaatattattcaatatggaatattatttagcacttaaagagaagaaaatcctgactttgcaacaacatggatgaacctgcaagacattatggtaagtgaaataagccagacacacaaagacaaatgctccatgatctcatgtacatgtgggatctaacaaactcgaactcacagaaacagagtagaaagttggttaacaaaggtggggggtaggggaaatggtgagatgtcggccaaagggtacaaatttacagctgtaagatgaataatttctggagaccagacacacagcatgattactatagttaatagcattgtattataagcttaaaatttgctgaagagagatcttaaatattctcatcatgcacacacacacagtgtaactatgtgaggggatggatatgtaaattagcttgattactgcaatcatttcacaatgcagatgtataattaaaacattacgttgtatatcttgaatacatgcaagttttatttgtcaattatacctcagtaaagctaaaattaaaaaaaaaaaacccacaatgttaaggagcctcagcaaaaagtacaggaatgtattgatctctttggctccctgttctttgggtctcaaatacagtttcaactgtctaatatttccctagttcccactatcacatttcaaatggcagtgatcaatatgggacttccccagctgtttgaaatacacattgttgctgatttcaccttttattctcttcttactggtaataaaaaaaaattgtatatgatcgtattaaccaataaataaatgtccaaagaccatttttactagtgatttttgagttctgcagaattcataaagcaggtcttttttcctaacgctttgcaaaatgaaagaaaacaaataaacaaaaaaaggcacatgaggaaagtgtctatgcctgactgcctcctgactgcatcagctgagcaccatcttctgattttcatctcttagctcttctctagaggctgaatggagtggacttcatgccctgggagtatactgagcctgcaatgatggccttctctttggccaatgtattaaatatcactatttcaattcagaaagaagcttcatgctttcttcctctgtatcttcgagttgcattgaaatgcatcatgcaaagtactcaataattatatactataaagcaaacaataactcttggaaaatgtgacattatagatgaatttttaagatgtgagaggatttactatggactaaagctttattgtaaaataattatatgaagaggaaacaaaatcagtatgtgaacaattcttcattatgacaaattttagctcaagtgtttgaaatttcatggagatggaatgactgagaaatgccacgcataatgcaggtaaaccttgactttacatctgtgaatacaaaaattaggagcaagcctcccaatcctaaaccatatccaggtcagtaaggtacatctggttgatgaatatcttcccaaaagcatttcttataggtatcatggagaatatttacattctctgaagtgtaccaaatttattcaaggaaataaaccatcttgggtttaaccactttaattttactagtgagttattgtcttctttatgttaatagccaaaagagacataaaagtttctttagagacgagtagtccaactttcaatgggtacttagaatttctataacaaaaatctaaaaattttaaaataaataatgagaagcatgatagctaagtattgatagtgtttagctgtatgctttgctctaaaacatgctctataatagactattggctttttagatggctgtgtcattcaaactagatctgactcataagtactagggtggcatttgttgctggcaacaacacatgttgagtcattttatattcccattacagattctagctaatgaaattaaattcagaatgtgccttctttgtctactggactgcaagtgtgcatacaaaatacacaatttgacaatataaaacaaaatatattcaaatttcacttatgcgacataaatctaagcatgtaaaatatagcattctgaattaaaatattacattttaaaccattgatagattaatacaaatcctattacaaagcagtcactttgctatttgctgggagtaagaagaattaaacaaatagattaaatgataaattgctttgtgatgcgctaagtgccataaaaacaaatatgaacaagtttggtgggagtactgtgaatgaaataaccaattttacctatattagttgaggaaagcccagagataaagagaacctaatcaggttttaaaagcataaaatacaacctgctaaaacaattctataatgcctttgattttcctgagaaaaaaatctcatttcattatggttcttacgatcattagacaaattatcagccaggtataacagatatatgaacactaaattttatttcagcagacctaaagtctgcatggatgtaaataaaaaactatccctttcattggtcttcaccacagtagtttcttaggaacagttgatggggttcagattctttgaggatttttcaccttatattgtagctttgcattctcgtcttgtatccaaatggtgtgggattaagaaatccaaagaatttagggaagagattgcagtatagggaaacatgctaagagactataaattataggatcagctggagaacggcaagcagaccctctcgaattcttcatagcaacactaatagttctaaagtagataagctgtgatcagagttgggaaacagcgttcttctgaggacattttcttaaaaaagaaaaacattgtgatcctgcatgtatatttttagacaatcccagttaaaaacatttctgaactctttctttctttgttctttttttttttttttttttttttttttcagatggagtcttgctctgtcacccaggctaagtgcagtggctccatcatacctcactttaactttgaactcctgggctcaagtgagcctctagtctcagcttccagagacaccgaaatcacaggggtgtacaccaccaccaccatacgtggctaattattattattattttttttttgagagacagaggagtgcagcggggagggggatggttgaaggggtggtctgagattcttttttgcccagactcaccttgaatttctggcttcaagctatcttcccaccttaacctccaaaaggtgctgggattataggcagcaactaccatgcccagcctaaagtctaacctttaaaggaaagtctatgtgttataaaattactgagaagaagatcgtcagtctacaggtggtttaattgttcttttaaaaggttgtcacctaaaggtgtcttaattttattattcctttatccatgtttgctattctctgtttttctcccactgctcctattttctcccctactgttattattacaatagaggtttttgttttcatttttttggtttgcttgcttaaacttctttggagaaaaagtgctctataaagcataaatggaaaggagaaatcctcttgtggtagattacatatatggagttttattttatattaatttaaatcatgcacatttgaaataccttaaaatattaattcttactttacataaacagtttcaatttatgtaaataactcaataaaaataataatcacataatttcaaagatgtgaaccaaattggttgtaaaccatgtttattttgaaatgccacatggccttataccttcattttaactggaaataccctccagcctttggcacactacactttgcaagagaaatactatggagtgattgtaggtgacattcttacattcatctcacaaatatttgttgagcatctactatgtaccaaacactatgctctgtgctagagatccagccataaaaaaaagagcaagaaagataaataataactgcctttttcatgatgtatctattctcctgagcagataagacaataaccaaatatagaaaaattaacagattaggccaggcatggtggctcatgactgtaatcccagcactttgggagtccaaggtcggaggattgcttgaggcctagagtttgagaccaacctgtgcaacaaagcaaaactttgtcgtagaattttgtttttatttaaaaacattggtagattaaacaataagtcagatggttgtatgtgctaaggagaataagcaaattagaaaaggaggataggaagtattgaggggatattcattaaaagtcactttttagcagagaactgaaggaagcaaatgggcaactatgaagatatttgggaaaaagcattgcaggcagagggaatagcaaatacagggcaggaggatgtgcttggcctattgggggaaatggcaaggggaaccctgcagctggagtgccctaattgccatggtagcaaactcaccactccatttccacttttgctccccagagtctatttgcaacttagagcctgaatgagccttttatgacatatattctaggatcactatatgtttgtccctttgacaagcctttgctcagaatcctttaatggctttccatcttattctgagtaaaaccaaagcctttgtaatgacccacagaaccccacccggtatactgttatctctctgccctcaccccatctttttctcctccttactcattcaactttcaatgtcccccactcccagggccgtttccccaaaacacaaatatatatacagtaacaaaccacttcaggatgaagtgaatacttctattagagaggttctgtgtatctgttccatctagagctttttatttttagaatttctttttttagacttacaagtaaccatttccttttaaaataaagtattttaaaccaagaactatacaaagttagatattgaattttattttttagtttaaatcccatgttctattctcctctcagggatccgttatcaggattggaatttgaatatttcaaaaacctcttaaaaagtagtttagtacataaatgctaccttttactctggctggtaattcaatttcagataccgtgtttaagtttttgaactactctacagttgtttttatggtctagcataaaaattggagttgttgagttagtttcctaaacttatccattagatattgagacaactgtagacataacaagaaaaaaaaactgtactcatatcttctagggctagaaaataacaactggtcttatagaatatacagtttaaagtttgtacctagtttgaaaagaatatagaaccaatgacaatttttaagtctgtatttcgtgaacaaattttgagctaaacttggaaagtaataaaatctccctctccttccacttagatcatgcaaaatgtagcatatcaaattctaccataaaatgcatgaacttgaactgtccgaatgcatagtggatgagactaatttaggagctttgaaccatgacagtatagcatttgacaaaagttgaacaaatatgggctcttgtccccaagagtaaacctagttatagaacctaaacacattttccaaaatgcctttttaaatgtccatagagtagtcatgatattactgaacctgcaaattttaattgagagttttttttatctttccagatagttaagatagcacagtaattggtacctagaagcatgcagaaatctactttggcccaaagcaaaaaagttcaaataaatgatttttacagtcatgttggacaacatatagaatacgcctacatcatgaaatttaaccaataatataactactagatgcaattctataataggctgtcaccaaacatggctcttaaagaaagacaaaattgtaacctatatactataaaccatacgaaaaaagagttctggtattctggagcagttttgtgggcatatgtctgttgccctttgggacactggagctgctatagccaaaatgtaacaaaggaacggtgaaaatagtatattctattacagaaattccatctgcacaaggaaatattgatgtaaaataagtgttggtcatgttttcaccgaaaggctccaacaacttatctctggaattgagaaaagaaaatccctttctttgttatttaatttgtagaagcagatacttccatgaacagtggccatgaagcttctttgtgccaccatcgaaatggtaatgtttgggaacttcactttcattaactacaggcacaacttaatacagtaattaaaagtgactcgagtcagaatacctgagtcctcatctaggctttacctatgtgactttgggcaagttacataatctcaagtgccttcatctgtgaaatcagtataattacagtgccaaatttgtggttgctgtgtagattaaataagttagcatgcataatggatttggaacagagtcgtataactggtaagtactcaaaaattatatctattattatctcagtttatcttcatgtatgacataagcatttttagtggtatttttattttaaagataaagaaatatatatttaatgacatctacatatatagcttgaaagttacatatattgtgatcttcgaactgcacagcactcctaccatgtgagataaataagctatgggcatttattgaatgcttgaattcagaacattatattaatgaattatggcattgtcaagtagtcaagtagtccctcaccaacaatcaatccaatgtctaatccaaccacaagggtcacaagtgcagcaaatggaatgactcaccactctttcatggatttggctggtaaggtgacaacacatggattcagacagtttattacacagacaggaaacacaagatcagcgtaatgtcagttccctgaattctttgtcccctgggatgacaccaaacaggccagatggcagatggcatacaaagaggtacataaagcagtagtcctgcccaatctcattggcagctgaaagcatgtatattgaagggaaggaaaggtcactctgtcattgaggaaataattctgaattacagccaagcatttttaaaggcttatatagaagcctgaaaatgtacctttaagagggaaaatgtgtaaagtcctgtgttcaactgaaactagggagatgaattggaaaaggcctggtggcaattccacattaggctgcttgtctctccttattacataaggaaccccagaacattctctcaagaattgtgtcagactgaagatgagcctcacttatgtgacctacgtggaaatgttcaaggtcatcaggacactcattggatagtggagctgtttctctataggcttatcttccttgacaaatttcagagtaatgcatgtgcaaaatcttcacaataaaataatatagattatgtatagttaggtaagcaatagattaatattaaatgcaaacctgatcttccatgtctcaacacaaagagaaaagaatattgatttataacttttttcttatttgggcaaaatattggcaatctgtggtgtaaaacatgcatacttctggcccaggccattattaaaatggaccagataagtgcatgaattaatgtttaaaacacaagtaaaatctttgtaatttggggtagattatgtgtaaatacacctaggagaaaacaaaccacaatagctaaaaatattcaagcacattagtaaagtacatggcagtttcaaatctgtaattatctcattgaataaaaagtctcctttcttctgttgtttattccacaatgattcttgaaagtctaaaactaaaaatttcagattattttaagaaagaaattccatggccagtggacatacaggttaactatcttttgtctgttatgagtcaagttctagtatgttaccagtcattgcccagttgatttcaatgattatgatttttactatctatcttaatgtacattgataattactttctattccaagctttcagaataatacataatgcacagaacagaaattatccaagatacttctcaatgtatatgtttttaacaagccatttccaagtcttcacttcaatttacatacaaagaaaaccttaacattttctttccttcaattctcatatgtgtagctgccagtaggattggacagggcaactcctttatgtacctctttgcattcatgtatttacatagaagcagaagaaactcctgccagaaaaagtaatgaaacctgatatccaccagaatacaagagagagtttaaggctactaaagaaaattctctggattaagatgaaaaagagatctccaggttaaaataaaatcacctaaaagatactttttcctacataaaatcatggtatacagtaagatttagtgtgattcattcttcaatcaaagaatggtttttgagagtagaagtctttcactttgtaaaggaattaaacagaagacttccaattcttgaagctcttaagttatctcaaattgagaaataataattaggaacagaaatagaaataaaagaaaaagaatataaatatggttattaagccatagtcaagacagaaggcttatattttaaggactgtactgttcctttgcaagaaaagaaggcacaacttttttgtaggaggaaacatcctaaaccagacttacaaatgaagtttatcttcattgtatgccttggatgcctgggttccttccaaggaactgtttctaatttcgcatttttaaaaaattcttcttagatagtgcccccaaatcatttgagctttaagtaccacaaagcctagctctgtctccaaaagcaactgttcaatcagaccatcatggagtatagacacagacaatgtggattggcaatgaggagtaaggaccaaccataaagaaagttgaaaatctaggccagaacaaaggcattaactgaagttatttctggctataggctttatcagtatcatagagaggagggctaatactgaaaccactctatttatgcctgaatatattataaaatatattcatgattaagttaactcctataactgtttctttttgggcttaattcacttcaaataattttatgatttacatctttattttggtccagatcatctttttattaaaattattcatatgagttatgatttctgattccaccacttataaattgcatgacattttacttaaactacctgtgcctcggcttctgaaactatacaaaggacatttgaatagtgtctacctaggactgttatgaggatgacatatatgtaaaattttaaatcagtgcttggtgtgttattaagtgctcaacagctgataatattacttttcctgctttctctgaagttttcttaattagtggctattctccctcccatactccattttctactgggatggagttggggtagaattgcttattgctaatcactgctgttaggtaaactatatttcttcctttatttttggctcagattacatattatcatactgtacctctcctgttgcagtcatctagtagctgcctcataccttgacaggatttaagctccaggtttattatcaccctttcaaaatgaaacttctgtcccatttttggtgctttcaatatatcctattccattcactctcctgctttttaactactatttcatacattttctcttctctaagattcaatgtttccttctctatcctttctctcagctcatgatcctgcttcctacttcacagagaaaaggaaagtaatcaaaaaagaacttgtaccatattgtcccacagatttgcatctgtggccaccttctctgattttcttctgatgtgatccattatttgggctgatccatttgtgttcctaaggccagctactcagtttgcacattgctcttgcccacccaaaggcatcactctactaactgggtattctcttaaataatcaatttctcttgctcactggatcattttcattatcatacaaacatgttgtatctttctcctatcttaaaaaaaaaaatcactttcgatcatgtgatcaaacagtatccagtatccataatagtgagacattaagatattatataatacccatgagatctaaaatgatgttaaagcatcacccatgaaggactacggtaaaaacaaacaacaaaaaaagttcaatcagaatctaatcaaggctttagacttaacttgctgattacataataaataaccagggatggaagtggagtggggttgggagtgggggtatagtgactcaaaatgttcaatgttacaacaagaaagcaatcagaaaaatccagaatgtggaatattctatatgacaactggcccaatatcctcaacatgtcaggtcataggaaaaaaatactaaagaattagaataaaaagagtacacttggatcttgatttagttcctactttgggaaaaacaaagtagctttgaaagacatttgggggaaatttttggaaatttcagtaggaaccgtatgttaaattattccaaatgtagtaacggtactacaatgatgtaggagaatggccttattttgaaaatagacatattaaaatattttagagtgaaatatctgatgtctgtgttaaagtatgtcccagctgacagacaaaatgagttccccatggctaattgaggcactcgaagttaaaacagaaccagtaggccatggcttggtgagagagcagtcatgtactttgtattctcaaagcgattttctgaaagtgtcacagtaccctcctttctacaaataagctaaaccagttcctgttttcagggccaagatagattgcagatggaaattaatcaactgaccaccaacagacttcccgaggccagccaataaaaagagatacgtgatgtcttgcttaaaagccatccagtccagaccctgcatttgatccccgcctcctactgcatcttgtgttttttgcctctataatttcctactccttaatccttcccgggatcacaccttaattttgcaccaaaggctgcatttctccaatttgaggattgcttttagaaaataaaattctcttttcgcctcctcatatctcattggtctttggttaacatctgaaatgtactttcaaatgttacagaaaatgtaacataaaaacatatatggcaggccaggtgcagtcgctcatgcctgtaatcccagcactttggtaggccgaggtgggcggatcacctgaggttagagttcaagatcagcctgaccaacatggagaaaccctgcctctactaaaaatacaaaattagctgggtgtggtggcacatgcctgtaactccaggtactcgggagactgaggcaggagaatcgcttgaacctgggaggtggaggttgcggtgagctgagatcatgccattgcactccagcctgggcaataagagcgaaactctgtctcaaaaaataaattaattaattaatataaaaataaaaatatatatggcaaaatatcaataattgttaaacccagatagtacgtatacagacatcctctggcaatcttgctgcatatttgacaacttttataataaaaagttaaaggtaaaatctctattaattcaactttcccctccagctagcatttcatttcacttcatttccttcttctcagcaaaattcctcaaaagagttgtctagattcactgtctgcaattctcctcccattttctcaatctccactctgacactgaagctgcctttatcaaggtcaccaatggtttccttgtggccatgtatatttgcattttcaacattttagcagcatttgtggaagggattatcccttactccttgaaatcattcctatttagcctctaggacaccatttttttacttgtttttctcatattttacagactccctcttctcagtctcctttgctggctcttttatatctcccagatttctcaacattgctgagccccagggcttggcttcttctcagtctaaacttactctcttgctcatcttatccaatttcttggctttcaaaaatatctatatgctaatatcctgtaactttttctcaaatatggactctcttatgatctccagactgtgtattcaactggaatatgcctctgtctggagcctaacaaccatgccataggagtagtgagtatttctcattctctctctgtggtacactcaaaaggagattggctcttagaaaggtctgaggtctagctagcatataaaagcagtggaagaacacataaaacaggagctgtgtgaattccgattgggaaaccaaatatttgcgtctgaattgaagatgtcttaatttattccaggaattgggatcttattagggaatacccgtttctgcatataacttaaacaaattaaggagtatgtaatcaaacattctgaagatctttagcaccaatattcttcaattctcaaaaatgtcctctcctgtccaactttactgttctgccccatgatgttatgtatggggtattagaaccccttcctaacaggtttccctagcttcagtaaagcaaactaaagctagggaagcctaaatttgttattcataaatataagtgactgaaagatgttgtaagatgtaaacttaaacatgttatttctttgcttaaaacaccgtaatggatgtccatcactttttaaacaatgtacaatgttctccaacatctaagtcctgtttgccttttaatttgtccagtccttatcttcttagaccgaacaatgatgaatgttgtgttttcaacgtcacatttcttgaagacagattaggccttctaatttggtccgtatgcaaaagaatgaatttaagttcattcatgctgaattaatagggactctataacgatgtaaaagtaacgcaatgagtattgcgttatctggcacacgtagctatttaagcaacttctgtgtatctcattggtctcatttgtatactggagatgatgatgatagttttttgcatcacagacttgttgagaatactgaatgggttgatacatgcaaatcacttagcatagtgcctaatcatcataagaaatcaacatacttaataaattttcattatatctccattttacaaatgggagtcagaggggttaactatgtttttcaacttgccacagtttctaagttatgaacaagatttgaacctggggagtttttctatctgagtccatatggactattacagggctgctgttcattactatatcaattctaataaaacatatactgaggcttcagaacaacatagaaaaatgcatgaaataagacctattcatcattgtagaaactgtgtccttcaaggactgattaaaaagcaaaaaagaaagaagtgtttgctccacattgactatacctacagttgaattggggattcgaaaaagagctgcaaaaaagccacttaagcccaaaacagatttgtagacacatcagttttacctgttttactaatgttattcactttgcctagcgggactttctcatcttttctatttggcagaatcaagcacattttcacaaatatgtcatttttgagaagctgttccctatccttccacacaaaaaaaatacctctttgctacattatgcattttattcctaattctcacatcatagtgtcatacttagtcttagatatttattttcccttacaatatagtagaacttcattgatgagaatattttattcattttttttattatactttaagttttagggtacatgtgcacattgtgcaggttagttacatatgtatacatgtgccatgctggtgtgctgcacccactaactcgtcatctagcattaggtatatctcccagtgctatccctcccccctccctattttattcatttttatctttgctactcaactcagtgctaattaaatatttgttgaattatattgatttaatttttgttgaatagtgggatagataaatatatcaaatccatcatttgtcttaaagaaattgctaatgtctagttcatcttttctatatcaccatcacctagcacagcatgacagtttgttacttaaactcagtttggtaaattaatgaatagatgagtgaataaatgaatgaaggctaaatttcaaaaggctgagtttagagtatcccaaatctagatgttaagagagcttaatgagagaatcctgatctgttaatatgaacaacacttattcatggcagaggaggggacatactcctttaaaaagtgtaagtaatagatattaaaagttttttgaaaatttttaatgctacattatcacccatgcacaaagaaaagaataattttaatgttgtaacaacatattatgatattcactacaatttaatcttttatttttatttacattttatgtagaatgcttataactagaaagaaaggtttcttaaaagctttccaaatttggcaatgacttaaatattatagaaatcgatatcctgaaattcagtaaacaaattcaagaaaaacttctttggcaaattctagaactttatttttagtctattttagtcttctttttttctcctgaagaaaataaaactatataatgtccactgaaggtgtatgctgctcaaaatgttcatgctgcttgacttcaagtcattattacaattctggacaattcaaataaacaaagtatgaagtaaagaaccttagccatgagatctggaagacagacaaatctattctttacatctagctttgacacttatcatgaatcacttcatctctctgatcactgcttttccaatatggaaactagaaagattagtgactacctactaagattattgcaagtaagtgagagaaataccataaagtaccaggtgagatacttttatataaatgaataaaagtactagcaaggtatcactatgtacatgctgaacactcaatagtgttatttcacttctttctcccttatagcttttggcagactactaaaagcctgaaaattctctaaagatatgagatatgatttccatatctagggcacttggttttgacaagccagactcacaaatgagatgcccattaaatttaagcaatttacatgtaatctttattcctgcttgtttctttttaggtatttatttgtatatttatttgtttgtttttgcttttaggagaaaggcattgtaagatcaataaatacaatgcaatcaaatgagtatgttgcaggggaggggattcgagaggaaaaaaaaagaaaagaaaacatagtaaagtcagtgatgatatccttgaaattttacctgagaaacaaatctgtaatgacatgttaatatttttttccaaagtcataggaaatttgggataaggtggcatgcccagattagaccctagtcagtggagtgtaattaaaaattttctaaattgaaaactggtataacctactttaccttttataggtacaaggcaagccttagttcagtattttacacaagcacattacatcaagtcatctcaaacatcatgattgaacaagtgagaaatcatattatattatcagaaaaacaaagcaatgtctggaaaaatgaaaatcaaacatttttgaggacaaaaaaggctcagaatttcttttagaaaatagtgatcagattcaattgagattcaagttttatatgatatgaaaaggttaatattttatacctgcaacattctgtagcagatataacaaaacatcaactagttcaaattcaaaaagatatagtaaaatgcatgaaataaaagctatccatcacctttgaaatacactgtttgtcgactgattaaaacacatgaagagaaatgttacttacacattgagcataccaataattgagctgggattcaaagagtgctacaaagagagtacttgggtacaatacacagatgtagaaaaatggtttatagccagaaaagtagtttgggggaggtaaataatcccctaactccttttgaaaaacacctgcttgaagtgcaatatttacattctgcaaacaacttcctaaagctctaagttcatttgtctctatgttttctctgcaacttaccttgacatttttgatgattaccaaagatattgtttatttaaataagcacacagtctctacctgacccatatgttccttcttgactttggatttaatttatgatgcctattttataacattttattatttccatggcaactgtcttggtataataaacaaagaatgacttcagctactttatcccgcagtgaaggagctggatttgagaagggtaagtttgaggtaaagacaaaatatcaaaaaaaaccagaaatgataatgaaaaaatgaaattcattttatctcataccgataatattttcgttagggactgaatgcatttactaggcagaataatggcagtcctactctctcgtattcaaccgaagcccacccctgttgatgccaccaaactcaaggccagttggtccctcagtataatgcactgttactaatttatagtcctagtttgttccaatgtccttttgtctgttttcaaagccctaggtacatttgaacctatcttagctaagtgcattaccagatgacaaacaataaaaccaattattagaaatcagcctctgtattaatggcatatatattttctattatttttaatattataaggctaaaagtagaaataatctatatacacacatatacagaacaaaaagacacatggattttatttttaaaaaatggaattagaacaaattttaaaatctatttacctaatatgataatgacctttgttcccagcttcaaaataattttaggtactgtcagtctattccaatttcaattaaatcctaccctctcctgagatatgacatcaagatctaattcagttataagcagcgttatcatttaattatcttctccagttatctacactgccaaatgatagtatttcctgagaaccacatatgtcactgttgtaagcaagaaccagtttggggatacatacagaatattgaactacactgacttatttaatgttttaattcttacgacttatagcaaaaaattgctcccaatctaacttgctttgaataaaaataccgttaatatattttcctagtgaaaattgcttaacctccctgtgtctcagggcccttattcatagctcataagaccaaacctagcatacagtaaacacacagcaaatattagcttttattattacctcaggtaaaatattccttatctggcattaatatatactagggacaagtaacctaattaagtaaagatatattaagctaaaaaccaaaattagtttgtctgatggcaaagttgatgaatatcatactttctaggttaatattataacatttatttttgctttaaagcactactttgaggtctattatagtttttctttttttccagcatattttccaatatgtctaggttaaatttcttagacatagccaaagaaaaagtatgctctaggtatttctgaacttgggcaaattccaaaactaggaagaggtcacccagagtttagacaaagagcaagtttttctggcactttcgtaattctttctcgtgtgagagtctcactcttgcaattgcttctaggacatgaccctctgcaacagagattccacacaacactccactctttgcctctcttctgtaattcaaactctcttttaaaaagtctgtgtcctctctgcaatccccaaacctatctttgaacttaccaattagcagtcaaattttggcttgtaacaagatttatagtcagagcataaggacatatatggagaatgaggtatttttaggagtcttctattttaagtcctcataaaactcaaaaatttttatccaaagagatttgagattttaataacatgagaatcaatgaaaccctccctatgggtgaatcaccatatagataggtcagggtctactctgttaagttggttcctgatgatcacatggtgaattaactttatactgtcttctgttcagaatgagcacctgttacttgccaaagtttgtggcagacacacagaaagtataaagaaaactaagatccagcctccaccttcaaaggacttacaggtatcaagtaaaatcatccttattcatgtgccagctacagtataataaaataaattcagatatttatctcctaatgagctgactggctgcgttctaaaaggatgtctgtaaatttgtttgtctacaaatcccaagtgaataagaattgaagttcacagtccacaatctaatttcattaaataggacatgtgtattggtccctcgcaatcttgtggatactatttctatcacacaccttttttaccttacttttttaactcattgaaaaagtttttgagtcagctattttccctgttaagctctgaattttactgcatattagggaaagaattattccatatacaggtacagaattcatcattttctcaccatattcaatttttataaatttatctttttgtttctatcaatcataatcataagcttcttcttagtagtcttttcaggcatcttaattacttggttggttggttggttggttggttggttggttggtttacttattagacttgagagattgtgtgtaaataacccacagcaaatgcattatagactaaacaacagtgtgacagctgaggttgaaatggcaattatagtcctttattggagttagacagaattgactctattttcctctggagcacagctttgttcatgtaaatgaaagttagtaagttgaaaatgtggaagtaaaggagttttgtcgatattatatattcatttctttatcaactcaacaaatttacttaaagctttctatatgctaaacactgttgtagataaaaaggcaattcaatatagcatgatgaaatctagaaaggggagatatggaaaagctcatgcaactcataggaaagacatctaacgtactcttgggaggtcaaggggagcttaccagaatgattaaatgaggtgactttaaaggatgaagggattaggccaaattatggagtggagattggggttaagagaataatattcagaatttatcttaagggcagtggaaaacaatgaaagattttaagtaagagagtaacataatcaaatttgcatcacaggaggttctttctgactccatagtttggtttaaggaaaaaggcacaagaatgaagattagagtgctgtttaaactattacagtaataaggtagataatgatagataatactgtcttgaacgatgacagggtaatgggaatggagctcaacagattaaaaagcaaaggctgcttcagcaactaaacaatgatttctgtgttttctcactgcgattttattattatttatttttttagagacagcatcttgctctgttgcccaggctggagtgtggtggcaccatcacagctcactgcccccttgaactcctgggctcaggcaatcctcttgcctcagcctccccagtggctgagacaaccgtcatacaccacaatgcctagataattttttatagagaaggggtctcattattttgctcaggctgttcttactgtacttttaaacccatattcttacagattaaaaaaatcatttgtttgcttatgtaaacacaagtgagaatttggtcatttgcatgcactagacctcaatatagccttaaaatcataaagtatagaaaatggttggcatgttttcaagtggcatgtaacatcttgtggctatattccaggatgcatatagccatgtaaagaaatgtcagtagaagacgctaaagccaactcatgaaaggacttaagaaattgtgactttatccagtgggcaatgtcaaacttagtgttttacgcagggaatagacagatgatctggtctttcaaaggataactggtatggtggacagactttaagttgaaccccatgatacctgtttttttagcaattatgccttaagccaatctccttcccttgagtataggcaggatctatggctttctcctcatcactccctgtattatgttaccttctataaaacttcatcttcctcgcagattcaccagagagacaccccttgctggcttgatgaagtaagcagctgtattgtagaccacatggtaaggaactgtggatggaattgagcaaagaattgaagctttcagttccacaacacaagaaactgattgcttccaatataaccatgtgaccttggaagaggaccctgaacctcaggtgagaactcagccctggttaacacattaattgtagtctgtggaccctgagaagagggtctaaaccatgcccagactctcaacccacagaaaccatgagaaagtaactgtattgtataaagtctctaaatttgtggtaatctattactcatcaataaaaatctaatataattagttataatattgaagataaattagatgagagaaagctggaaacaggaagtccagctaggaaaaaagaggtaacacaatgagattatatatataactgctaaaatatgaacatgacagtcagaaagagtaggttttaagctttttatcaagttctgtagttaatcacctagtcacattataaaatggaatgataatatcttcttaaatggtttgtataaagggtatgtgaagtgaaatatttacacagggttcaacacaatgcctgccgtgtattattattcttatgctactatgttaatctttttgaggaccaatgagagctgggctaggacaaaggaagtgagaatgaaaatagtggtaaatttgagcaatatttttaggtggtaagtcataaggactgctctgatatggataaaaagagagggaggaaggagtgaaagataatacaatttctagcttggatgattgaataagaatgattccataactgaaataaagagtgcagaaagaaaggctgatttggctgaggagataatgagttctgtcttagcagtgtaaagtcaatgtgcttgtgggaggacatccatatggagaggtccagtgtactcagaagagatttgagtatacggatagattttgagatggttgagaattatgttaccaacaaactacatcagtattcacacacacacacacacacacacacacacacacacacacacactcctaatagtctcttttgaaaaacatgagaaatatttcctcttaataataaatacattatgagtttaataaatggagcccaggatgaaaaattagagaataggtaaaggatcctttcttctttccctaaaggatcaatgactaagaaatgcccaaatacaaaagggatatttaagttgattaagcttgataagtctgttgcaagggccagcaaactatggctccacagccatatccagattattgtttttgtaaataaagttttgttggaacacagccacatcaattcatttatgtattttctattgttgctttcacaatacaatagcagagttcagtaattgtaactcaaaccatgtggcctcaaagccctaaatatttactgtggagcactttacagaaaaagtttgcccacccctggtctattgtataaaaaaacgatagtcttctaacttgaaaattgtgcatcaataaataaggtaataaatgaatgttgcttgaaatgccacaacactcatctaagaattacaaatctttgtttctcgtacatttcttttatttattaattgtaacatttctgagcatgcattttctaaactgctaaaaaggaataacacctcctctgcttacttcataaggttgtgagcaataaactctttaaaaaatgtagatagcattgaacaaatataagttaatattctagaagcttttatattgttaagccaagaaatcaatgcattcagtcctaatcatacaagagagaagtaaatatatatttctttatattactcactagagcacttttctttcatcttaaaaaaaaattgggttaaatagaactcatactggcatcatcctttccagaaaagaaaaatatagaaaattaaggcatttgcctaaattaaccagctaattaatggtaaactctacgatcaatctaagtctcttgatttttaattttctttctaccaggccatatatctgcaatgctgactaactggatagatcagtcatatttgatatacatatgtgggcatctgatagatataattttagtatagagagcttggaggttaagataaagtaaatagaatttgtttcaagagaaattgcctcttcaaatgcactttattctttcatattttgaatttttaatacattttcattttggaatagttttaggttaacagagaagttacaatgatagtacagacagttcgcatatatgctgcacattcagtttgctctcttcatttttaaactaagaaataaataactatcatcatatatcatctgaaaggtcagaaaagtgagaataatatgtagatgtgtaatatagagttatcatttttatcatttgactcatgattaaggcaagatgttgttacttgtccaaggtcaaataaaaaaatcaatgacacacgaaattagaaacagaagaagatgtattaaatgggggattatgaggatgaatgaattaatgtctttgaaatcacttcaaaatgtgtgggcttcttaaaatatgtggactcctgcctaaagacaaatcattactaatatttaacttgctaatctactttccaaaacaacatgttctttcattagctcgttgtttatttgcaacatggcctggcttggttcctggtatatttggatgctgagtgaagacatgcaagtttttcctgatttaaaaagatagcaacgtaaatgacagtgtttttgtaatgtaaactttagaaaaagaaatcatgtacttatatcttaaacaaaaaaggaaagtgtttcttattttaatcaacttatcaacttaccggtagtttttaatttttttatttatttatatttgttttattttactttatttttttgctgttgggtatttggttgccacttaaacaagtgatcagatattcattcctgagaaacatggctctccaggaaaatcattcaaatacaaaacatcttaactaaaatatcattttttctgtttttaaagtttttcccaaaatgtgaagtataattacagatacataaatatctatttcagatagtaaaactttcatcttgattactaactagtaaacgagattttgtgtattgagtgcttatctactaatagtgtaataaaacttttcctgttatactcttaatttctgtcaagattattctcctgcttctacaaatttttctgcatttaagcaacatcagataaatggattatggttgaagaagttttcctctagttaaatagaggacaagcatacgaagttctctgaagccatgtatcaactataatgcaggccagatttcctcccaactttatcaaagtctccagtcagagacaatggtgtgctactactgtggaccatacacaggacttagactcggaacattgtgataatcataaatctgctcctgggtttgtgttcaaccttgagtatttttatagacatcatatctttactgataagatagttgtattaaacttactttcacaatatttgggagtctttggaatgagatattacacgacagaatttttcatagatgtaaatggccatattatggtattattacattttaatattttgttaaactttaaacttaaatgcagagcttgtgtaggaaattgtttaaagaaaaattttatttattcctcattcaacatccagaataagataaattttgccaaattctaccaaaagaaatgaagataccaatcaacctgtacactaaatattgaatcaaaatctatataaataaaatgtaaagtaagtttccaaaactagctttatcagttcccttactatccagaatcagatgccttatataacctatatacacacaaatcgctttagtaaacgttaatattagtttcatactttgtataaaatttaaaacctcatctggggcttgttctgggagtgtatccatcatttgtacccttgtgccaggaaaagaatgtttagattccaaataactgaaacagcagcaaacttttgaaatacaacctacttaaaatttggctattgttaacctaggctttctatgcagttggcaatgctgaagactaaataatgattttttaaacaagtatgaaatagagaattggtgttagggtatatgaaataaaaagtacaaagaggttaagaagaaataaaagctgtccaaataaactaacattcctaaaagtggacatctgctcagatgaatggctacaaataacatgcattttatgtgaataaagactaaaatatggaaaaaaaaacaaaataagaaatatacacatacgtgtgtttagaatcagaaattcaagaaggaacaaatttgttttgaagcataagcaaagcagtaaagaaaaaagttcaaaaaaattggaggagtaacattttaaaaaacatttctttttaaaggaatatttctccccatcctgtaacttaaatgtatgcctaccgtggaatttattaaggtcaattgaattaattgtaaattttaataagcttaaaagcaagcacagctaatttgaaaatgggtaggggggaattcccatggcaataactttgctttctaaatttgtccacagggtaattttctttcatccttcccattaaagatttgggtacgaataaaccagtctcaaagaaacaccttaataaaacaaaattaactcaatggtagatttttgcaatgtcaggttttcatagatccatttattaaaatatatcataaatataaactaaattttttaaatgtacatgtaaacactttttttttcaacctatgtaacggcctggcatgtattcggttactctgagagaaaatgttagttctctatgatagattccttctagaatcacgtttccctagacactagtgaggaaaaaattgggctttggaatgaaacagatcactacaaaaaaatcatagtgctacctcttacaaacttgatgatcttgggcaagttatttagcatctctaagcctcaggcttcttctaatgaaaaatggaagagataataatatcaggattttagtaaggattaaatgagatgactttacataaaagaacctagcaggtccttataatgttagcgttttataaaatggaattatttcccactgtaattgattttataaactaagttgacaggctggagagacagcagattatactcaaaacaattagttaaaataaaatctaaattcggaatgcttcctatattcaagggattgtgccaggtgtctgatttatatgactaatttcttttaatcctcataactaactcataacaatgagttaggtgctacagttgcaaacattttgctgatgagaaaaatgaagttgagaaaagtgaattggccaaatatcaaatggtcaggcactctgtagccctcacttggactattccaaaggtttcattaagtaccttcgaaaacagtcacaaaaatgaaaattggcataatgaagtaaagtacaggaatttcaaatgtggcagtaagcagtagcagtagtaacaacaaaatgtccttaaaaaaaaaaatgcaccctgcatagctcctggaaaagatgccctgagagtatgattacttatcacctcccaacttcaagcctctatggttgcttgtgccatttctataaaaatctgtgatttttaaagagaaatttcatctgctaggtatcttgaaaacaatctcattacaataaaagacttcagacccacactaacttggatgatcatattttttggcttgatttgtggttccacaggaattcccacattctatatattggacaatatattgaataaggcaaaaaggatataacttcttcaatctcatttcaacctgcagggcattttgtatccatagtaaagagcaggggcttaaaccacatttcaaatctctaccaattttcctgattttgtagcatattataagttacatagatttgtgacccacaattagatttataattaatcaaattaagtgcttgtgataattttcaatagctttataaaataattataaaatggccatttgaatcttattctatcataagatgtactgataatcactaaacagcaagaagtttttggccttaatattttctaatttaaagagggaatgatttaagtcttaatgaaaagccttttttctaccgaacatttttttctttttatcagtcaaaatatttacttccaaagattgagatggtgacttcacgcttccaacactttaattatagttattttttatttcacaacatgaatgaatagctctcttaatttatctatcaaatattgagccaataagttcattaagagcccttaaattagttacctattcttcatttggcactttctcttgtaatcatcttttatgcatgttaattttaagttataaaatattgtcaaaaccttggtcagaatatactatcaatagaatacaagaattctattttctgtgagctctcaaaatatgattctatttctatctgtctatctgtctatctatatcatctatctttctccatatatctatgtgtctatcatatttctatctatctatctatctatctatctatctatctatctatctatctaatttgtttcttatccctatctgaaaacaaatttataagcatggtttcttgaatggagcagtagagaagttaattcagttacaccagattgccaaatagaaaaaaagttgaaataattaatgtgaaataaatgcagaaattcaacagattataaagaacgaagggtgtaaccatgcaactccatggacagtgactacacatacaagcaaatgaaagcagctgaccacgtacccacacaccttggcagaggtgcactccacactcgtcggccaccaccaagacagatgatctctgatgttccttccagtcgataacccgaagagcatgagaaggtcagagtgtcaccaatcccaaagttgaacccgattcgactaccatattgaggaatgccaggatcttcacaaggttcaaggttatattctgtaaattagagagaaaaatttccccgcgggggaggaaaggacaaagaaaatgatagtggttacttttaaaggtatattcctattgtttttagaacctagtcatatatttagaagggactatatgaatagctatcagaacgtacaaatggcacacatacgtttctttttctgtgaaatagctaataacttgataaatatttgtatttgtggtattcaatatagatgagaaaatatcaccttctgaataataaattaaaaaatagctatttatcttattgttttttctgcattagaaacatttttatttcatatattttcgacttacggcataagaactgcatattttcaaacacaaaataacatttgaaatgaaatcatttgcacttttgaaatgcttttgcttaatattttacatttaaatgataaaggcccttctgcttcttgtatacaagttcaattaatgcatattctgaaaaacacatgatttgagatgcaagggtttatgtgagactgaagtgaccacacattgaaaactattgtattatggatttttacaggaagttttccccaggcaataaatgaacattatgaaaatgaacaagtaaacagtcttcagggtatgaaaagtagagttgattaaacattataatttatatacagtcctaagaagaagtagcttatctaaaaatattcccagagcagttactgtgtaattacaacaaagaacaagaggcattgcttcatgttgattagctaatattttatgctttaaaaaaattacttggactttttttaacattctaggttatgttcatttactattcatgataaaatactttaatgattttagcatccaaacatttccacccaaatactaaaatagttgtttaagaacaaggttagtgcttgtatcattttaatgttagcaagttggcataagatttacttattaatttgtgtctgtattaagaaatagctagttgtgttcattcaaatggaaagtacaactctaagtggtgggaatacattttattttctttggtctcatacaattttttccccctgtaatctaagtaatactattgtctataagtgaggttatactagaagaaaggagtaactatgttaatttgattatagattatagattatctaattccagaataataaattactatttattaattatatatataattaaaatatataatttattattaattaattaagatcattaattctggcctgttgactatgccttctatgtgttttcctagacacataaaacaaggaaatcactggattaattctcatttcatttttgagtttaactgaaactttaaaatatatattttaatttttattttgtgtttactaggcattttagctagttttgacctttgttagaatttttcaggattgtaaattaaagaaatgtaattattgtacttccggtagatttatagcaaattaatttttgctttttcccttatttattactagagataatcttcagtgtattccaagctttccttaaaacttgacacatactactttgctttcttctttttaaaatttttcttctctccagctatttttcactgttttatcatcagttatgctcatatcttgaaaaattgcttttttaaaagttactgaatgagcccttttgttttttattttctcaccagagaatgttatgttaaatccttcatatgatattgaaaaatctgaaatgaaacgcaattgagccctgaaatttccatagagaccagcattgattgttggaggaagatctgaaccagtcaggcgtgccagtggttgggtaaaactgccattctctgtgatcagtaagtagtcatgatggtcttccaaatgaaaagtgtggaagttgaactgcacacctattaagaaaaatagaaacactgaatttacaggtagatcagtaaaacacagagagttactgtcaaactaactattagccaggactttacttataattaaattttctgaaaatgagaggcattgctataaaatattccaaatatatgttatattattctttttgtgtgtgtttttccttcaggttcattataagagatataatgagtcatgtcttggaaactgcttgaaaatacaatttaaaaatcagtgcctgaaaaaaaattacctggttttctgaaaatttcaagagaaatacatatcttttgtttataatagaggtgcaatttcctggcaaatactgcacatgcctccattttcttctccaatcccttcgaccaacataaaagcaatgcttaatattatagcacttaacttccaaatatgcttgtttattttagaagagaaatataaaacaggcatagggaatgctatctgttagatgaatgtaattattctccatttatttatttgtcacacatttcaacctgtgcatataatatgcaaaaaatgtatatataagtgttcaggtcaatagttttcacaaatcggacacctttgtaaatagtatccaaatcaatagccacaataataccaacacccagcgccttctttataaaacttttctgtcatttcagttttccagaagtaaccactcacttaacttctaatagcacaaactaatgttgctgctttgtatatatattttgtagtttatagattggaatcatatatactcttttggatctgacttcttttactcagcattaggtatgtgaaatttctcaatatcattgtgcatagttgggggtggttcatttttggtgatgtatagtatggcattccaccttgtgaatataccacatctatttacctgttcaactgttgatggtcacttaagtcgtttgcgttttaccacaaatgtaaatggtacagccatgaacatttatcttttgtgaacatatgtgcttttttctgttgggtatgtatctaggaatggaattactgaatgatgggagtaataatatgtgttctgctttaacaaatactgttttacaaagtggccatgctgatttacatctccatagacaacatggttgctccgtatcttctccaatacttgaaaatctggggctttttaatttgttccattccagtgagtatatagtggactccttgtggtatcacgttagtatttaattacactgtcaagaacacatgtaaaagactaatgacttcacacaaacacacacactcaaatacacacaacacactgtgtgtaaggagccatctgaaataaaaaatggctaccacagggatccttcccttgaggtgctttatttttttgtacctcacctaaaaaattaccaaagtatttgctaagaaaattccaaaatatcagagtatgacaagtaacattttttattcatttacattttagttccaaatgttggaaattcttaagagtctccattgttttaaaaaaaaggggacagaaaatgagaccaaaacaaatgattgaaaacacaaacattaacacaacaaggttatcactgcataatgaatcagagatttcatatttgagaaatatttgaaatatataaggtactattttcaaattatttttcaaaatgcaagttttggtgttttttttttctcctctctataattggcagcaatacaagagcccttttagagggggtctaaaaattaagtcagtttttcaaatcttctatagtataaaatcagtattgatactagacagatgaaaggaaaatgggattttgacatagtaaagagaagatgctttgctgtccagattagctcctgcaaaataatgtaagggtagaaagttcagataagtcagtcttatttctgctataaagctaagaaaaaaatagttagacaataggagagtagattgaataaaagagaaataaatcatcatgtatactatattatttttattttttaagaaaaatgtgcttgttctgaaatacatagaatgaattattttagaatttcattaattaattatcggtgccaacaaagccactgttaagtattatttacctttctgagccctactttctccatatttaaaatggggttctaatagagttgttttgcaatttaaataaggtaacaggtaaatgacttcgcacagtgactggcacagaaagcgttattgctattgatcaatttcccaaaatgagagctaatgtttttcctgttatttagccctggccagccgctttgtaaaaagaagctgctgttcatcaagtcatggattaaatggtaatatttgctttctttcactactgcaaaacaacttaagaccttcaaagttgtgccaaaggtcaattaatccaaataagaaaatgatcctgagaaactactatattctagtcattatagaatataaatatttagaagactgtaagtaactcatggcctatttgaggaaaaaggtacatgaaccaaaattttaatcattctgccaaactggttaatacaactcaatataggagcatagaaatagaggtaactaatttgtcaaaggggtccgtagaggggtataaaaatgaccttcaaatgtaatgacaatccaggtctggtggctcacacctgtaatcccagcactttgggaggcctagacgggtggattgcttgaatccagaagtttgagatcagcttgggaaacatggtggaatcccaactctacaaaaaaatacaaaacttagctgagtgtggtggcatacacctgtagtcccacctactcaggaggctgaggtgggagggtcacctgagcccaggaagactgaggatgcagtgagccaggatcagcctgggtgacagggtgagaacccatctcaggaaaaacataaaaaacaaacaaacaaacaaaaaaccccaaagcaatgacctcctaaatcaaaaaggcaatgactttcaaaagtgagaagtttgtgatggtgaggacctagtatagacattttggaaagaaggggattagacaggaaaagacaaccaattctaataaggcagggagaaaaagtcagtggtttcaatatcgtaattacttctagtaagaatgctaattcaagatgcccaataaaggtaatttatgtttatatatatatatatctgtatgacttgtacttaaagtcaaaatagcgttaatatctaggttttagttatagtcatgccaccagctattacctaaagggtgccatttgactttttttttctaatatgtaaagtaataggtgtggactatgctttatttaaggacagtccaacttctaaaagtctaagggtttttcctgatgtacatttttttctctaggtttcccgtaactatttataattagcatcctgacttctacaacgtgtttaaggaaaatctctcatggtgtccttgtaaataaggagcaatgtaggctgaatgacactgtcgttaactgagtttgaaactactgaacaattgtatgtgttcaaacaccttgacttaatgtttaatggtgaagagattacagatggtacatatacattttattatttcttaaatatttagatatttagatttatccttgttaagattcttataaacccttaaaatactaatgatcatagttatataagaacatctgactacacaatgtaaatgtaaatgaaatgtaaatcacttcaaaatgatctcataggaactctgaatcaaaatcaatatgataaagcataacagggatacatataaaagcttgcactgaagatagaaaaaagcaattgcataattatagaattttaagaattgaatttatctgtattttaagtcccagtaatctaaaaagatgatttagattactacaaacttcttatcaattagtattataacatggcagcaaaaaagttaattaacacaaatactgtcttcttcaatgaaaataattttagtgttacactgtgccatgatgtgttcagttttagaaaaccacattttaaagagataagctggaatgcatccagaggaagttgattagagtggtgatgaacatgaaaatattatcttatgatgaattaaagaaactaggagtgtttagtctgggaagaaaagacttggaatcatgatctagggatagaggacatgaaaaacatggtagtctcagaatggtgagttgatgtgtttgaggagcttttggttggagcaaggattaggctgccttttttggtatagctccagagagcagaacagggataacggctgcagaataatttttaaacaatcaaatatggaaaaaatgaggaatttgtcccaaggagtacagtccttatcaacagaaatacccataacaggccagttcatcatgtttctgaaacaccatacggagaagctagttttctgagtaagaggttagactatattaccttgaatatttctcccaactttgaaattttccttcatgtaaatttgctacactttggaagagttgtacttcagacaaacttagttggctcttaaaagaaaggcatctacgtccgcatctcttgccatgtaaatacagatttaattaacatttgcaacctgtgaagatgcaaaactttaagtgttaattaaacctctatttacatagcaagcagtatgtagccctccactcccttctataatatcagggagcttattttaaactctattaatctattgcacactgggataatgggacactttggttaacttccagcaaagagtcttctattaataaagattgacaaaaatcacagtttacaaagtcttctacctcattcctgctattcagtaccagaatactcattttaacaacgctttttctcagtaatatttaattcattgtagaaatttaaccaaactagtcctgacataattctcacctcctgataaaatatatatgtaatttaatcaaaggcaaactttatttctgaaaacgcaaatttaaatgtattaaacacaagcttttagttttaatggtaataacatcttctcattgctaaaagtattttgttttgactttttctttttttagattttctatattaaaatcaataaatatattttaatagtaaaattcaataatataatacatcaacagagctaaaaaaaagtacttttcaaaatcagattttaaaatgaataaactagctcttttagaagatcaacccatggagattttcaagtaaataactttaatatattttttgttttcatatattagaatggtcattttaccattcataagttgttaccttgataaattacactgtatcttgataaatttgaaatacatacttatacacttctaattataagcaatatttgcaaaaatggatggtaaattaaacatgagtaattgtttagcagtccctcttattaagcagtaagaaaacgaattattaatcatgcaaaattgtttgttatagattcctatagggatacatgtcattctttacagattcctttcaaaacagtgaagtaggttgtaaaagttttatgagtggttgaatctcatgaatgaaccatgtttaatactacagagccttttacttatttgtttatttgtaaaaggacatttattaacatctaccttatgcagagtgcaattttacactctatgtgagacatatctatagctctgtactaaagaatctgagacacagatatttatagaatggctataaatttatatagagaatataattgttacaaacaattataaacaagtatatataaacacatactagttgctttaaaaattggcttagcatatcagagcatctcatattcccctttgaactcctgaaatccatttcttaacactatgccagaaactaaagccctcttgtttgaggttttcctgttacaaaaatttcaaatgacattagtttattatatcaaaagtaaacaaatctctcatagcaacagcctggtaaaaacatgagcacaatataatactatagaagagtaaatataatttttgtggcaattatttaaattgaaatgtgttttagcatattgtagtactgatctgtttttgctcatgcaaaataacatgtaaaggaaagtgaaataagaatagactcaatgaaaattcagaagatagtccaattattatttcatgaggcaaattaccttttccatgggttacatcaacagtccatgtacaattcagagaatttggataaaattccgggtaaccaggtgataagattgttccactaggccctctaacatctcctccacataatgctgaaatacaaagaaacagatccatgtgatcagcagtgagagagacagagggtgaacaaatctctatctcctctcttgaattgagcagtcgcattatctttgcttatgctacctcctagtaataacaggtgtgcatgcagcactagagaagaaaagtgtactcagtagcatctgagaattagtgcagtccccaagagaacatggctcaactttccaagtttgaatttgaagtatgtgctaatacatttctaattataagcagtatttgcataaattggtggtaaattaaacatgagtaattaattgtttaacagttgctcttattaagcactaagaaaatgaattaactgtataaaactgtttgatatagattcctaaagggatatgtgtcattctttataggattcctttcaaaactatgaagtgagttgtaaaagtttttaaggctgcttctgggtttctttatttttctaggaaatattatgaacaaaaacgagttttgtaagtaattattctaagatagtaaaaataagctaactatctgaggtcaaaaaattaatatttgatttgatattcatttctttgagaacaaatcatagtttacaaggtcttctatatattcaacagctatcagtgcttatggtatgccaggcaattctatcaaaattgaaagctggaggaagcaaaaaaatattgcttagtaagcatttttattctagtgtgagcagagaatttgttgactccttattcactttcacttggaaaggccaactcttagacacagccaagggcagtaagaatcatgaatgccacatgtacccttgtctaatttgatccttgcccactttcttagcacactagaaaagtgagttttggttttgtctcttccaaaaatacctaacactataacatgatatgaatttgtatgatgaatgaaatgtctactgagttaaaacctacagtctctacttcaaaggactatatgtcatgcagctagaataaaatttctcactgaacacaagcatgaaaattaagggagttaaattaatttaaaatacacaaaaaggtaacaaaaaagagagatgcaaactttcagaaaggacaccagacatgtgctcctgagcatgcacatttatgtgtgtttgtatatctgtgtgtttgtgtgtgtgtatatctgcgtgtttgtgtgtgtgtatttacaagaagttgagagaaagtttttctgtatatcagtattctttcaaataaagacactttgtcaagtatcctacttcttgagaagtttcttgggaatttttttgtctgtaagctgtacctatatacatatgtagaaggggaaacttaaagggacattctgcaggtaaatgcataaatctatgtaacacataaacacatttaaacatttaggaggaatggtcaacaactaatataacaaacattcgtactattactttgactagaatcagatgggaaagtatagaatatatttttataacaaagtgaagatttctgttatttgaaaataattatcattggatgaagacactgaagagaatggacttaaagatggaatttcatagtaaatagtgaagaaagaatgtaatttaagctttttttataagatgaaactaaaaacatgaagacataaattttattttatatctaataaaacaggataaaattacaatgatttactaattcttatcagaaacaagagcaaactgttttgaacttaaaacgtagctggcactattctgcagattttatttatgttaactcagcccccacaacaaccttttgagaaaaatgctgtaattattcggtttacagatgagaaagcaagcaagtatagaaataactcaaacagtctagttccagggtctatgatctcaggcagattcttgaattgtgtggatgttttttccacattaagagtactattttagcaagctatgatgttctttactcatgtttgattttgtagcacttccctcacaaatgatgaatatataaaaaaaattcaagggcatcctttattttctcagagattcatttaatcctgtcattttcaaatcacttttttttttttttttgagatggaatctcgccttgtcccccagggctggagtgcagtggcgctatctcggctccctgaaagctccgccccccgggttcacgccattctcctgcctcagcccctccaccgcagtagctgggactattggcgctcgccaccacgcccggctaatttttttgtatttttggtagagacaggtttcactgtgttagccaggatggtctcgatctcctgatctcatgatcctcccgcctctgcctcccaaagtgctgggattacaggcgtaagccaccgcaccaggccttcaaatcacttttttaatgcacctaacacctattgtgtcagtatccttgtctatgttctttaattgatctatctcttccgaattctcatttgccagtagctttgtatgtgactgaaataattctccatcatcatcatcagcctcatcattttcatcaacctaatgacatttttcatttttctaaatgagattattttacattgccaatgttttaagttgcatttgttttatattgtcagctgcaagtggtgatcataatagcacttatctatagagttacttggaagagaaaatgacttaaaatacataaggcacctgtagcagtatcagcatatggtaaaaactcaataaatattagtcatcactattattaccaccatactacattgtctggtttgctttgtaaatcagctaatcatgggatataaagacatcacaaaagctgatgtatgttagagtgaagcacactgtacacaagcattaggcaacctaggtcaatcaagtttacattcttggagcagggcaagaaattctgtttgtctgtttctcccttgttacctcaggagatctggactagttaccgctggggcaaaagtttctgttaaaggaaaggtctgatcaaatctgttcactaggtgatacaatagttgagttcagttcgagtcaacagaaaaaaattattattaagtacctgctttatacacagcttagacattttttaaataaacataattcagtccttgtccagttgcactcaacatgaaatagaaatacaaaagaggaggccaggttataatagaggttaaaagtaacatgatttgatcttttaaaataaagatgcattgtaagaatgcaggacagaaacatcactgaaaaggatggatttctcaaggttaaggacattgaattccatgattagtcatttgagctttcatttctaagcaataaaaagccattaagaattttggatatggaatataacgtgaaataaccttagtgagaaacatggggttggatggaaaaatgatgagggcctgtgctgctcctgggaaaactggatatatttgcttttattattaataaaagttaagcgtgttgatgcgcttgccattactttttatcttcctggttcttataatattgcctccatacctttctttcgtggtgaatgctcctcattcaggccaaccttgtagctttattagggtctggcaaacataggacttttaaaccaccatggtctgtctcaaccacagggatagatgagcacatgaccaagacaaagtcaatcataatgggcccttctccttcactagagttactagtttagatatggatgaattgaataccttccctgggatttttctaattagagtgacagggaagagctctccttcctctctgaaactgaagatacagggctatcaacttccatctgcctgagagtgtatacactactgtcaattcctcatacggaaaaagcctgtctgcagcgtaagagaattatgtgaatacacaaagaaaagtctaagtgtaagatggagaagttcttaaaaagttttgaatttatgcttcttattagcaatgagagttatcccaccttgccttttctactagttgaacagttgaacaacagcttctgcttttatttttaaataccagttagagttgggtttctgtcacttacaatcacaaattaaaggaagatgttttgatgagttgtttaaatcttcatataaaaacaaattagcttaaaactgtttaaaaaatgatggcactgacagtacttgaaaatttaatcataaaatgacaaatggtatcttccacttcaagaaatagtaagtgtagaatttgaaaatagtactgtaaatagaaattaaaacccatagttaaataatatatggatttacattgagtgtgctttttgacaagcaagcatgcaagcacttcccaatcttaggagaagcagtttcctccactggatttcatatgtgtttcctgaaaaatgaagcacttctgacttattctcatagaaacaaagaagcagtaaggaacactagtatgctatttattataactaggaacttgacacaacagggtagtcggagtaaactaccatagtgctgtgtagctggttagaatttttgtagacaggctggccttctatttgaactgggacatgttgccattcaaggcaggaaacaaatgctgcatttttttcaggactttcttctcatacaaatttggcattttcaaggctgttttgaaaaggtccacagcatgttcttaaaatagttacacaggtgagttttaaatatatatgcatatataaacagggtagatacacagatagtatctttaggcatggagtaagtttggctgattagcaatagtctttatttcatgaatggtttgataacataaatttgccagaaatcaaaagaacttttaaaaaacctaaaatatttataattatgttaaaccccatataaaaaactacattgatttttctgtttataaatcagcatattttgcatgtcaaatgagttattaccatcacaggttggaagtggatgactccaccagtggtttttttcgcatagaaggggctcttcatgactcaacctgtatcctgaatcacaactaaatgaaacagtagagccaatggagaaatcatgaccatagcgacggccatgtacaggtatgccagggtccaaacaagaatacgtgttcactgtaacacctggaaaacaaagggaagaaaataaagagtaagcttggtgggatttggagttgctgaaaataattcctagttcttcaaacaattacaagcaatgatttttacaaataaaggtactcgtacttcatttttaaaatcagcaatttatttaataaatttgttttctcatttcctaccagtaaggatcaaattcaggtcatttaattacataagaacttgatgaaaatgtataactatctgtaaaactttgtattgttataaattttgtgtatatatacacatatatcacaataatcatagcaatagtcaacatttcttgaacttattatattccaagcaccattctaaatattatacaaaattttctcatttaattactaaaggaaaaagaagagtagaggcattttgcaaggtatgaaagtatgaacaccagaaccgttctaagtataaccaattagcacatttcttctggtggttaactgttgttgttatcaatagtctctagtacacttcagtgtctcctgatatcttccttgcaatttacaatccctagctgagatcataccatgacaatgtttttcctttaataagatatggcttctcaacctcggcactgttgacattttggactggatacttctgtgttgtgggtgtcctgtgcattggagtacttttagaaacattcctggcccccacctgttcgatgccagtagcatttctccaatcatgacaataacaaatatctccaaatactgctacacatttcttggggtgcaacaatgccctcagttgagaaccactggtacaaactataacaagtaattatttttttcttcctatataggatatttaaacaatgaataactactatttctatattccaaaattagtcgttaacatttttaagactgtataattatattaaatcatatttatatgagaaaatatttatttgtattagctacccaattcaaaaatgaagctaaacaaaatggtacaaaatagaagtttaattttaaagacggaaattgtacattttaagtgtatttatcaagcatattcgtttcatctaaatggtgttattttaatgagaaactaaaatacaatagagacaattttatcttcaacacatctacttttatctgctaagttcctcttctaagtgtgaccattatttttctaagcacccagtgcattttttttttttttttgacggagtctcgctttgtcgcccaggctggagtacaatggcgtgatctcggctcactgtgaccttcacctgccgggttcaagcaattctcctgcctcagcctcccgagtagctgggactacaggcacatgccaccattcccggctaattttttgtattgttagtagagacgggttttaccatgctggccaggctggtcttgaactcctgaccttgtgatcttcctgcatcagtcttccaaagtgctgggattacaggcgtgagtcactgcacctggccagcacccagtgcttttaaactctcattcatctttgattcctcactcttttcctccacaaaatatgtctgaaatccattctcattgaaaagcatcatgtcatgtattatttctcttaccctatccaaggccctcatcacctcaagtttatgaaacaaacaataacatttagcatgtttttcagtatctttcatctccaatttattctatataaaatgttggacatacgtatagccaaaacatgttttttcattgctttaataccctatggctaatggcaccatgttcaaagtcgtcaccctgaaaattaagattcccaaattagactttactattctaaattgtcattatctcccaatggtcattttttatatcaatcagataagtctcctcattagttttaggctttgtctcataggaataccttcagttgtcctcttaatgtacacaatcttctcaacctttaacagaaaagtttagacccccttccttcaggtttcaatttcccccaatgttccaggtgatatataactttcctttacatgaacctctaacattgtagtaaaatcgtctaaaatcagagaaatgggggttgcagtggtcatatacaatgtaaattacagtaaaatttaattattcaaaagtgattgtaatgcttttgttcattgacctatagtaaaggtcaatgaatatatggggttaataattcatttgcctttcttggcttttcaactgataaagtaagatgatgtatttcttttatgtcttccactgtggtgcattgatctaggagtcacaaaataagtctaaagaaatagttcataattgattgacaagcaaataactcaaggcataatgcaaggcaatggaaatgttgcaaaattgagaaaatgagaaacatcatgaggaactgatatcagtattatttattaactgatagtcattactgaatactaaaacataattggtaagtagctttagaagattttttttttagacagagtctcacccatcctacaggctggaatgcagtggctaatcttggctcactgcagcctccacttcgcttcctgggttcaagcaatcaattctcctgcctcagcctcccaagtagtgggaattataggcatgcaccaccactcctggctaaattttgtatttttagtagagacgtggtttcaccacgttggccaggctggtctcaaactaatgacctcaagtgacactcccgcctcagcctccaaagtgctgggattacaggctttagtcatcgtgcccagctagttttagaaaattcttaaatgttggcaatgtacataattttcagaagttcatgtctgcattatatcaaatgacattaacatgttatctttttccttattgctttatagagcttgtttttttaaaaagtagaaattcaaaatggacatttttcttatttatgtaatacaacgtttgaacattttatgtttctgtttctactactcctcccctcaaatatctattgatcataaattgtgcattcttttagatgtctaacattttcctaattggaaaatacatctatacgttcatatgaaaaatacatatttggagatgaatatatgtctatacgtttgttctgtatccattttcaattttaaaatttgtataatatttagatatccaagacttaattatagtcatatttcaagcaatacaacataataaacagacgtgattttttcctggggaaaaactatagaaataaaaataaattatattcctaaagtctactctatgttgttataattttaatgtgttttgaaacctctaaataatcttatctttttttttttttttttgagatggagtctcactctgtcacccaggctggagtacaatggtgtgatctcggctcactgcaacctccacctcccaggttcaagtgattctcctgcctcagcctcctgagtagcttggattacaagcacacaccaccatgcctggctaatttttgtatttttagtagagatggggtttcaccatgttggtcaggctggtcttgaactcctgacctcgtgatctgcctgccttggcctcccaaagtgttgggattacaggcgtgagccaccgcacccagccaaccttatcttattgatagtttttgtaatccccatgttttggggggcagatagaatggggtaaaaaaaaagaatggggtaaaaaatataacagaaacctggagtacaaacaatggtggcattgcaagcattccttcctataggattttggttgcctggggaagacaaattactttcactttcaatgaatttgattaaaaaaatagaaatacaccaaatgccaaatatattgttaatgttctcattagcaatctactgattttgaggtttgtgaatggttcatttgaaaaagatagtttagttaccttcagcttgggaaacagtaagaaagagatgaatgaaaaggcttttgttggtttcttgataagaaaggatttatgatgttggagattatttcacaggagtaaatataccacaagactaatagaataaaatgagagaaggtgatttcttaaagacaaatttaaatacaaagttatttcatcttgttagatttgaccaaattaataacaagtgtgtctctaatcaacctcaatgtttgtcagctctcagcttccactttgccttttaaggcactagccctcgaaaataacttggactatgccactaaggacctgtaagtgacaaacttgctgactgaaggtatgcatttgagcaggacttcttatttttattccttatctgactagtttttgtaggagaaatgtaaaggctatcatttattgagaacatactgcatgttaccagttatgctgacacattttgcatgttttgtttcatttaatctttaaaatagtcctgtttttggtaaagaccacataccttgggtggaatgggattgaatacgatttactgggtaaaggatacagcaatggactaaaagaaaagctgcctgcatattgatatcaattaattactagtgagaattagttttgaagtagatttttctaaatgactaatttgactcaggtttagtaaatacatgttagactcaaaatatcagttaaggcactttagttcatttgaacccccaagtatgtgtgcattctcttattgcattttaccatgatttttacaaaatatgctttcatgccacaaagctcaaaataatgggaagttaatatagtcaaacaatactgtagataagatgatttaaaaaaactaatggatctatattgacaattattttaaaaacccatgagtccattgactatatctattgaagatagatgcccaacagcaaatataaaactatatatttcaaatgcagaaatctcttcttgagggggaaagggtcataattaacttgaatattaaaataaataatataatatctgcatttgaaataaagacatattttaataaccctcttaagtgtgttgttagattaatttatcaaaagtgcatttcacgtaaaagtatatggctatgcattcatgatgaaaatgtacacatatgtaaatttatatgtttgcacacacataaatcttatgcaatatagccacacatgtgcaagatgtttataaatggaaaaaaagcccatttctgtgttcatatcagcatcaaaatgtttcaaaaatcaaaatattttagactttttaaacaaaaccatgagatttaataggggttataatgattccaacactctgaattatagcttgtattaatatagttttctcgacttatattaatcatatttgaatatatgtatatacagtttgccttttaattttaatattattttcaacattttatgcaaaataataaaattaaatattttaaatggaaaatatgtgcaattagtgtgaggaaactataaaagaataactgaatttgtgaagtaaatgctaaaaatgttattgtttatatatatcttagactggcaattactgtctattatctgtttttcagaactatacacaaataattggtacaaaacctcattttcaaataatgatttgatgcttctgatatttctttagtattttgtttcataatgatattagatagatattgctggaaaatctattgcagaatttactaaaacacacaccttataaagcattaacattcttatagatgaaggaaagctttgatttaaaataaatagagctaatagttccattagtaaaactataataatacaaaaagtagggcaaacagaatgaggaaatcaaaaagttttatcattacttactttcataatgaatcttgaaaccattattggaacgactgttgtctgttgtaaatagaaggtatataaaattactgctactaaatagaaactggggcacttgggtgccattgtaagatccaagcaagggtgacagaagatttggcccatcatgaacttccagaacatcataattcagttcagtctgaaatctaagattaaaagacacatgtgaaaatatatttagaattaacactatatatggaaataatgctttggactgctatttaaattcctatttaaaatttttccattttatattataattttctttagcttatctaatatctaagatatcatttaagacaccatcatttgtgaatgccaaaggtataagctcttattcctatgaaaaattattattaaaaagttatgtattgttcctaagattctttcaaatattataaattatcttataactggactgttcatgaaccaaacatatttttggaattatctttggttgtcttccttatttttatggaaaaatatgtggtttacatttattttcaatcagataattagattatcatcttaataacacacacatttcaaatttgacatctgcttttataattattttttattcaagtgttttttattgatacataacatttatacaaaatttttggacaaatctatttctgcctttaaacatgtgataaagtttgtatttgaaaacaacagttctaagtaggtagtaactaatgatgatacatttgatgtttattaaagtatcagcagctctattaaagacttcattgacattagtttttgtaatcctcccattaaccctatggtgtagctcatattattaaacccactttccaagtaagaaaaccacagccttaaaaacttttttttctttttactttttttttttttttttttgaggcaaaatctaattccatcaaccaggctagagtgcagtggtgccatcttgggtcactgcagcgtctgcctcctggactaaagcaattcttgtgcctcagccttctgagtagctggaattacaggcgtgtgccaccacgcctggcggatttttgtattttcagtagacacagggtttcaccatcttggccaggctggtctctaagtcctgacctcaagtgatccacctgtcttggcctcccaaagtactgggattacaggcgtgagccactgcacccagccaccttcaaaacttaaatagtattacattatcttaaattacaaaagtaggcatcaaaaccaagtctccctgactctaacctctattctatgatgtctgatcttattagatttttggttgttctgctgttttcaattctttaaaacatattaatttattttataaacgtcaatcgacacagggctacttttaacatgtataacatctattttaaaaaaatagcattttgtattcttcccttgcacttcagggttatactatatcctgaatctagatccaagatctaaactgtggaaaaatgtttatgtgaactcatggagtactaaaatatttttcccttgcctatgatgatcttgaagcctcgaaaattcttttccttgctttaaccaaggttttcctacacatctttcagtttcagcttaaatatgcgaacagcaagacctcttctgtcctcacattgtagattattttatttcctattctactgccacaatttactgtggcttttgtgatactaatcacagtagtgtttactttttagacaactgtcttccttaaaagtctataaactccatgaggttaagcagtgtgtttttgtcaatgctttgcatatagtagacactcaataaatatttattggatcaaagaaaaaatgaatgtattttacagttaaaaatgtctttcttttctctagggtagttactagttttacaaaaaagtatccaacataattggatgctttagtattaaccatgtatttttactcatgttaaatgcactttccaataaagtttcagtactttatttctccagttttatctccagtacactttaaaaaataatttttagtttgaaatgcccactaattttcagagaatcacttttactatcatacttgccagtcttttgcagtatgtgttatgagattaaaccactttattcctcaaaaccaaaatgaataaaactcatatgtggtcaaacaaatgcccagaactaattgaatggattcaaaaaaggttagaaactctatttcattatatcgtatcagtctctgatattattatgaacatagcatatgacacgttagtcaaaattaagtatataatttaatactgttcaggaagcacaactgcctcctattaatcagtaaacagtatatgtgaatttttgaagtgtattttacttctaattttgtgacctggaatatactgtatgtgtttcataaatgtttcaataatatggtgtagagaaggaaagataaaggaacactaagttctttaaataaatgatcatatacttagaaattgtcaatctaggccaggcacagtggcttttgcctataattccagcactttgggaggctgaggtgggtgagtcacctgaagtcagaagtttgagaccagcctggccaacatggcaaaaccctgtctctactaaaaataccaaaattagcaaggcgtggttggcgtctgtaatcctagctactcgggaggctgaggcacgagaatcacttgaacctgggaggcggaggttgcagtgggccgagatcgcaccactgcactccagcctgggtgacagagtgagactttgtctcaaaagaaaaaaaaaagaaattgtcaatctattatttggttgctttgtagtcagtctactgtgaatattgaaattggagtttgactttgatagctagtcagctgacagcagccaaattaaaatgcacggaagagtcagggattacttcaaattgaaacataaagagacttaattcttaatagaatagcaacattaactggtgatataaagaacattgttcagtaccagtgaatctttaaaaagaaaatcattgcagatttgccctgaggaactataaaaatacattctaataacaagcaaaatgggatagggttacacaataaattgaatttctttcattttctattttaaaatagttgtataaatttctcatgaattgcctcagtctcatgtttgtttatgaaattaaatttattgtatatgctaaacaaatattatggtagcactaaatgttattatgaatgaaattggatctaatcttattcaatttttgttgtctttaaaaaacattcttgatgtaatccaaacccttcctaaccaaattgagatagtcctcattaacttaaaaaaatattctctgaaagactgatagtgatagcatgcattcagggagctgaggataggaaaaggaaccgaaaaatacactttgaatgatggatagtaaaatgaatacctcttagactcaggagctgctggatattgagaaaatttagaaagtgtgggaataaacaaaaacaaaaattcctttgcagatctgagagtaagaattgttaaatgtttggatatgttaagaagaggtaaatggttttaaaaacatgtttgttggtgttattgctattttgttttgtattttacaagaaatcatatttcttgtagttttattgacaagctgttgagacaatctcaaagagaaaatgaatgaataatatattggtaaataatattactttctgtaggttaattctaatcattttctccatttgagaatatagaaaaaaactacaaaatagctatgccaccatgttaaatatattatctgatttttacaaattttgttttcaacaaatttaaatgactcacgagtagtggaaagtaagtgacatgactctgtaataaatcatttcttggaaccagcttcttcaagaatattctcagaataagaggaattattaaagagttggcaactagtgtccttacaagagtttggctggaaatcaaaagagaattagatattttcaagaatccattatgtgttagatactttagaaataatattcgatttcttaaaacaatctttagaaaaaaataaagcaccaagacattataaggccactgatcaaggaagtgataggcatatttatgtctgatttcaaagtgattattttatgttgctgccctaatggataaaattcacttatttttaaaattgaaataccttgttcatccctttgctactgagttactgctaaccatgtgatatctgtgtaagatgtagattattaaaagaaccaattttctggcaaagcatatggaatatagacagccctcaaccaatacctcatacccttaaaaggtctttagagaagaacaaatggaagaagatatttaaggatttttttttcttagctccaattcaataatcttataggatttggggtggaagtaaaggaaaggcaaatagaaggctcaagccctaaaaggagcgtttatttcagtttacaacatttggaagaatttgggacttaatttattttatttatataaggtagattcaaaggaaatatgtgatataaatgtgctctgtttattctaaaatactgaaaataccattaataaattcttaaagcattgtaactcctgattattccagtgtttgggccaattaacaaagaatgattttttaatgattggttttagggaagtggaagaagccatgagattataattgatttgagtgggtaatttcaggattaagaaatgaggcacggttgacaagtccagcttggtgatgtccatggggagaagccaaaatctttaaactgtaggaaacattcctcacccaaggcctattctgatctacgcacaagactgattattgttcctgtgcataaatcctacattgaaaatcacttttcaattagactttcttacttctagcctaatttaaaagatttgtgtcttaatcaatagataaaagaataagaaagtggcagagtaaaacgtgctaagtaacgctatagaaattaatttaagtttatgcctatttaactagtgttacattttattaaaatggctggaaagatttcaccagaaagtcaggtttgaaacagtctaatttcaaatataggctatacagtacaagtgaattcatttggagaattctaaaggtatctaaacaagataggcaagcagcaaagaggcctatattggcctgttggaaggacagcagatgcatgctaagaattttggacagagaaaatagtgccttcaaacaaaagtccaaaatcaaatgtcagagtacggatgccctctgaattgcaggcattgtttggcaatcaaactgttcatcaagtgagccactcttagtagcctactttgagctgaaagatactaggtgtttatttatttaatgatgattaatgactctcattagcaaatcagcagatgcttttcaacataataatgcactttgtgttcataaagcttaaactaattttctagtcatattatttttggcttatatagtattttaaaactgaataagagaataaaagaaaatgttattttaaaataacattccagtttcagtcagctagaaggtggggaaggggtgaggtcttcataagaaaacactgctgtttgataaaaaataataataataatagtatgtttcaaaagaaaggcaagatccattcctactccccaacatcacccagaaaaacaaataattaaatcactctgcataataaagtaataggtattttgagacttaccctgctatataccaggagcacagggaatggggaaatgaggactgaagattctagatgcagaagagattaaaaatgaagaacaaacaaatggaagaacattccatgctcatgggtaggaagaatcaatattgtgaaaatggccacactgcccaaggtaatttatagattcaatgccatccccatcaagctaccgatgactttcttcacagaattggaaaaaaactactttaaagttcatatggaaccaaaaaagagcccacatttccaagtcaatcctaagccaaaagaacaaagctggaggcatcacgctacctgacttcgaactatactacaaggctacagtaaccaaaacagcatggtactggtaccaaaacaaagatatagaccaacggaacagaacagagccctcagaaataatgccacatatctacaactatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgtgcagggacttcatgtctaaaacaccaaaagcaatggcaacaaaagccaaaactgacaaatgggatctaattaaactaaagagcttctgcacagcaaaagaaactacaatcagagtgaacaggcaacctacagaatgggagaaaatttttgcaatctactcatctgacaaagggttaatatccagaatctacaatgaactcaaacaaatttacaagaaaaaaactaacaactccatcacaaagtgggaaaaggatatgaacagacacttctcaaaagaagacatttatgcagccaaaagacacatgaaaaaaatgctcatcatcactggccatcagataaatgcaaatcaaaaccacaacgagataccatctcacaccagttagaatggcgatcattaaaaagtcaggaaacaacaggtgctggagaggatgtggagaaataggaacacttttacactgttggtggcgactcctcagggatctagaactagaaataccatttgacccagccatcccattactgggtatatacccaaaggattataaatcatgctgctataaagacacacgcacatgtatgtttactgcagcactattcacaataccaaagacttggaaccaagccaaatgtccaacaatgatagactggattaagaatatgtagcacatatacaccatggaatactatgcagccataaaaaatgatgagttcatgtcctttgtagggacatggatgaagctggaaaccaccattctcagcaaactatcgcgaggacaaaaaaccaaacaccacatgtcctcacttataggtgggaattgaacgctgagaacacatggacacaggaaggggaacatcacacaccggggcctgttgtggggtggggggaggggggagggatagcattaggagatatacttaatgttaaatgacaagttaatgggtgcagcataccaacgtggcacatgtatacatatgtaacaaatctgcacattgtgcacatgtaccctaaaacttaaagtataataaaaaaaaaatgaagaacagtttgggataagagaggggattggagagatacaagcaattattcctgtgatgagggttatcaagaaaatttagaacagtgtaggcttattcaatcttaaatgactctggattgtgcaataatcctctttcattgtcacctgcattatggttttcatgagaatgaaagaaagtgatgcaaatgaatagagtaatgttgagagagtgcagcagcctcagtgtctattatgtaggttgattctggagacagaatttaagtccagaagtgaacaaaagcacccccaggcattctttgaaaattgaaggagagagtaggtttcccttgtatgtgggatggcggtgaagtctttttacttgaatattgaaggataatgactggtgagagtcatctgggtgatagatgctatgaactgatacaaataaaatatgaaaataacatattttcaactaccgttgcacctcctgatacaaaataatgtttagtccaaaacaagaaatacgaaaattatgtacttgacatattatataaatatatatgagattaattctgatagattgacaaatatgcttgtttttcaaatgtaaaatactaaatttaaaaactgaaaaatatggatgaaatctttgtcctattgttccaaatcaatacatatcatgctttatcatgtattccaaaccaaacataattctgtgtgctaaagtaaggttggttaattttagttcaacattcatggaaaaactatattggaaaaagatttaatgatgaataactaagatgtttttcaagctttctaaaattgctatggcaacataagccatgtaaaccaataaataggggatacggttttaacagaatagcaacaacaacaacaaaatgccaaatgaatgtaaatgaaaatttttaaaaatgtgtcaattattgttgtgggctaaattgtgttcccccaaatttctatgttgaaatcttaatccctagtagtactcagaatgtgacagtatttggagaaagagactttaaaagggtaattaaggtaaagtgagatcatatagatgggccctaatccaatgtaactggtgtccaggacataaacacacacacacagaaaatcacgtgaagataaatggagaagacagccatctacaaggcaaagggagaatccagaataaactgtcttgtggacaccttgatcttgaacttctagcctccagaaatgtgagaaaattagtttttgttttttatctcatgcagtctgtgacacttggttatggcagccctaactaatatagaaaactaatatagccctagtaaaccatgtagattataacaagatagtgttaaattaagtttagcttaaaacctcctgtatactttgaattcccgcataagaaatggcaacctaactaagagtataatcttgtaataaatagctgagtgtcatccaattacagaaaccaagcttcagtcagtaacaggccaccgactgatcagatcatatctatataagtcaaatgcgaagttgtaactaatcaagctgtttctttatgtcacttcctttttttgtctataaatactttctgcccatttgccatacgaagctcttcatatttactgattcaaggtgctacctgattcatgaatggttctttgctcaaataaacatggttaaatttaagttgtctaacgtttttgttttaacagtagaatgaagccatgtgaaatgtttaatactctacctctgttcaaagtggaatctgttctctcccatgcaaatgttaacactagcatggatagacaaattcaatgaaagaccttttgagttaggaaagaatcatgttaggtttgtaaaattcaatcttcagtcaataataaatatattctgctgtacttatatgtttttcatgtggatctaatgcttaaataagtttttttgttcatctgtttgttttttgaagaaaggggttgggagatgagagaagtcaatgatataactgagagattatatagataaatctattttgatttgtaagttgtgattcaataacgtaagagaagtttcattcttttaagatttaaaatatacaatattatagccttttacaatatagtttatttgatcagtaatactaatttttctaggggaaataaaaggtcagctgttccaccattactacatactacatgacagtcattttcacaaggacttataggtgaaagcatatggatagtgtgcctaagtgtcttagactgcactagtgttgatttgaatgtgtttacagcaccttcgcctcttgaaacctagcagagcagaattcacaggcccttcaaagtatagaacaactaaactcattaagttaaaggtcacatgttcacatcttagtagtacataaagcaaaaaggtcgatcttgcatatttcaatagtactgatacagcattacacaaatagaaaattaacttggaaacacgctgaaaggttaaaagggggcaaacagatggaagcattcaaagcacagcaattgactattacaataaaattaaacattcatttggtaaatgcaaaagagaatgtcaactaatcttttagataatattttctttaaaagtaggaaaaatatttgtgagacctttcaaatgtaattttgatagagtgtccaggttcagcttcaatcacccactcacaattcaaagagtctttgtagtatcctggccatcctggtgagagaatcactccactgggagctgaaaaatggccaccacatggggctgaaaaattaaatcagacaagtaagaataaaacattcaagataaatcgcagatattattcttaatacaaacaatttcaaaaacaagtctctgcatatccttattaaatagttaatactatttttgaaagcaatggtacatctagtcaattacttctgttaaatgattatttttctaaaaaggtaatttacttttcaaaatatgaaatagctacatttagcatgtcaggtaataaactgctcctccttaagtctctgaataataccccttacatatattcttgtctctccatcgtcatctttgtattcaaagcttgaaagaaaacctaagttgttagctttggtttctttctctttgattttcttacttatgttatcaaattctactaattcatcttatacactaacagtttgtgcttccattttccagagtcacttcattgattcagctttttaccttatttctcatctgctattttctttcttactttagtccagctgtcagaataagctcctccaaattatagtttcatcataccatttcctagacatctagcccctttcttagatttgtattttgatctcttttctttttaatatcaaatttaaatattctgtttatcatttcaaatattgtatcctctgatttccctaagctcacacacaattgaaaccacaatgatagcattgtagttccagtaagtactgattaggtcatttagtgtaaacgcctcattttggagatgtgtaaaccaagttttagagagagcaacttgccaaagttcagtaggttgaaaggtcttaaaatcactttgaagtcaacttttgcaaaacaaagccttagtactgaccctcttccattatttcctgtattggtaaatgaaaccgccatctgtccagttgcataaactagaagctagaagtattcagttttcatacgtatattatttttaccatttactcccatatccaacccatcctcaagctcactcttatttctctagctctatggatttcatcttagtttaaaataacatcatctcatccttgaagtatagaaataacccctgaactggtctctgcatttacactattctccatgctacggatacagtgatttttttttctttttaattcacaaagcttaccatgcccttcagtgacaactttctgtgtttcctgataaggctctgtgggatctagctgttgcttattctctagccttgtctcagaactcccctccactctgcagcccagctacattagcctgctctactttcaggaagtatacacagaagagaaaatggaggaaagagtgtttaagatgttgaaaattatcaggaaagaaaaaaagtctaaatgtacactagatcaactttttaatacatcattatttccagtgacttttcacatcattttctttaaatcttcccatttaaactcttacccatgtgtttatatttttcctagcttatttctttctgttttgccttacagaatttctgaaaacaattgctctagacactattttactcctttttattctttaaataacttgatggaacccaaatgaaatagcaaatatttataaattggcctaggaattaaacattactgtaaaatttctgtttttagtaaaacattttctatgtgaaattgccaaaagatgttatttgtatgacagagaactctcataaaaactaagttttcttccttaatagaatttaattttgtttcctaaaaagctagttttaaaggaggccatttttatgaggattatttactcttcctagttatgatgactcataattaggtttcctgtagggttatgtatttcaaaaatgaaattatgtgcataatagtcacttaaattaccatattttacaagacagagctaagtattttagtgacagaaagccccaaaatacagagtatttctgacataaatctttattatgtcagcaactcatattgttccagaaaagtattcactcattcattcaacctaatcatcattagacgaggtaattagtcataaaattaacaattgagaaatgggccataaagaattaaaaagtaaagtactgagaagcattccgactagccactcagtgcaaaatgtgagggaggcagagttagaaggggtctttaaagtgaagaagtagcctaaagatgtgattgattgctgtttgtttcctaaaatgactctctggtatagtgaccctgcttgtggttcttctcctacttatgacattttctgaagtagctactttctcacttaaaggattggaatttcccaaaattattcttccaaaagtataggaaccaactttctagaaggtctaccaccaagaggggagagacatgcttatatgggtcggtcagcaaaagtctcatcattaaagtgactctcgggcacatgagaggaaaatgtcagtaaggagaagccatggtgtagcaacagtggaagagcatggaatagataacatgcaggagaaaggagaggctaaatgtagaaaaacaaaacaaaacaaaacaaaacaaaacagctgaagaaaaaaaaagctgcctagagttttggaacagaaacctaaaaatattattattattattatgtatttattcttttttttttgagatggagctttgctcttgttgcccaggctggagtgcaattgcacaatctcatctcactgcaacctctgcctcctgggttcaaacgattctcctgcctcagcctcccgagtagctgggattacaggcacacaccaccacacccggctaattttttgtatttttagtagagacagggtttcgccatggccaggctggtcttgaacttctgatctcaggtgatccacctgtcttggcctcccagagtgctgggattacaggcatgagccactgtgcacggcctaaaaatattattaattgcaaatattttatctgtaaagaaatctaactgcaatatgagtaaaatacaactaaaaaaaacaaaaagttatccaaacttaacaatgttgccatatccatatattgcctatgtagttaattatgtacctactgaaatttaagaaattcttatacatttttttaaccaaaaatgagcttgtgtatctccaggtgtgaagatactacacttcaaaaaggatttctctaaaaaacaataactactcttggctgaacaagaaaaatttggaatatacagaaagcaaaaaggggaccaaggccataaagaagcattttcaaagtcccattcattcattcatcttttattcatttatatttcagttcttcgacgtaccattgtctgacaggtgtgtgcctgtgtggcatttgtactacttctactaatgaacatttatggaatgctttctctgtgtcaggcaccctcagattattttatataatgctcaaaataatctagccagataagtacactattatagataagaaaactgatgtgtaaggaatttaaataatttgcatctgaactgtcaaggatttgaacaaaggcagtttgactctagaaaaattctttccaactgacattaagatagtctttttcctttcctcccagtgcccatggtgcaaaagacagaaacattaacaaaacgtaaaaatgtcaagttctataacaaaggtatgtccacagtacaaggggcccagaaaaggaaatgaataaatgtttcatagaagagattctgtttaatttgaagattaaacaggatgaaatcaagaatgaagatgaaatcaagaagaagaaatcaagaagcaccaacagaaaaactgagggaggatattgtaaatgaaagcaacatcacatgcaaatgcatagaggattgagttagcataaagtaatgcaattaccttttctggggaataaagaagtgatgagagaaaattagaaaaggacctggtttgctccactatggaaagtgaaccacggcaattgaaaaattgttgacaaaggatatgtatatatacacacacacgtatatagacaaaggataagattttcatttaagtgaaactttcatgtaaaatggattgcagcagtacacctggatttagtgagatcagttagaagattgttgcaactatctaggaaaggcattatcagattatgaaataaggctgtagcagagataggcagaatatacaaggtatttaggaaggagaatcaaaagcatttattgacgtgcaaagagtgagtcagaggaaggagtctaaactggtccttgagcccttggcatgtgcaatagggtggatggtgattccattcaccaaaatgggaaacacggaacagggaggagtttcatgtggaaagttaatgagattcagtgctaaaatggaagggtctgtgaaatatcacaagaaacaagagaaaatagaatctggagctcttggctatcttaggagtgattttcaaaattggttgatgttcaagtttccatggaggttgaaggtaaaggtgaatatttagaggaaaaaatgaaagatgattgaatatgcaaccctttgaaaaaagtattttaatttaataaaattaagtaggtattgtccaatagccagtatatcactacaacactgagaaaagggctgagatgaattatttgtttgggtcttcctctcacctaagtgtgtgaactgggataattttagcaagtaaaagtaataaattcctaggttttagtggaaaaatagaatagtttatatctcagttgactgagataaactttagtttaactaaatttagacaggcttcttcctgattcaagaccctccttcccacctccctttcctagagcatttagtttagaaaacttgtttgttttttttcctctgtacctttgaaatgtacattttctcccagcctcttactagttttatgacccaggaatgtctttttcaatgacctgggagccatccctttgaagcacccttattttccactctctctgtgggagagtgggaacctaacttcagtaagctccaattatcaaacataaatgatctaatcacattggccaacctaccccctaacatgctccagtacttttctactagctcaccccaatgcttaaaaaccttctccctctttcaaaggagttgagttcaatttttcttctcctttgcaatagtctcaaatagtcttgcttgcctgtttaactctgacagagaaatttttctttgacacacagatgatcctcaacttatgatggagttttgacttatgatcatgacttgatcagaaacatggactaggtagcggcagagctgagactcaaattcaaattgttaaattcctagttaagaattacttccacagtagatttattatttttccaaaagaaatgtttatttaaacattttatactctctttaccattggtttagtgaagacagaaatagatgaaaagtcagggggtagaatatttagtccaaaggtttttagtataattttgaggctctaaccccattttaagtgcctctccactactattattcattttttaattaattaaataaacatttagtttctgctactatgtctaagatactgtgctagctgctgaaattgaaaaaaaattctatgtgatattatatctgccttcaagagatacacattttctacaaggaagattgatacagttaacatgaaacatgataagtacatgcttgagctgggtaagtagccttgaaatatagggcagggacaggtactgtcccaggggcattaggaaagagtctgggtaggagatgttgtcaaagaagagtttagattaaaaaatgaatacaagcaaaacaggcttaacagaagtgggacagaataggcagaggtaggaagtaaaaaacactaatctgtgtgggggaaagtcaagtggttcttgttgttacaacttattattagtggaggcctaaggaggagcagttcatgggggcctctggttacctgcagttattattgctttcaaagactttcaaacgttagtggccatctactgagcttgttaaaatgcagattcctgtattgtacttctaatagttgtaagatgggacccaaaaatctgcatggttgacaagacccccacctgatccctcaggtccttttattggttaggtatgtggaccacacaggaaatttaagggatgtgggtgttctgcagctccaagactccattggttaatctctcagttttctgggatgaggaagttatttggatattttagtgaaacacaggtcgttgcctttaattcttctttttgtagcaatgaaaacaacaatgagatatgtaaattcaatatagttcatttatctagttttatttttctaaggcctgaagaacgtctgttataaataatgtgagtttgagtgctggctcaattttgtcttactttaagaagaaaggatacattcaaagaacccactgtgttttaagacctcgatgaaagaatcagaagtgcttcagactgcattcagataaaattctcctgaataaaaatgctaaggagtgctggtactccacagcaggagatgctcttccatctgagaagtggtacttaggtgctcagaaggaagttggggaccatgggctaagctaggttttgatcacagggattttgccataggtgaattaaagaggtgaacattgtagcatttggtctgataaacagtccttctgtggagttgttcttgataaaatctagatgccaattcaaggacaatcagacaatgacagttccattttgttccttaaaaaaaaaaacttgctttatggttataggtgtggtaagtaatcaccaggtctctcaaacctcagcacactgcatcatggttcaaaaaaaaaaaattacaatgaacaagtcaggtatgtatctaggataagaagagaaagacagaaacatggtaattaaggagccaaaatagagtccatttccataactacttctatccctccctgtacccagctccacaaagattagaagcaaagccctgcagatggctattaaattacattattctatattagtgcttcaggagacgtagaatttaataacacctaaatacttaactaaaggaggggttcattgttagatataaatatatataaatgtgtgaatacatatctgtttataagaaccacaaatcaattctgatctgtgtatcaaattgttactctaattgcttcctcaaaagaactctctctaaaaagaatgtaatggctgtgaatgagaatggcttcctttcctctgagactaattgagattcaagagagaacctcttaccctcaaagggaaagttcatcaggcatgcaagtccaggcttgtcttcaaacagttctcccgggacttcagtcccatcctattcactcaaagaattctcttagatatcccattagggagtaggaaggagcataagccacagctatgcagggagttctgtgctgagggcaagggagttcttgcttgagtaagcattttatagaacattctaaagttggtgaagcaaaaacagaagactttttttttttctaattactgccttaaaacacacactgccaagtctctttctctcctcaaagagcatgttaagcagagcctctagttttcttatcacttctagtatttaaaaacttgatccagttcaatttaaaactgttatctcattctctccattcactcacccaaggtgccttgagtagcagccagagagacttggaggatagggaagagcatgctaaaggaatgccagcactttcagattcattcctctacttacttcagcacttggagtagagaaggtattatcacttattttatatcttgtcctcttccttttacctttagatcctgtttcctgtggtgagttagggctgggatgaggtgaaaggtcatagtcctttcctggaagttattgctttccttgcaaacctttgtctggtcactggtgcctctcttttgtcaggtatggaacatgttgattctcccatgagaacaaatgagttgtttgcaaaggccaagagtgaggagaatggcttctcaccgcacaattccctgataaaagagaagctcaaccttttgtagttgcctgtctgctcccatccctgacggcacaccctataactctgttggattgtcttttcctgtggccaagcctgagtaatttctttggtattcatttgatgcacaggaaacttacatcactgactaatcaaactgtttgaactaaacagctctccctctctccaacctgccagcttttcaccaatttcttttcttttgttcaataggcatagaaggtagatcagcaagctcattgtataagcaaatatccacctgggaattctctttcacacaaacatctccattctctaagagggattcttatgcagccctttccctcaatttggcttgaagataaggagactagcactttccctcctctaagaagaatgaaaaaccaaacaacttataattcaaacagttatagatagatgaatgatagagaaagacagatatacggattagatagataaagacatatagatctccctagcttttgctgcttagcacattggaagtgggatggcagaggttatgattgagataaaagaatcagctagaacccacttaagctctggaggggtgtcttgtccttaaattttcaagaagaggaatatagataattttttcttcttaactggagatctaagttgccaaagctaaagcagcaggaaaatttagttctccattttgttagtcacacatttattcctatggttttccttgtcaggagggctgcaaatataacaatgttcaaaatcatttcgagtatccacaagaaaaaggcaactttgccagtcttaacccagctcttagttaaatcatcagctttgaggcaatagcattcatcagactcttccaatgtatttcactaaatgtaatctcctttatctataaagcagacccatgaatgtattacatctaatcatattcaagaacatgatcatgtaatccagaaggccaatattcatttccatttttgtcacggagattgctttagatcaaagggggcactgctgactacagtgtaggggacatgtgagtcagagtgaggtaaaaaggacaagagaagcagaaagcatatatacatcagagccttctgagactcagaggagaaataattatgaggaaactaatggttgggcacaggtggactgaacaacaagctatttctaatttgaactacaaatttcagtatctgcatgggatctggaaggaaatgacaaggtactgcttaggggaaaaaaatcacagggaccaagtctctttagagaagaatggtatatcactttggcagctgtgttgagaatagaactgaataaaagcagagacagaagcagtgagagcagttagggggctacggattaattaaagccagagacaaaggttgctgggaccaagatgtcagcagtggaggtagtaagaaatatttgggttttgaatgatttcaaaggaagagctagccagtttttctgatgcattatctatggttatgacagaaagaaaggagtcaggaaagatttgataaagaccgaagaattttggcctgaatgactgaaataatagagttgctattaataatggagaaagtgagtgacaacagcaggtttagagtgacgtggggagacatatcagtttcagacagggtaagtttgagatgcctattaaacacttaagtgcagatgtggagtaggaagttgaacatataagtctacatttcagggcagagaaccaggctagagatgtaaatttgagagacagcggcatgtagatattgtttacagttagagactgattgaaaaatcaccaatgaaatgaatgcaatagagagcagaacatatccaaaatgtagctctgggacatgcacttaaacagatcacagagaggaggagaaaccaggaaaggagactaaaatgagcctgagtagcatatttaataaaataaaatttaataacatatataatttttagacttgtctaacttatttttccattaacagttaaataattgtataactttaaattattgaggaaaatttgattttaaaacaaaaatggtatgaatttcagattctataacaaaataatgaatacattaatgcatctttcatttttggtctgcaataaaatccttttcaactttcaatctacatgagtatagttcagtagcattttattttaaaggcattcaccaatgaataataaatctttatattcaggaactgtttccttctgtggctgcaacagaggagaattaatttatgtccaactgtcttgctttttaaaacagaaaactctagatgacttagtcctcactgcttgacacttagaaagataactttcttgttttatactacatctcatggcctggtatccctttcaagttcttttgggattcattggctggcttattactggcaaattcagaagcgggcattataaagtagaaatgtaactcagagagtagctgagaatatatgtcaaaaacttgctgtctctcttctcgttgttttcaaaatcagtacataatttattataacaaggtgaagaatttattcaccaagcttccaaggagacagaatgtcaatcgaaaaccatcagaatggaattaatgaatctttcctgggtgcagagtacagtggagtggattttctggtaacttgaggattatgtgtgtgacagagggactgaattcatgtgaacaaagacatgggccctggaaaggaaaatagaaagggagagaagaagagcttagtgatgggaggactgtgtgtgtgtaagcatgggggaagacagggaaataaatgataatgatgatggtggtgatgatttttacaagctatcttgaatggtgggtgagaagggggaaaagatggcctagaaaggtatttgagaagccttctgtttacttcattgtataaaacacttgcatcctaactcaaaaaaaaaaatcaaagtaaaaatctctgttatttatcaatgcttcttaaataactttggtctagttcctgagtctgactgaaatgaaatcatactagataactgagccacattaggagctaaattattagcaaaattgtactgtctcatggtaaaaataggataagacatgagcagaatatcaatgcaaagccaaaaggatattgcagagagtactttgaatttgaaatgatcatttgggggagaatgcacaattcaagatatgatgttccagctagactctaggtgctagaggattggacttaaacagtgttacacaacttcacaacaaaaaatagtaactcaagaaactttctcctgaaataactactttgcaaaatgattcttaaggccctaaaggatacccaatttcttgagacattggtgtgctttcttagaaggaatagaggttgctgtccaatatatgatttctgaactgcttcactggcctagcacaatggattgattgtggctcttttctaatgtccatgaaggtattgtataagctaatggaaacattgctctcagttgtcaataatataattttttgtattatttatactgtttttaagcacatatttatctataattatgtctgtataaaaagtgggaaaatacacctgtccattgggagggtagcctgcttcctttagcccatctaattcatttctgttacttccttgctcctgttaagcatttgagattatgattcctgatctgtggcattgggcattaggtgctatctgtagactcagattcaccaaaactaccatccagtctagtggcagttggcttcaccaacctagaggacataaatatctagatgaagttgagttgagtaaaaattttggaaagacattttctgcctgtgtgttaaactcacagaacaagttaaaagcaagacatccactaggaagaagtattaaaagattggataatcaaaagtacctgcaacaagatgatggcagaattacctatagctaatttaccaaataatcacagacactctcctttacaaactgatctcaagaatctggtaaagcaaatcagagctgagaaaaataagttaattatggctataattaagaaagaaagccaagtaatgatgctaagatcatttaaggtaatctttaagtggattgaggttctgagttttcaaacaaaaacattttatactgatttccattgttctgtaagttctgattaaaacaaaatgttctaccttctaattttaatacacaacaatccatatatatatataacttttaacaatgaatttgattttgaagaaaataaaatagaagtagaaatttagttgtattaaccagaaaataccaacatgtacctttaaaaagttattctatttgaaatgtttaatatgaagataatttaaaagtttcagtgaaaatcttaaggatgttaacgtttgttaacatttgtaaatgttggaggctgcgatagtgccccaaagatgaacaataataaataataagaaaaattttatctgtaaaaatatagactgtctacagaaaaaaggagacaggaggagtagcctcccaaccatagttctctatgtaagtgggagtggctctggaagtttcaggaatggtggggggatggggcaggtttttttttttttttttttaaattaggaaaaataaaaataagctgaggcatcagttagtctcaggctttaattgttagtacctaagtagaattcaggcaaaatgaaaggaaatcaatataaaccttaattagaggctaagaaatcaaacctacctgagttagttatagagttgacagcagtctgctttgttgggtggaaactggctcagaggtggtttgggatagagtagtaacctggcaagggccaccctaagattgcttctggcccactccagttctgccttccttggctccaacctcatccttagtgatgtttccaccttgctattgggtccacaaacaggcaggtgtgccaactgtgtgtcatttcactcacacatagagaaaaacaattcttgtccatcagaaacttcataagggttctcttagggatgtgtggagggcttattggcctttgtcaagttagagttctgaatattttatcttacttaattttaaaagttaaataccatttgtttttcacagatagtagaaaatctccctgaaattgctctacataagtagtgattcattaaattactgattgacattactaattacttttacctccaccatgaagctaggcaccaagcaaccccaaaaccaatgcccaagttaggcaaacgaggatccaacaaaattcaaacttacctagaagtggtctctgtatgtgtcgactgagatttaaaacaaatttcagtgcaggggagggtgaggctcagataatgtcatttcccagctgcaatggctcctgtttagccacagggtaactttggagctacttagcattatttaaaaagggtctaatgctctggacttctctagtcattcatcagatccaactcactgtgtcctcccctgcagtcacactgaactggctctattccttttgcctgaaacacacttttctctcatttcctactgttgcttcaaatactaatgtgtggccgtagggcgtggtggctcgtgcctgtaatcccagcactttgggaggccgaggcaggcggatgacctgaggtcaggagttcaagaccagcctggccaacatggtgaaacccagtttctactaagaatacaaaaaaaattagatgggtgtggtgatgtgcacctatagtcccagctactcaggaggctgaggcacaagaatctcttgaacccgggcggcggaggttgcagtcagcagaaatggtgccactgctctccagcctgggtgacaaaagcaaaactccatctcaaaacaaacaaacaaacaaacaaacaaaaatgctaatgtagatttttcttactggttccccaaagccggatcaaaaactatgttaaaagaatgaatgggctccggcaaaaagaatggtggaaaaactaagtattactatccatattatccattttccctttttactttagtccattattgtgtaactccactatgtttttaaaataccatcatagtcataattattgacagagtagcccctgctgaacccatactatttgaagtttgaaaaagaacactaaagtcatctagttctgcccacctgatattactaatgagaaagcagttagtagtaaaaagaaggaaagcattaattgaaggggccactaggaaaacataattacacggtctgggattacttcatcatgagacattatgaaaatgttcaatccaatgaaagtcatcaatatataggtaatgcttcaattaaatttgttgtactttggaaaattacatattaaatcttctcaatttatcagctagtcagtttggagacaggtaagaggaaaaacttggaaaataagaaaaagaaactgcttttaaaataatcaattattatatgacaatctactaaaggtgttagacagttatagttcatctatttcttagtaaaagttcatttgtatacttttttcctttttcttttttttttttttaagacagagtcttgctctatcaccaggctggagtgcagtggcgcgatctcagctcactgcaacctctgcctcccaggttcaagcgattcccctgcctcagcctcctgagtagctgggactacaggcatgtgccaccacacccggctagttttttttcttattaatattattatttattttagtagagacggggtttcatcatgttggccagaatggtctcaatctcctgatctcgtgatccgcccgccttggcctcctaaagtgctggggttacaggcgtgagccaccgtgcccagcccatttatatctttataataaaatagatatgtattattagatactatagtggaaggagaaattaaaatttagaatgttaattccttctgtggcaaatctaaataaaggtccctcatttcagtagattctaaattgatatactatgtaattgatgttttacttttaattatgatcatccttccttcttaccaacataatctgagatttcatatgagtgtatatatacaaaaataggccaagagcagtggctcatgcctgtaatcccagcactttgggaggccgaggcagacagatcacttgatatcaagagtttgagaccagcctggccaacatggaaaaaccgtgtctctactaaaaatacaaaaaattagctgggcacggaggcatgcacctgtaatcccagctactagggaggctgaggcaggagaattgctggaacctgggaggcagaggttgcagtgagttgagattgcaccattgcattccagtctgggcaacagagtgagaatcggtttaaaaataataataattccaaagatcatacatatatatcacacacacacatatatatgccttgaaccttgttgactatatttaattggaaaaataaaaactgaaaaaaattagcaaatgatgccttcagaaatcatatattttaaataaatgggtgttttagcttaaatgtatttattataattgatcattattaacacatttttgaaaattagtgtgtaccatgaatagataacataccgagaaaaaatgaatggaaactataaagtgtattaaactataactaggaagtatactatagagagtttacacatgtgaccaatatttaccattcattaatctttatcttttaataagagctttttttaaaaggaagcttctaaaaggtttctaaaaatttgttttaacatgaaaaattaaaagtgtaatttccttaacaagatatgtttaatatagaatatcaagaaatgttttaagataatgattatgacagtcctggtaggataatgtgtttcttgttgtggtttcttgtacataatgatgatgaggttctatttctcactcactactacacttacctccacattttggaatcagtccactccacattacttttccatccataagaatacatgtaattgtttctgttccctgggttttaataaatccttcttcacaaataactgaaattgaacttcctaattgaaagttgtccccaaaccgccgtgcattgattggtattccaggatcagggcattcattatgtccaaatgctttagaataatatgcaaagaaaaatacacaaacaaacaacattagccagagagagatccttctatattttggaaaagagagagagagaaagagatattttaaaaggttgtgtttatttctacacaagtttttatttatttactttaaatttggaggttctcctctgaccttacctgtttgcctgtgatgtgcaataaatgtgaatgttttaaaatgtgaattacactctaaaattataaaatttcaaaacagaattatttctgcttatttctggagaccatgagactagctaagattatgaaaatatttccagtataagctggtcagaatttcaattaattaaaatgcaaagcaattgacagaagcattagtatgtattcctttggaaacttttatttatttttctctatttccaactggaaatagagagagtgagtctcatcttgagaattaaagtgaaatgtctcaatctagtatgaaactgttacaactttttaaataattttccatgacatttattttctgccatctgggaaaaaggaagagagttaattctttcgcaattaccatgttccaagcactgtgatatgttattatctcatttaatatttagaatagctgatgaggaaagtattgccatctattcaaaagagtaatgttagactcaggaaaagttaagtaacttgcctaatgtcatagaaatagggcttcataggattgaaatgtatcccctggaccggattttaatttcttctcaacaacctattgtatcttggcttatttgtctcatgtatctcaggagaacaggagttcttgagctcagggccactatcttattctaccttgtttgtctcacagtttatatttagccaagttacagcaaatagcaggagtataataaaaatgggtttatttgaatttttcatagattatagattacatgaacaatccaaatttttctctgtattcatctgagtgaccaattgtgtattataaaattttaatgtattacaatataaatggaagaatatttaaagaggcaaggtctacatgtgtaaaatatattttatgagatgcttataacttattattatattcatactgcattagtacatgcagtgattttaaattttctcactaatcatcactttgatgctggttataaattgtataattttactatctgttctccttattttaaatgaaacagtgcaaaagaatattaaggtacgttttagaatacataaaatatgttttatatgtatacatatttctaattattattttattttgtaattttaaaaactcaattttgattaagcagtgtaactctaatatagagtacctggtagatattttttcagaaaaaatgaatctcattagtaagcattaaataaaataatttgcacattatcaattaaattatttactatagaacagaaccaggaaaagggagacctatttccataataccctgaaaaactatcaacattaaagttaaaaatattatgcatttaagacaaaataaaaattatagatagatagatgcatatacatgtctatctttagacatgtacatgaagtattttttaaaaattctcaaagcagtcattttatataagtttctatgacacatgtcaccgctaatttaactttaataatatgcaattacatgtttacaatttacagcgacactattcaccactagtatcactttgaaaatacaacaactacactttgtctgccaaagcttaacattgaataggtgagggtgggagtgaagtgtgaaattctttttataaagcaacaggaagagctggaaactaaatccttttattatgtgacacttaaatattaactcatccaattggtcaatatctgacacagtgtaaaagcttcaaggaaaagcaataaaaattactagtattctatggcttcaggtatatttgcaaacagaagcattagtatctaagtgttattaatccactaaggtttttttcttttttatgtgattcatcttttttctatgattataaacatttttgcagataaataatatttaacatctcacacaacaacataagatgtcaagataattgttcaaaaaccaactaaacaataatggctaatgtttattaagcttttactaagtaatatgtactctgtgctaaattattcacatgcatcacctaatttattctttatagcaatccattgtggtttcactaatgtgagtactgtggctcagttataaaacctaaaacaaggctaagatccaaagttaattatttccttttctatgatgctactgtagccatgtgattttttctttggaattttaattctatgccatgattagttgtttaatatctattggtgcatgaatatctttaagggaaactctatttctcttttatgttgcatacaaataacaaagtatgtgatcaataataggtttgggtttatgctaagatataaatatgttggctgatataacaattataaatatattggcttacataataacaatatttgaaacatatttccttgatattgggcctctcacaaaaaaggaaatgtattaatataatagagagtaaaatgtgattggaaatgaaggaagaaatgaccatccttggcacaatgagatttacagcttttacaaattttcttaactaggaaacaagggaaccaatatacatgatcacttttcaactcaaatttatagaaatatattatatgggaaaaaaacagaaacagaaacttactgttgtaagtgatgttaaagccacgtcctgacattgagtggtcagcctgaaattccaatcgcagtatgtgactattactagtaagatgggaaggcacctcagccccagtaaaggttccaagaattggggattctggagagtcaccatctttaacagcaaggaaatcaaactgggattccaggtcaaagtcattgaaagaaagatgtatccggctccctggatcagagattatcgtccagatgcaatttaaattatttccatacccttctgggtaatcaggagaaagaactgttcccattggtgcagtaaagttagacaggcagggaactggtgaaacaggaagattatgaaatacaataaatattcaaaaataatatttcatcttattttgtcatattctacaattatgataatcaattagcagtataagataatattaaattatgtaaattataaaacagaacaaaacggttaccatttttacatattgaaaaaggcaactagtactttggataaacttaaggctctacccttaaataatgcacaaaaatataattggaataatagcaattttttgacatatatcttgtttatgttagactgtataaagtgttcatttcagtgtttaaaaagtgaaaaaatatacagaagttcccatagaaagcaataaggttcttgaaatgattgaagacaaaaaatattatgtggatattaacagaacaagaatccggtagctcagaaaacactcaaggggatggttatcaatgtgtgagttccatttctatggtggcaatggatgctctgatagtttactacacaaataaggagataaactaacttctttaacagccattagtggctaaaacctgaagaacagctaaatgagagctcttgccatcacactaaaatgaagtctttctcctccagtttttttaacttttaaaaacatgtgatttgaaagttcacatagaacatttagaaagcagaggaaaaataaagaaacagaaaagaaaatgacatactactcaaaggaaatcaaagtttaagtattgatatattatcttccaaagttttcattacattttttttttttttttctgagacggagtctcattttgttgcccaggctggagtgcagtggcaccatctaggctcactgcaacctccaccttccgggttcaagagattctcccacctcagcttccggagtagctgggaatacaggcacgcccaccacgcccagctaatttttgtatttttagtagagatggggtttcgccatattggtcaagctgatctcgaacgcctgacctcaagtgatccacctgcctcggcctccgtaagtaatgggattacaggcgtgagctaccgtgcccggccttttattacatattttttaaaaaattgaattccctacattttgtactaaattatgttttccttatatttaatatgtgagtttttcaagtcgagtttttaagcaaaatttatacttattagttaaaactctcctccattaatttatatggacatataaacattaattgaactgttcttctagtgtttgacatttaaaattgtattttaaaatttttgcaatataaataacactgactctattcttgaagaaagcttttttgttcattatttccttggtatacattttcaaaaaaagcacttagtatgacaaaggatatgaatttaagcctcaaaacattttgctaaatttctgatttaaagttattttgacgttattgaaaaataacagaaatatcagagaatacaacacccgtaacagtataaaatattgtgattattttccttctcctccattgataagaaaaatgataactcattgtcttaactcgcatttctttgactactagagaagttgaagatttcttacttttgttagacattttcattttcttttaaaaaattatctgctcataaactgatcatttaagtttatgatctcttagtttataatatgcataaaactttctcattattttgtaattttagtattttggcataaattatttgttttaatttgaatattaaaataattgttcgcatttcttacaatcttttagcatcatatgttttattaacattcagacattataccaatatctatttatctacacaaatataaaaccataggtatagctgcatctaccaacagatatatctctctttataacttttatcattttatcattcaaaaatattttgtactttgaatctatttattttctgcataattttatgagttgaactgaagcttgcaaactgacagtcattggattgaattcagattgcagatgtgtttggcttgatttttttttcttctgcccccataaaaatttgaaatcacattgaaaaatcatcatatttcatatttaaggggaaaacatcttttattctagcttatcttgaaaagttaaggcaccccagtttcctaccacttccaaaatgggtgcacacatacttactcctaatccctcttcacactgtttcctgcctgcatcctggaataatttgatcctataactcctgatctaaattaagggtcggaaatctttttctgaaaaggagtaggtaataaatgctttggctttgcaaaccatacgatctcctttgcaactatttaattctgcaattgtagctggaaggcagccatgcacaatcagtaaatgaaagtgtttggttatgttccaataaaactttgcttaaaaatacatggaaaggaggatggatttggcccacaatctgtttgccatctcctgatctaaatgatccccacttggagcaagagctaaccaaagacacactttaatggcccttatcagatagatagatgcttatatcatactttaaattcttaattatataagatgcagtttttatgtaacttcccttcacaatttgttagtaccacactcataacttaagatgatacttaagcatccacagaagcactttgcttttacaaaattcttgtatctactcctgcctgttttattacttagctatatgtcaatacaatacgtcaagttcccagaaaaactatgttagaattttgactaaaattgcaaagcaatttctgtataactcatgtatttgaaatagtgatttatcattcaggaacatggcttctatctgtatttcgttctcataaaattttattttcttgtaagttttataattttttgtatgagttatttgaaatatgtgaggattatttatttgtattttataattgtattttctgaatgtattctcttttaaatgtatttccaagttagttattactggtatataaaacattattaatcgctacatttttatcatatatcaggatatcagacctaattttaaaatagtaaaaaatgttttctagtattcaagaatgttttaaaaattggttttagtcagcaaaattttcagtattttcactaaatgccttttggaatctgttaaaatgctcttaaaatatttttatttttgatgtgatatattacactaatggattctccagtattaagccaacgttgtcctcctagaagaacacctagaattaaaaattgtcaacaaaagtattttgaagtattactaagctttggtaaatcgaatcagatcctcctaatatattttcttctcttacaagaacttcaccaagtaatcttggttaaagataagaactaaaacaaaaggggactgtgaaggggacgtatgcacttttcctcttctagacttcctgaagagcaaacacaatatattgttattagggaaatttctgccagattctaaaaatatccacttcattttaatgtattgaagacagcatttaattgagcacaccaagtgcgtgaataggcaatacaaattatacttttgctgtagttaaactgcaatatcttaatgtatttgaatacattattttaatccaagcatattgtatatcattaatgttaatgaattgtattgtatgcaatataaaaaaatggcacctcatgcattagtgttaacatctacaagcaaaaataagttagtgcattatacatacaatataagctttaaatattttaatgtttttgattgcaaataaacatatactatcttattaaaataaatgagtctattagaattcattcagatgtataatttccataagaagtatgctctctagaaagtataaaatgtcatgaaataaaatgttgtaagaacacacgtaatatatattttgccattaccaagtgaactatgttaactttatttaaatctgtaataaaatttataatttggcataagcacacttgttaaagatagcatcacaaagtgctactcactcaaaaataattacacggttgcagctctttgcaattaattacaaaagcaattatatgcaaggacagggtaacatatgctatctggaagcaaagcatttggtactcacagatacagatgggtatgtttgcagaccattggttattctcttgacaaacaatggatttctctccaattaattcaaacccaaactggcattcaaaccttaaaacatcacgattagaaaatccatcgccttctctaattccatataagggtgtaccaggatcaccacaactttctttctcaatttctggaaaaatagaagataaaagtcaccttccaagggttgcaggcatatgatacccataatacaagttaggtagatatatgctctttgttgtggagatatttcagaacaaaaaataaatatattctccaatctttttttttttggccattcttacaggcatgataaaatgatctttagataataattagtatatttctttctttttatatatgaagaatctgaggttatcagagctaatgaggtgccagaggccatgtacttaacagaaaaattatgataagatctcatattttctctctgtactacatatatacataaatgtacacacacatagacataaatgtatatttccctcaaatcccaaagacttttcttattcttgtcatttctacaggatacggtaaatccctgaatcatgaccaggacacgagggaacattctctgtgtctatactcctacagaaatcaatgaatacctctcacctaagatctcttccacactctggtactagttggttgaattattttcccaactagacccccccccccaacaaaaaaaaaatcttctcaaaggaagcaatcagttttgaattccaaattactcagctatgttccttaataaatgtttcttggatgagtggaaagagattgaaaaaaatattttaacaccattaaaacaacctttgagatgtatccaaagaaacttcaaatatctgggatcatcactgtttaactatgaatgttagcagtaaattattgtggtggttgatttgccttaaaagtcacataaaatcttagtaatacagttgtcttcaaacaaacaatagtaaaaaaaaatacaaattaaaaaaatgtaactttaagataaagttatagtctctcctgacactcaaatatcgacacattgctagttcctccgttatccactagcatcgatttaatgtgtatctttccagttcttttttcaagatgtataattccacacagacatatctaatatgtaacattatagaaacctaaaaattatcttcacaaaaactatgcagtattgtttcatgtacatcatactttaacttttattatactgtcaatattattttctttctcctttttaaccaaacactatgttttagagatactattgaacatccttgtatccttagcagaaatcatacatgcatttaaacgtttctttaaaaaactggatttgattttatattttcttagactttttttatctatcagggacattggtctataacttttttcttctgctcttcatatctagttttaatatcaagggaagatgttagtaattttccacattttactagtctttaggttaatttgtaccagaaaaaaattggattcttgcatggatgagtttggtagccatctgagtaccattttttttcttcaaaggttattttcctatttaagtgtttcatgttgttgtttgttttttcttttgcttgtttcttggagagggttttgggccaatattggcaacttataaacattagagaagtgacatttttcaaggtttgctggtagtttagttgtaacagaattgttacaagattttttaatatctcctttataaatatgccataattatttctgacttctaatgctattagtgtttactttctggttttctttcttcatatttacaaaaggttgtcagatttattaggtggcttaaagaaccagtgtttgctgttgataaattgtttttttgtttgtttgtttttttgtttgtgttttgagacagagtctcttactctgtcacccaggctgaagtgcagtggcgtgatctcggctcattgtaacctatgcctcccaggttcaagagattctcctgcctcagcctcctgggtagctcggactataggtgctcgtgccaccatgcccaagtagtttttgtatttttagtagagatggggtttcactgtgttgtccaggctggtctctaactcctgacctcaaatcattcgccctccttggtctcccaaagtgctggaattacaggtgtgagccactgcgcccggcaaattctattgtttttattttaatttaaacatcttttctttttatatttttggattccatcttcagttttcttttggattatattgctattcttttttctgttttcttgagttgaaatcttagaacttttttagtatattttcagcctttcttatttattaaaaaataaaataaatttagctctaaattgatatggagagattttattgttcacttgtgaaaagtttgtagcttatgttttggtttactttgtaactcataaataatgtctgagtgttttaaaatttatgggttgatctatcattttgttgctgctttctaatgttgtttctttggtattcagtatatgtatatcgaggtcttgcagtggataaataagtgaaatatattcagttcaatttgttatattaatcaagttgaaattatttatgccttcaatgtctactggctccaacaacttcttgaagaagcctgttaaagttccaaatgtggatttgacaacattttttaatagttgaatcaaattcatttcacatactttaaagcatcattcagttagttagtttatacaacaaacagttgattgtcttatacactaattcctctttatctgcattttgctttctgtggtttcagttacctgagataatgtggtccaaaaataggtaagtatagtacagtaaattattttgagagagacagagagcacattcacataacttttatgacagtatattattataattcttctattttatttttagttattgttatcaatctctttctgtgtctaatttacaaattaatctttatatctatctatctatctatctatctatctatctatctatctatctatctatctatctatcgagagaaaataacatagcctgtataaagttcaggactatctgtggtttaaagcacccattggggctattgaatcatatccttatgaacaaggggggactactgtatttacatgtgtcagatgctgttccagggatctaagatacaccaataaataaacagacaaggatttctgctccatgaatgcatgtattccattggatgtttgcaaactataaataataaacaaataatgtcttattttagaatgtgatatatagtacagaaaaggaaaagattaaacaggaagtagttgtgttaaagtgctaggtgattgggggtgacactattgctaggttcagtttattactcttataccttcttcgaaaaattgtttctgttattgaaagaataggtccttcttcatctgaaaatgtctttattttgccttcactgttgaataatagggggtaaggtataaaattttaattcaaaattatttgccctcagcatttaaagatgttttcctctagtctattatccatccactattcctgataagaaatatgatatcaaattgattttaattctttcataattaatctgccccttctcctccattcttttaagagctaggattccttttcagacttgctgtttttaaatatactcatttttaaatctattttttctactaggtgctcaatagactacttctgtcaaataccttgtaacttttttttcagttctaggaaattgttaccattatttcctttaaaatgttgtttattatatgtcctcatgtttctgaaacttgttcatattgaatgttgaaaattaggaatttagccctcatgttgcgcaaactttcaacttctcatttttagggattctctattttgcattctagaagaattcaataattccatatgtatataatacacatatacacacacatttatatatttatatattataaatttcagtttactaattcactgtttagttttatttaattacaaattaccttaaatactgaaaaattatgttgtcatttcctaaatatttaatgactttaatgattgttatttcttattgtttcatagtcttctttttttccataaatacaatttccccccttaattttgtgaaggtatctactctaattattttaaaatattttcttattgctcttttaactctgtttccttggatttaatgagaagtgtatttagagagtagcagagtgaactttattctaatgcagcatatttgaaaatttatacagtgaatcataatggctgttatgcctatgatgaaaaggcacaggaggaagtagtttaggggagaacaaaacttgtgtttgagcaagaaaaaacaatgataacaaacatttatttatatgtttatttacacttatttatcttaggaataccctacagcctcaaaacaattgtaaatgttctcttttcattcttagtcattattatatttttaaatacgctttctattatcttgggtttagtgttgagagtgagtgttaatctatttgaaactctatttttttctttgctccattaatacaacactctttaaaattaagaacatattttaaatttaatgaagctgtaaatactctctaacatagactggaaacaatacacagtaagtaaagtaaacatgcacctagtatgtaacactgcttttgggtttttttcctatgcagtagtgatatggttaggctttgtctctccacctaaatctcataaattgagatttttataaagtcttaatcaccatgctattgtggagaacttttcattcactagttattcatttataaaacctttacttagtttctaatatttataaaaaataaaataaggatggccaaataggaacagctccagtctacagctcccagtgtgagcgaagcagaagacgggtgatttctgcatttccaactgaggtaccaggttcatctcactgaggcttgtcggacagtgtgtgcagcccaccgagtgtgagccgaagcaggggaaggcatcacctcactcaggaagcacaaggggtcagggattttcctttcctagccaagggaagctgtgacagacggaacctggaaaatcgggtcacttccactctaatactgagcttttccaatggtcttagcaaatgctaagtctctcctgacactcaaatactgacacattcctagctcctctgttatccactagcaccaatttaatgtgtatctttccagttcttttttcaagatgtataattccacacagacatatctaatatgtaacgttatagaaacctaaaaattatcttcacaaaaactatgcagtattgtgttatgtatatcatactttaacttttattatactgtcaatattattttctttctcctttttaaccaaacaatatgttttagagatacttttgaacatccttgcaaggctggttcaacatatgcaaatcaataaatgcaatccagcatataaagagaaccaaagacaaaaatcacatgattatctcaatagatgcagaaaaggcctttgacaaaattcaacagcccttcatgctaaaaactctcaataaattatgtattgatgggacgtatctaaaaataataagagctatctatgaaaaacccacagccaatgtcatgctgaatgggcaaaaactggaagtattccctttgaaaacaggcacaagacagggatgccctctctcaccattcctattcaacatagtgttggaagttctggccagggcaatcaggcaggagaaagaaataaagggtattcagttaggaaaagtggaagtcaaattgtccctgtttgcagatgacatgattgcatatttagaaaaccccatcgtctcagcccaaaatctccttaggctgataagcaaattcagcaaagtctcaggacacaaaaccaatgtgcaaaaatcacaagcattcttatacaccaataacagacagagagccaaattatgagtgaactcccattcacaattgcttcaaagagaataaaatacctaagaatccaacctacaagggatgtgaaggacctcttcaaggagaactacaaaccactgctcagcgaaataaaagaggacacaaatggaagaacattccatgctcatggatatgaagaatcagtatcgtgaaaatggctatactgcccaaggtaatttatagattcaatgccatcctcatcaagctaccaatgacctttttcacagaatttgaaaaaactactttaaagttcatatggaaccaaaaaagggtctgcattgccaatacaatcctaagccaaaagaacaaagctggaggcatcatgctacctgacttcaaactatactacaaggctacagtaaccaaaacagcatggtactggtaccaaaacagacacatagaccaatggaacagaacagagccctcaggaataataccacacatctacaaccatctgatctttgacaaacctgagaaaaacaagcaatggggaaaggattccctatttaataaatggtgctgggaaaactggctagccatacatagaaagctgaaactggatcccttccttacaccttatacaaaaagtaattcaagatggattgaagacttaaatgttagacctaaaaacataaaaacccaagaagaaaacctaggcaataccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaacaaccccatcacaaagtgggcaaaggatatgaacagacacttctcaaaagaagacatttatgcagccaacaaacacatgaaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagacagtgtggcaattcctcaaggctctggaactagaaataccatttgacccagccatcccattactgggtatatacccaaaggattataaatcatgctgctataaagacacatgcatccatatgtttattgcagcactattcacaatagcaaagacttggaaccaacccaaatgtccatcaatgatagactgggttaagaaaatgtggcacatatacaccatggaatactatgcagccataaaaaaggatgagttcatgtcctttgtagggacatggatctttgtagggacgtggatgtttgcatcattctcagcaaagtatcacaaggacaaaaaaccaaacaccacatgttctcactcataggtgggaattgaataatgagaacacttggacacaggaaggggaacatcacacaccggggcctgttgtggggtgggggcaggggggagggttagcattaggtgatacacctaatgcaaatgacaagttaatgggtgcagcacaccaacatgacgcatgtatacatatgtaacaaacgttgtgcacatgtaccctagaacttaaagtataataaaaaaaaataaggtactaaggatataaagacaaataaaatgtagcccctgtccttaactgaaggcacaaaggaggtattagctaagtctccttggatttggaggttggaaaagaggtaaagactgcacagaagaggtaaccctaaagctattttcagagttatctcaccgagtagactaagaaggacaaaagaaagaaaaagtatcctgaatagagagggcagtatcagaaaaggtataaagcctttttcttcccttttctttcaaagtggaatgggtagagttaggtggcagtggcagtggcaccagaggttgaggagatattagggtcaagtacgtggtattatggatgagggccagagaagtagaagtgaggctaaaaaggcagccggtaaggttgggaggttaagtatatgtgaagaaggttgagaatcagaaatattgaagataagggcagacagacttctcactaacaaaaaagagcatttacaaatgtagaaacagaaaagactacaaagaaccctaaggggttaaactgaaatgttaaaaaatcgtgtgaactcaagtttaaaatatgaatataactagatataaatgggtggatatacatacatatgtcatgcatacacacatatgtacacatatatgtgcacatattttctagctgcatccactgagagtcctaaaagcaataaagctctatagaaacaagtatattgagtacccagatttggtttctacataccattcttcactaaagggaaccaggggagctgattttaggggatggacaaggaaaaagataagatgaaactggaataccttgttgtgccaataaaagtagggtgtacttaaagaatgatggtggggacatatcaaaaggacatagaggccagcttgaagaagctccattggctattctggtgcaatttaaccatcaaacaaagataatggcagagtacaacacattgaataaaatttaaatgcattcatccatactgacataaataaataaatgggacagaagggaaaacattttctccataaagaggtgaaaggtgaagccggctgggcttctgggtcaggtggggacttggagaacttttctatctagctaaaggattgtaaatgcaccaatcggtgctgtgtgtctcgctaaaggtttgtaaatgcaccaatcagcactctgtaaaaacgcaccaatcagcgctccttgtctagctaaaggtttgtaaatgcaccaatcagcactctgtaaaaacggaccaatcagcactctataaaatggacccatcagcactctgtaaaatggaccaatcagcaggatgtgggtggggccaaataagggaataaatgctggccacccaagccagcagcagcaacccgctcgcgtccccttccatgctgtggaagctttgttctttcccccttgataataaatcttgctgctgctcactcttcgggtccgcagtacctttaagagctgtaacactcactgcaaaagtctgcagcttcactcctgaagtcagcaagaccacgaacccaccagaaggaagaaactccggacacgtctgaacatctgaaggaacaaactccaaacacaccatctttaagatctgtaacattcaccgctagggtccacggcttcatgcttgaagtcggcaagacctagaacccaccggaaggaaccaattccgaacacagagggacagttaataaatacagaataagtggggaaaaaaagagaaaactaacatctggcaaccatcacagtggttgtggatttttggctggatgtttgataaaaaataagatattacctctctgtgaaacacatataaatcacaaaggtgaaattggtgatgttctcatgaaaaatcctggaagacatcaattttactaggtgactaatgatcgcataggacgtatattcaggtatattgacgttgtttgcctcctggtgtgatgtcctgagaggcgagcatcatttttgtgatacatctgtcaagaatgtgtggcctatgcctggatatgggaaaatattgtatgtacccaaattgagggatatatcacaaaataaaaggcttatactctttagagctatcaaggtcatgacagatagggaaacattgaggaactcatccagattgaaggaaatgaaagagacatgacaacaatgcaatgcaggttcttgggttgaatcctggacaagaaaaaaacatacacgtgtgtgtgtgtgcgtgcgtgtgtgtagttagtgaaatttggaagggttttaatttgtttggaagtgttttatttatgttgattttctgatttgtatggttgttttgtggttacataaaggagttttttgttttggtgcaattcaaactgaatatttgggaatgatgagctattatgtttgcaacttgttctcaaatcattccgtagtagttttaaaacatgtctgcaaattatttgatgcttctatcaaaaggtagagtcagctgggcatggtggctcatggctgtaatcccagcactttgggaggccaaggaaggcggatcacctgaggtcagaaggttgagagcagcctggccaacatggagaaaccccgtctcttctaaaaatacaaaaattagctgggcatggtggcaggtgcctgtaatcccagctactcgggaggttgaggctggaaaatcgcttgaacccaggaggcagaggttgtaatgaggagagattgtgccactgcactccagcctgggcaacaaaagcagaactccatctcaaaaacaaacaaacaaaagcaaaaaaacaaaaggtagagtcaaattcccctcttttttattattggccagtattgttgcctagattttaatgaagagaatatgacagaagtgacactcatgaccatttctgttggctcctcttctaatgttaccagttgtctcaggctcatgcaggcttacggacagaacaaccatggtaacagttgccgttttcttgtcaattgcaacataaactactatagcagctccagtacccagatttgactccacaggaacacaggaatcttcctacaggggctggatagcagcatcaaattgtggagaatttaaagcctgagagatgaaattttaccatcaaggagcaagagaagagatgggaaggagaccagtagataaatttctaacccttcctctcccaaaacagatggttctaaagcacaactggtccacatggctcacataattaaacattcagctgtgtttcttgtgaggctgtggccagctcagtaacataccaccttatatttgattctccaatttctctgtttatataacttttccccctctttcttgctgtcttagaaatacacctcccaagctcctcaataaagtattagtctataatctttgcttcaactatgttttctagagaattaaagctaatacaagtgagtgacgactggcaaacaaattggtagacaaggtaggggattagagtatcttaaggtggaaacatggatgtaatttccaggaagataagaatattagctgacattagtgatttttttgaaaaggggattgctgaatactataatcattttaactcatgtaatttttattgcagtgctattagccagtcaccattatttcccattaaaggatgaaaaaactgaagttctgagaagctgaccacagttatatatgtagaaatagctcaactgagattctactcatgcccacactcttttctattgtcccatgataatcgagagaaagaatggaatgagacactgtaagccaggtactgggaaaaatgagggaaaggaaaggataccttgagtccactgttgaaagggaaaggatggtcatattaattttaagaaatttttttgtctctactcctttggcccaccaaagttccacccctgcacactctgaaggtaacttgggaactatttagatctcttcgacttccttaccatagagggcccttcatgatctcagcctttcctacctctccagtcctgtctcccatcattttcccataagcaacctaagtgttagacatgttgaagcacttgttgttccctttcaacctctgtgccctgaggcatgacatcttctctgcctgaaaagaaggcattctctgagtgtataaaacatgaagaaattgctatttatttcttaaggtcaaactatacatcctccataatgagtgccctgagcttgcaagcactgttaattgctattttctttgggcttctataggccttggacatacctatattggtccaagtattttactataattattgatttactcatctgtctttttcccatgagtttatatttatttttatttattttttactttgtatcccaagtgtctaaacacttacatatgatttatgtatcacacggttctaggctcttacatttaatcctgacacagccctatgaggaccccaaaagttaaaggatttgtccaacgacacacaaattttaagtggcagagctggcttttgaatacagtcagtgtcattccaggatatgagttcttaagcactataccctctctcagagcctaatattcaagaaacagttgtggaatgtataaagaaggaaggaaggcaatcaagaacatacaaaagtatatggtccgcttaatacataatataagcaatcacaaaatctcatagttagagaaaatcataggataatccatatttcagctacgtcttttgaatgatttaaattgtatagttgtcttgtaattgaaagatatgagtgctggatatcttctgtttacccactaaagccattctgccccttctctgctcgctttttgcacttctttcctacttccggggtggggggtaaagactgatccccatggtcccatgatagccaggaccctatgctctcaggctttctgtgggtaagagaacagagagttatcaggcagtgagcagcattttggtaggagagtagggtgaggaggtcaggaggggcgtgaagtagggtatttcccctcagttccttctttgcctgatcgctatgtgatggctgtgtcctgttagtgaaagccacacttatgtaaggcagcccactccataccgctgtcctccaagctgtggttatcattcctgaagctactagtggctccctgctgtcaatagctagagatatggtacaatcctttgttagtttccttaagctctacccccacacacccagtatgaatgtgtcatttgtttcctgcagggtttcttaatgatacaatataatttatcattgaaatatcaattaaacacacaaaaaatttagctagcatcctactggtacttgattttgttataataattttgtctttcagaatataaaatgaggttgggatttctttaatacatgttgcctccactgtcagctaaatatctgtgcatcatccacaactaaatttggaagaaacaaagtgaggatccatccccagggtcagaggttagcacccatagagagtagcacatgattctgctctttttttcttccctgctgtgcaggcaaagaaatcagaagcaggggaagaggtgctgaaatgaattagactgggaggtcagaggaaataaaagcagagcagtcagaatgctctcatgcagtgagttcagagcaatattggaaatataggtttaaatggcagtggctaaaatttgtagaaacaaggctttttcaacactttttaaagtgaccaagtaactttgatccttgatggctaaagtaataaaccctaattttaaattcaatcagatttccagccaaataataacatctggccttaaagtgacatagaactactcattgatcaatctctgacttgacaacagttgacactataattcaaatacttcacagagaaactgtgtaggttaaaagagagtgatctgtaaaacttgcagttttgctgattcttaatgttaagaagccttttgggaatctcattacctcagcaacgggtttacaaaggttgtgaaatatagaatcatgcagctagaaaagaccttgtgagttaaaccatgtctcaccttcaagcatctcagacaaacgagactatagtcaatatttagagaggttttgaggaggaaatctataactgcccacagaaagtaatgaaaggcatatttacaataataaataaatgtgtgaagtgttttacaatcatgatgtaaacactgacatttaaaatgcctcagattgagtacaacaatttaataaaaatatgcaaaatttagaatggcagcaagtatgccctgggacacgggtttccattttacacagagctaatatagaacatctgcagctagtagttaaatcatgcactcttttgagatacagcaaatagagacactctaaaaaatacatatttaattctctctctctctcttttttagaaacaggctctcactatgttgctcagacttggtttcgaactcctgacctcaatgatccccccacctcaactgctgagtagctgggattacaggcatgaaccaccaagcccaacaagaatattttaatatgtttaacagaattcagaactctttaactgtgataaaaaactatgcttttctttgactctaaatatgttacttgaaatatcattaacgtgaagttgtttttatgattgcactgagtatttatcacaagccatttatatcgtcaactcagctcttagatcgcaaatttacaggatggctagaagacctgcacgaaatgtctgtggacagacaaggagtttgccagtcttcataggtatgggacctatgaatttggattatgtagcattttgctgcaacccgatgattatcaaaattttttctggttgtgagtttccgagagttttatgcaagactctgcttaataattgtagctccatcctctctctctctctcaagagaatacattgaaatacacaagtgtgggattaagcttatttttatggataagactaattgttctctagcttaattaaaatgaaatatataatttacaaatgtacgtacttcaaacattatttattagtagtaatatatttcctgaaacctcataacactttgaaacgctccacaatgtgactatttcaaaatcaagagctaatgctctaacataatagttccccagcttataaatttatttcatgtccaaaacaattaaatgggatatagtgggaatgaatttaaaaaatccacacttcttgatgattataagtggtttagttaaggaaatgttaaggctagtctcatcaactttaatgtatgatcaattcacttcagttcaatatttacagagcatatactgtgtacaaagaactggggtaggaactatggctgctgaagtagttcgggacatgctaccccaaaatattgtttattttgagatgaaggcacttgagaacagcagatacgaactttctgacctcttctcttttacctaaaaacaagccatgaaatttcccatgagaaagatatcctaggaagaaaagaacatctttatcactagagagtggaaatcaacactgaaatgaatctgcacaacaaacttgctaaaataatctctacctttgactagtgttctccagtatatcttactcacttccccacaagttaatgccccagcccaaaccccttgtcttctcatttcttcacgaatttaggatttctttgtctaaaaagtatataagctttctgctctggtcacttctttggatcttcatttcttgaggactctcatgtacatttaaaatttttataaaatttacatgctttttctcccgttaatctgacatgagatatcatgtaagtttcttaggcctagtcagataccctaaaaagggtagaggagaaatttttcctcccctgcatcacaaaaaagatgcaagccataatctctgcccttaaaaaggatacagtctataagagctgccaaataggtgtattcagaatatattttaaaattctctggcacacatttttcaagataaaaaatggactatactctggtcaacacctttgctaaaaaatgtaaatgttttaaaactctgagatgatttcaaaagtttagtgcatttcttatatattctgacttactgggtatattatagtttagactattaaagatgaaacatgaagtgataagggaatcctccttgacttgccttgaggtagcattttaaaaaaacttagcccattgtttatatacttaaagttcttcaaaggaactccttgacatttgtcctcagtttgggactaggtactgtgtctgtgacaaatgcacaatgtaacagtctacttgaggataggaaactcagatatatgctcaagggcactttcattgtaaaaatctcaaatcagtagattccatcatccagtgagtcagctaattatagcttcattatcaatttttcagatactctgacctttcttgttcacacattcattcattcatctattcattcaaatatctatcactattcaaaaaaaaaatcttgaaattgtactatgtcctaaatgttgggacaacagaagtgaataagacaatttattattgcctactaagaagacaagcatacaagtacataaaaagtctaataaataatgtaattttatcataaaatgtattgggaatatggagaaaaaaaataaacaattctgccaagaagtagaaagacaaaaaagattataacagaaagatgaactaagatttgaaagatttgcatggatgtgtgtgtattgggggtgatgtagaggtagctcgtgactttttaggtatggagagtagtttgaccaagggaatgatagtgtgaacaaaagagcacatttggaaaaattcaacagctcagtagaactggagttcagatgcagggagggttaggtaagacacgagactagagagatgtggggctacccttgtgtccaatgttaagggcctttgattttattataaggagagaaaaccattctggctgtgcacaccaaatactccatacatagcaactgtcacactattatcatgtgaaatgaactaaacttgatatacagtcaattaaagagacatgacactactttcttaggagtttataatctaataatagagcagtaaaatggaagtatcaggaaacatttctttttataaaaagattcaacatggcattgttcacttgcaaccttacttaacctgtctattttttaaacattttctctgaagtaccttgaatgaaagaacaaagtggaatatagatttttgtctaaatcctgtagctacctgtttaaaagagtttgcaagcaaggatagatcaatattttttgaactataatagcaatcaaagtaaatggatttttcttttgaaagaaccttaactgcatacagcccaatagtcaccatcaaaaactttgaaacattattgctcttactgtatctactagatggtaaatgaacttataattatctggaaatataattttgtatatctataaagcaagtaagaaggataaaccactcttacttattatgaaagactacattaagaaaagtgacagtgaaacaagtgagcagcagatgccttttgctttaaaagtaatcatgttgatactgtgttagtcctttataaaattaaagggctatcagcacaacctcttgcaacctaataaaccattattgagactgcatctgtgctgagctaattattgggggtggtagtggtggtggtgcggcgggaggggggtggttcctagatgaatgggactaggtattttctcaaggaaataaatacaacagttaaacaggcaatttggaaaattggtgatgggtataaaaacaacaatataatactaggtctttggagctgatttctttcctcaacctttgagggttgttttgaaaactacttctctattgtgtttgtctatctttcacgctcctggggctgtgtgtccaggaaaaatttattctcaaaagagaatcctgaatcaataatctttagtttgaatttgaaataacaggtaacttcttactattatccgcattttaactcttataaattctagaaagaactctataattttaaaagaatattaagttgtatttgggatatactgtttggagactgaaaaataaatttcaaaagtcagatgtttggccttatttatttaacaatagtacatgccagacatagtctgcacataggctgtaaaatttaaaaagttgaccaaaataaagattctgtatataaagaaaattattagttacatgatatacaattaatttaaatgtaaggcaatgtgacacaaatgattgttatttattcaaggtgttttagaaattcagagggagaaaaagttattttcatgttgaaactaggtgagtgtagggatgattataggagactgattcaaggaagttaaatttcatatggtccctaatgaatgaaaaggacttttgtatatggaatttagtaattatagtacagaagaagaaggaggcatatcaaagtttgaaaggaaaaagctttcaagatataagtggaaaagtaaattatacccagatggtagagaatgtcttacatctggttataatggagttaattgtgtaagattggaaaagatattagcaattttagaataaataagaaacaaaactaaaactaatcttaaatctatgagaagagcagacgcaagaaaggaattgggattcattttggaataattaaaggagcacaaaataaaggatattagagtggagaccaaaacatggtaacagacaggataaaacttgcaacttgtttgaagtgggaagtgcagaaggaagattaaaggttaaaaataatataaaaatatatggcaaagtaacaagttttatgggttgttagggtaatgcttcttttttttttttttttttaatctgaaggactgaatatatattggaaaaccaccacaccaaacaggacgatagagcaaaaaaaacctacaaaaaaaaatccagggaactaaaccacaacctctgcaacaatcgagagcaaaaaaggtcggacttggtcaatgacagaaaacttttttcatgtttctttccacttccaacttaggatcaatcaagaaagccaaatgtgctgctcacactaacgtggtagctagcttatcttcagcttccccataccaaaaacctccagctaaagcataactgaatccttccttctttattaactaataaagttttcccattctcttgactgcgtttaagtctctgccaaagacaagtgatggtggctgcctcccttgctacagaaagctctgaataagtagccttgatttattcccatttgcatggtcttcatttatttccaacaatccgagctcatatacacatgccaacaaacacacacaaaaataaataactgcaaaatacgtttcatagtaaaatacatatccccataaatgtattataagtaatgccttctgaaattttctattccattacataaaaagtaaatgttggccccaaaccaaaattatttaatggcccattaaccagtacgacttttatattgaaaaataggtgtacacatattttctaaagcttatttgaccccgcggccatctgttcactgagtatctcttaagacttgtttccttaggacacgcttggggaaggttaactacattttgaatagagattactggaagaatagagatgtgattaacaaacaatcagaataaacacttggtttttaatgaaaggtatttagttcaatttaaattatattgattaagaaattacaattcagagaaacagaaaaaaatactaaaattgagaaagaaaagagttttataaaattctagtcctttctgaagcttatttaaaggtcatttagtttaactttcctctcaatcaacaattttgttttcctgttctagtatctattattaaaatgggactgctgttttaggcaaagtaaatataaacaaagaataaactcctgtctattagaaagtgaagggaaagtgtaagggcaagcacaaaacgaaaagaggcttaattttttagggttagggttagtgttagggttttaatgagagaagactcctgttgaaaataagagaagagactccttttcacctccctttatctcagataactcactttagaaaaactgtaattgtcagatttttcttttgcaagtatatgtaatttttaaaatgctaaataagccctttaatagtctcaaaatttaaaaattcttccttaaggacgtgtaagccatttctttaaaatataaccatctaggaagacagcactgcaatctcccagtttctgtgaaaaggtaggagtccaacatatgccaagttgcagaactacctcctgccataaagatatggggtttattttttcttcagataaagccaatttattttttctttgaataaagccaacacagatggtcaccccaattataggtgaatttaagataaactatgagtgacaaacagtggtgtcaagttcttttacttgagaacaaactactgtttcttgtgagaacatgtgtctaatgaggttgtatctgcttggctatttaaaagggtaacacgtctttctggcttttcaatctctttagcagattgcctaagatgcacatcttgttctcatttcatgcttatccaataataaaaataattttctttctatactgcttttgtggagaggctttctgtactggccgattatgtttttaatcacattaacccaacgccagtcacatatagaaattacaacttttttttcttagtggaaaaagcttgtatttattaacatttggttttgtttttgtattaaggtttggagtaaaaagaattgggtgtgggagaaagacaaggaaagtctgagaaagatgtagtggcccaagtgtgaagggaggcaaagtctaaaaaatctcttacttcatgagtatttatactttatacacattttaaaaaattataatttcttgtttagggtgggtaaagcagaagtctttatgctatgatgtatactagataagcataagttcccataagacttttgttgagagattttgacaaaagctttgtacttcgtaagagatattgcatatttctgcttccctttctggtactcctgccatttgctgctccaaggataagagaccctggggcagacctgaattagatccactttctggagccaaagcccagccagccaacagggtaaagcagagccccacaggccagttcactacattgaactaattgctgttgattcacagaaagaaagagcaataaataaataaatatttcttattttatagtagagtggatattttagcagcattattgcaatgatagtaactgatataagtgcttacaaatgaagatagcctaacaatagatcatcttaattaagtaaaaggtgaaaggttttaagaaacttataatctctattttcacaagaagaaaaaaattttaccagggtaatttcagacctcatgaagagattttccttgaaaaaaataataatgtgccagaaggcccaaaatgaagacagaggcaccattaaacaagcgcattgcgatttacacaaaatcaaggctgtaaagaagtaggaggagaaaaaataatatgacaggaaaaggtaggaagagttgaactagttcaatgggttgttgagtccttaagaagtaaaaatttctaacttattttcgtgtgcctagcacccagcaaaataactggcatctaatatgctattttatctttttttattttcatgaatcataagggaaatcagaggtggaactactggaactcaaagctaggcttcattaaaaaccacagtctacactgattagttataacaggactaattccaaaaatagtattctggatttgtgaattgtcactacaattgattttctgagaacctttctaaacaaaaatacaatttgtatatcaatatcattgttatttatgtatttattatgtgtttatgtatttttttagagtcacagtcttgctttgtcactcaggctggagtgcagtggccagataatggctcactgcagctcactgaggcctccaattcttgagctcaaatataatcctgcctcagcctcctgagtatctggtactacaggagcacgacaccaattatatatcaagatgttccagaagagtcctacttaggacattatgcctaactattaagctactggcggtatgtggacttttgttggcttggagccaatatgcttatggcctgataggagatgcaagagtaactgagaaacactgtaaaatctgtgacactctgtgtgcaagtcagtgatactacagacctcagatactattgacctctcctccagtgttgtgccactctcatctaccaccacaaatgttctcagagctgaaactgtgagcttaagaagacccactatgaagagcaggatcctcaaggaaatgttaacttgacatcaaaccaacaaacaacaataaaaaacaccttgtaagttgggagaaggggtaattaaaattttacttcaatttggtaaatgtagtctgattcaaaaatttaagtaatcttgaggtaatttagtttctattaaacagatctttttaccgtgtaagtggttgattcatgttaattactcacctactcctgttcctttttaaaatggttatacacagggttggatttatgggacagtgaggagattgtcaggacaggaggccccgcaactgtaggatggaagttctctgattttactgtcactgctgatgtagagtaactggattaatattttccttggactgatgagttgtcaaatgtaattattctggttttgacttttggggtatattcggaatcttaaggatcgaggcattaagacatttgtgccttgtagtcttttaatcttgaatatttgctagtccataagtcttacaaggaattctgcatctaattattaagacaggtaagaattaccacaatcccttgacatgccaagactgtgtagaatcaaaaataaaaaaaaaaaaaaagagcctgaagtttctctcatgacatattgaatggaaaactgaacttacttaggtgctgcagacttccttcaggacacccaactcaacatttggggaagctggttattagtctgtccttaaaaatagattctaaggggcagggccaagatggcttactagaagaagcagcgattggaggcacccatcaaaaagaaccaaaacagtatgcaaatccagcaccagcaaccaatatccaggtatctaggttgtcaacaggactgactaggtggctggcatgaccaacagagagaaaggaagagcagtgtggtgcagcagcccacctgagagccacatggggcaggggagatcccaccccttagccaagggaggcagtgagtgtgctacctagtctgggaaactgtgctttttccatggaactgtgaaacccacagatcagaagatcccactcgtgagcccaaatatcaatagccgaattgattaagtggaagaaagaatattagagcgtgaagaccatcttgctgaaataaggcaggcagacaagattagaaaataaataaataaataaataaataaataaataggaacaaacaaaacctccgagaaatatgggactatgtaaaaagaccgaacctactattgatcagagagtctgaaagagatggggagaatggaaccaagttggaaacacacttcaggatattatccaggagaacttccccatcctagcaagagaggctaacattcaaattcaggaaatacaaaaaacaccactaaggtactacatgagaagatcaaccccaagatacacaatcagattctccaaggttgaaataaaggaaaaaatgttaaggacagccagacaaaaaggccaggtcacctacaagtggaagcccaccaaactatcaagagatctctcagcagaaaccctgcaagccagaagagagtggggaccaatattcaacattcttaaaagaaaggaattttcaacccagaatttcatatccagccaaactaagcttcataagggaaggagaaataacctccatctcagacaagcaaaggctgagagattttgtcaccaccaggcctgccttgcaagagctcctgaaggaagcactaaatagtggaagaaaaaccagtaccagacactggaaaaacatgccaaaatataaatacaaagacactatgaagaaactgcatcaactagtgggcaaaataaccagacagcatcatgatgacaggatcaaattcccacataataatattaaccttaaatgtaaatgagctaaatgcctcaattaaaaggcacagactggcagattggatgaagagtcaagacccatcagtgtgctgtattcaggagacccatcttatgtgcacaggcacacacaggctcaaaataaaaggatggagaaaaatttaccaagcaaatgaacagaaaaaaaaaaaagcaggggttgcaatgttactctctgacaaaacagacttttaaccatcaaagatcaaaaaagacaaagaaaggcattacataatggtaaagggatcaattcaatatgaagagctaactattctagatatatatgtacccaatacaggagctcccagattcataaaacaagttcttagagacctacaaagagacttagactcccacacaataatagtcagagatttaacaccccactgtcaatattagacagttcaacaacacagaaaattaacaaggatattcaggacttgaaagcagctctggatcaggtggacctaatcaacatctacagaactctccaccccaaatcaatggaatatacattcttctcagtgccacatctcacttattctaaaatcaaccacataattagaagtaaagctcctccgcaaatgcaaaaaaagctgaaataataaaaaacagtctctcagaccacagtgcaatcaaattagaactcaggattatgaaacactcaaaaccacacaactacatggaaattgaataacctgctcctgaaagactcctggttaaaaataatgaaattaaggcagaaatcaagaagttctttgaaaccaatgagaataaagagacaacataccagaatctctgggacacagctaaagcagtgtttagatggaaatttataacactaaatgcccacatcagaaagctagaaagatcttaaatcaacaccctaatatcacaattaaaagaactagagaaacaagagcaaataaatccaaaagccagcagaagacaaaaaataattattcagggcagaattgaaggagatagaggcacaaaaaacccttcaaaaaaagcaatgaatcaatgagctggtttttgaaaaaattaacaaaatagatagaccactagctacactaatgaaggagaaaagagataagaatcaaatagacacaataaaaaatgtcacaataaaaatgacacactgaccccacataaatacaaactaccatcagagaatactataaacacctctgtgcaaataaactagaaaatctaaaagatattgataaattcctggactcatgcaccctccaaaaactaaaccagaaagaagtcaaatccctgagaaaccaacatcaagttctgaaatctaggcagtaattaacatcataccaaccaaaaaaaatctcaggacaagacaaattcacagcaaaatgctgccagaggtacaaagaggagctggtaccattccttctgagactattccaaagaattgaaaaggagagtctcctccctaatgcattttttgaggccagcatcatcctgataccaaaacctggcagagacacaacaaaaaaagaaaacttcagtccaatatccctgatgaacatcgaagtgaaacacctcaataaaatactgacaaactgaatccagctgcacatcaaaaagcgtatccaccatgatgaagtcggcttcatccctggaatgcaacgctggttcaacatacacaaaccggcagatgtaatccatcacataaacataaccaatgacgaaaaccacatgattatttcaatagatgcagaaaaggcctttgctaaaattcaacatccccaattgttaaacgtttttgataaactagatattcatgcaaaatatctcaaaataataagagctgtttatgaaaaacccacagccaatatcacactgagtgggcaaaagctggaatcattccctttgaaaactggcacaaaacaaagatgcactgtcttcccactcttattcagcatagtattggaagatttgtccagggcaatcaggcaagagaaagaaataaagggtattcaaataggaagagaggaagtcaaattgtttctgttttcagactacatgattttatatttacaaaactccattgtctcagcccaaaaactccttaagctgataagcacttcagcaaagtctcaggatacaaaatcaacgtgcaaaaatcacaagcatttctatatgccaactatagataagcagagagccacaacatgaataaactcccattcacaattgctacgaagagaataaaatacctaggaatacagctaacagaaacgtgaaggacttcttcaaggagaactacaaaccactgctcaaggaaataagagaaaacacaaacaaatggaaaaacattccatgttcatatataggaagaatcaatagtgtgaaaatagccatgctgcccaaagtaatttataaattcaatgttattcccatcaaactaccattgacatttttcacataatgacaaaaagaaccactttaaatttcatgtggaaccaatgaagagcccgtatagccatgacaatcctaagcaataagaacaaagcaggaggtatcatgctacctggcttcaaactatactacaaggctacgattaccaaaacagcatagtacaggtaccaaaacagaaatatagaccaatggaacagaacagagacttcagaaataacaccacacatctacaaccatctgatcttctacaaacacgacaaaagcaagcaatgggtaaagaattccctatttaataaatggtgctgggaaaactggctagccatatgcagaaaactgaagctggaccccttccttacacctcatacaaaaattaacttaagatggattaaagacttaaatgtaaaaccataaaaaccctagaagaaaacctaggcaataccattcaggatatgggcatgggtaaagatttcatgatgaaaataccaaaagcaattgcaacagaagctaaaattgacaaatgggatctaattaagctaaagagcttctgcacagcaaaagaaactatcatcagagtgaacaggcaacctaaaaaatgggagaaattttttgcaatctattcatctgacaaaggtctaatatccagaatctacaagaaacttaaacaaatttatcagaaaaaaaaaacaaccccataaaaggcgggtgaaggacatgaacagatgcttctcaaaagaagacatttttgtggccaacaaacacacgacaaaaagctcaacatcactgctcattagagaaatgcaaatcaaaatcacaatgagatactatctcttgccagtcagaatggcgattattaaaaagaaacaacaatgctggcgaggctgtggagaaataggaatgcttttacactgttgttgggaatgtaaattaattcaatcattgtggaagacagtgtggcaattcctcaaggatctagaaccagaaataccatttgacccagcaatcccattactgggtatatacccaaaggaatataaatcattctactataaagacacatgaacacctatgtttattgcagcattatttacaatagcaaagacgtggaaccaacccaaatgcccattgatgatagactgaataaagaaaatgtagtacatatacaccatggaatactatgcagctataaaaaggaatgagatcatgtcctttgcaggcacatggatgaagctggaaaccatcatcctcagcaaactaacaaaggaacagaaaaccaaacacctcatgttctcactgaaaagtaggagttgaacaatgagaacacatggacacagggaggggaataacacacaccagggcctgtcagggggtggagggcaaggaatgggagagcatcaggacaaataccttatgcatgtagggcttaaaacctagatgatgggttgataggtgcaggaagccaccatgggtcacgtatacttaagtaataaacctgcatgttctgcacatgtatctcagaacttaaagtaaaataaaaaataataaaaaatagactctagtgagagaaaagaagtaagtaccaccatattatttctttgcataatcctcaggctcatggtggttctggctataggtttttcatttcctctagttttgtatttttctcctcctgttttgtagtgagcctgaagatctaaattgcacacgtataaaggctgtctcttctatatactatgaaggatactctataatatgagtactttattcttgagaggtttcataataaatgaagaattcatgaaattcatttttctctgacaaaggctggctttcaagcctgtcttctcaactcaactcaactcaactcaaaatcacactttgataggcaaagcttgaactatttcattctctcttcagtgttttatatgaacaattcctgttctaatgcctatgtgtgtgtatatatatgtatatatatatatatatatatgcataaaggatgatagtaatatgcataataatgcaagagaaaagtatcacaaaacaaaacaatttaattttaaatatttgtaatttagacttttaactacttcaccttgaatattcctatttatcttttaggacttatgtaaggtgtctatccttggactgcttttacagtaccccttatttttagaaaatcatttctgtttgctctgagcacgtattaaaataacctatttatatgtacctgtccccacttatctgaaggtgtatagatgtatgaaccttgtctattttgtcttctcagccccattacctaacacagtgcctgggacatagtaggtaatttaaaataaaaacttcttaagcttaaattaaatctatttattaggtggagattagtattgagctctgtgtaaaagatttaaaactgtacacctgtcaaatgaagagaaagcatttttctgtataaattcactctgaatttattgaagacattattctgatataagaacaaatcaactatcaaatcaaaaaccacatttgttatatcaaacttcatgtaaaaaaatttcattagacaaaacataagtaaatgatctagaaatatataaatactgtattttgctgccatgggtaacagcaagagaattagaggtcagattagaagactaagtaaaagttatgactattttcggtcagattagaagactaagtaaaagttatgactattttccagaagataaattagaatttaaggtataaaggtcagcaacataatatgccccccaaaaaggcaaggaaagaaagagtaggtacactgctcagcttatgctgctacaccaaaatacccagtggcttaaacttaagacttggcttagacaacaggcatttatttctcacaattctggaggctgagaagtctaagatcggggtgctggcagctttggttttgatgaaagctctttttctagctcacagttggctgccttcttgatatatcctcacatgggaaaaagagagagacagacggagatttcacgtctcttcttagaagggcactgatcccatcatgagagcttgacttttcaaaggccccgtctccaaatactatcatattgggggttagggctttaacatatgaattttaggggggacacaattcagtccatagcagtaggtggaagactgaaagagtaaaaggaattaataataatacagaaaaagctattggcaaagagtcttatatgtaaatttgaagtagttaggaagaattaatattcaacagttattccaaactttatttgaaatatctttcagcactaaaaaattaaaggaacaaataagcatagaaacagcaatccttttcttaaacacccttgcaactagactcctaactgtggattagatgtagtcaattaggtaagatttaaaaagtgagagagacgaagaacctatctttctcacctttcctgtgcttttggtcatgaagacaagcgtggtcatcgggtttctctgaaggcaaatccctttgtccagtcatgacttcaagagcactgatttttgaatggaagtctttattgatgctaagctcaacttcttgatttccactgacctaactgtggcaaaggtacattcatttggtagtttatttcttgctattcttatagtctctcctagaaacctgatctagcatctgctcttctaaccattgcaacaatttgttaaccaactcatttggtttaaatccctttctgcttaaaatgctagaaatttttttcttttcttttcttttctttttttttcccctgctttcaactgatccttgactgacacaacaggttaggggaatgtcacattcaaatgtgacaaattcaaatatgtaggcattctacccaaattatgcctcaaaagatattaaaatcctctacagtgaaaaccaagtatcacatagttcacctacaaaatgctcgttttccaaaacttaatattttaaactgtcctaggcctatacggaccctacatacatgcgaggaatcacattcatttgcatgtagatctaggagtaaactctgaactgagatggtgacactctgaaccgcagcatagtacctatccaggatgtgactgattggctcaacaatcattcactaaaacttccaacgtgccaagcacagtgccggattctggcaatataaataaacgatgttgttgcttcttaaagagttcacagtctagatttcagataaatgatacttggaatacagataatattctaagataaatttatatattttctgtttatacatatttgattaaataatttgaaagcagagggagagagtaatcttcaagagaaatttgtatgactttagtattctgaaattatcagtttggaatgtatcctcatctcccaatttcactgtatatattgtttcactttctacaaaatctagttcaagtctgaattcatttctgaccctacagtgctttaacagtagaacagggtctatcaagaagttagtgtccatatatatggttaaatgccaactctagattagagttgctcagatcaatagctcaatgccttacctgtagtagatctcacaagtatcaattacagaatgtttccttgacttgttaatcatcatatatatgctgacagctttgatatgtgaacaattggaaaaatcaccatgaaaaactgaatctatgtgacttatttgacctcagtaacaatcacattagaaatgttaaaatattggccgggcatggtggctcattcctgcaatcccagcactttgggaggccgaggcaggtggatcacctgaggtcaggagtttcaaatcagcctggccaacatagcgaaaccctgtctctactaaaaatacaaaaattagctcggcatggtggtgggaggcctgtaatcccagctactcaggaggctgaggcatgagaatcacctgaacccggaaggcggagtttgcagtgagccgagatcctgccgctgcactccagcctgggtgacagaacgaaagagaaggaaaaacaagtatttgtcaatgataacaatttcacaagctgtatttttgatctactaaagatacctcgtctagacttttactaatgcattgttccttgatgcattcctgttttgtcagcttttggcactatttgatagtagagaaaagaaacatcgagtgaggccttagaactatttttgttttaatgtttcctacattttgacaaccagcgattagcctcccaaatatcatcagaagttttgaagggatgatattaatatatttgatgtgtgaggtaaaacacacatgtacatttctcagtattaaacaataaataacactacaaatgcaagaatatgatttggtcaagatgcagggatcttgcattggttagagttcatattttgaaatctgaccttcttgtgtttgaaatattactctgcagctttcaaaatgtatacaatttggggacgtaacttcactttttttaagcccattatatgaaaaaaaaatccatacataaggctgtgtagggaattatattaaatagctcacacaataatacatcatcagtacaaatcattattgggataatctagaaggcagctggtgttaactctgctaaaaattcagtgaaaagagaaaaaaaaaaaaagcaagggaactgttccagaggaaaagataccaaagagacataacaaacaaatgcaatgagtgcaaattaattagatcttaggttttttaaaaaaaaaggctataccagacctttttgggcaaactgggtatattgaaaatggattgtacagtagataacattggtgattgaatgttaattttctaaacatgatattgatattgtggctacttaggggaaggttgttacgattagaagatgcttatgtatttacgggtgaaagcacgtggtatttgcaccctactttcaaattgttatgcaaaaataaacgaataagcaaataaagatgtgtttctgtgtgcatgcacacgagcctgtgtgtgcgttagcgtgtgtgtgtgtgtgtagtgtaggagggagaaagagtgaaacacagaatgccaatgtggcaaaatcgtaaaaactgatgaatctaagcgaagaatatgcaagtatactttttcttattctttcagtgtttctgaaggttttaaacttttcaaaatagacacaaggaataaaagactcagtaaaatgaggaattaattcacgagctacagaaaataatatgtgtataaataataatggtaattatgaaacatatgatgtgtcacaatttaagtgggagtattaagatgactcacttgtaactgaagatcaaaaatcacaaaatatgttgggtttttgaaattatattttcctaaatttataataggcccaaaaagaaacagaaattaacactttagaaatctttagatgacatatttttgtgagtaacaagcaggtcacattagtcatttgttgacaagtagcaaaaaaaaaaaaacctgttcattaaggtattgataaaacgtagtgttaaattgtcagttcaaaaatctgaaaatcttaaaatgtaataatcattaacctaagtatgcaaaatcatttgcatagcttggagtagatattaacacagacagaaagaaaagccaatgttgatattatagatttcctaacttaaaattatgactactcattttcttatgaattttcttgccaataatgacagaacacatgctattcctatttcctaaggaagaaactatcctgtcactgtgcctccaatgggtcaaaatagttcagaacatttctcacaagcatttccatctatatttgaaaccagttcttgtggtgagtatattagatttaacatgtcacatctcacactcttgaaggcagcaaatggcttagttgatatatttcattaaagcgtaagataaattctcaaaatcaaatgtcaacaacagtaacttttctatgttgccaagaagtggggctattatttttcatgattatcagcagaaattttgttttcagagttcaatacactgcattacatgtgtttcagaagcaataattagctcatgttaagatgggaaacaatgaggattcaaagcagaagctttggagtcaagctacctaggtttaaatcccatctttaaatgctgacagcataactttgggcacattagaaatcacggagacctagttttatcatccctacaagaggaaacaaaatagctacttcattgaattcatgaaaagattaagcaaggtaatcaacacagcacacagcatggtacatactaggcacaccaatgcagttatttaataaatatgtattgagtacccactctaagccatgtattgttctaggcactcggggcatagcagtaaatgagagatcatccgttcactccccaccttggaaaaaaaaaatacctgtccttttggaattcatatttcagtgtagagagacagaaaatattaaacagacataataaaattatataatattagaaggtaataagtgctatggatgaaaaaaatgaagcagaatagggtaactgtggagaggtgaataggttccaatttttattatagtgagtaagtaggcagccttggaaaatggcatttgagataagtcatgaaaaagttgaaggggttagccatggacatataagaggaaaggccctaaggaaggaatatgtctaagtgaagaagagtgagaatgaaagaaaaatggtggaaacgagaaatcaggtatagttattgccttaatcctggtgcctgatgatagtgggttgaccaagatattagcagtagaggtggtgataaaggattgaattccagacatgttttcaaagtgaagccaaaataatttgctaataaatcatgaaatgatgagagaaaggggtaaatcaattatgtccccaataatgtctgtctgagcaaggggaatgatgaaatttctattaacttagatggagaagactagggaaagcagtttggtaaaaaatcaattaagttaagtattcgcatacataacttggggaattaggtgtccaagtagagatttcaagaaagcagtggattgtctagaggtccagcagcatatttgggctggcagtgtaaaatgtgagactgcatacatatgtggcatttaaaatcatgcaacccagaggttattgctgaaggagtgaatgtgagagacaaaaagatgatgaagttgcattaacattaagtgatcagacagaagaggagaaaacaatgtgacaggagaaaaaccaggaactgaaaccctcgaataaaagtaatgaggaaaactgagcatttagtgctaagataaatactgctgatctgtcaagtaaaaagtatacaaagaatccactattagacttagcaatgtagagaacatttttgactttgccaaagaagttttgttaccatagtagtgaaagtctgtttggaacaatgggtttgggagggtctggaaagaggaaaatcaaagttagcaaagatgaataactcttttgagcaagtttgcagcaaagagaagcaaaaaatatatggcaataactggcagggaaagtggggtcaaaacaactttttttaacaaagggagaaataaatccatgcttttataatcatagtcccgtaaagatagaaaacatgactaaacagaaaaaagaagggaggctggctaaactaaaatcttagagtaggttagaaatagtggggtttagtgtgctagtggaaaggagtagctttagatagaagcattgcgacttcagttatattaacaggaagaaagtcaccaaaaacaggcaaagattttgactacctgtgtagatctggtagtagatatggcatatagttaatgtcatctaaaataaaatccatattaaagggaaatgtgaatgttaattagttcctttaaattgtcccatagtagttcaaatggaagttgattcaatccaaattaataaactctaaatcatggtggtataacatctacaaatgactttctaagacaaactgaaatatacttggcttttttacttttgtatatatgaaagggagaattggctagaaactgcttttatttgctcttataatatcaatgcacagtacctcaaaacttgttacctaatttggaacaaagagaaaaaatccgaaggatttttttccaattaactgtgactcaaacggaagttatgaagtttgaattaatttgaatttcaatccataaagtatttatttcttattaactgtttattggtgaaatgaaacatagacatgagaggagaaaacatgagattgcaacctgtgtatgaatgctgtattagtccattttcatactgctataaagaactgcctgagactgggtaatttataaaggaaagaggtttaattgattcacagttcagcatggctgtggagtcctcagaaaacttacaattatggcggaaggcaaaagggaagcaaggcaccttctttacaaggtggcagaaaggagaatgaacgcaggaggaactaccaaaaaattataaaccatcagatctcttgagagctcactcaatattaggagaacagtatgtgggaaaccaatcctatgattcaattacctccacctggtctctcacttgatacttggggattatagggattatggagattataattgaagatgagatttaggtggaaaaacaaagcataaccatatcaatttctctgagcatgcagactgctactttctgctgaaaaataactatatacttgcttgttgtttaggtaggctaggccagtgatatacattagcatatcacctctgcttcctcctaagcttagaatgcattctaagtacttagccaattattatgtacttggcaagtagtaaagataattttatgaagagcaggaaatggattagcaaagaaagtagttgaaggtggttagagaaggtatatatataaaagagaagatcatatatttttctaaacctagtattaagcagagtgttaggtgcatagtatactcagaccagtgtttgttaaattacatatggagcttggatttaggctgtcttttggaagaagagacattactcatccaaccaacaggattttagcctttcctattttgaaattcttccttttctcataactttatttgcaaagttataacaacaacgtaatgaaagataatccaaatactatagatgcgtcattaaatttttaaaaagatacggaaaaaaggaaaatttgattattgatgtaatgtattagatttaatgcttgatcaataacactaagcaacaaaatgatattacatcaaattagtaaatataagaaccaatgggaatatgattcaagagaaaatgactgattaaagctcattttatttctcaatatagttcatgaccaagcaaagaattctaaaaaataaagacaaaaatgactatgcttcttaaatttatttagcctcattcttcaggtatttatttctgaacaacaaaaaatacagactatattaaaaaatctcatatgctgttaaaatctattatttttctggaactatacaaatgtataattattttgaataattatagaattttcctgatttgtatcatatacagtaaacatttcatatattgtgttaagggaagttttgatgagttataaagttctcaacaaaaatgtatcaaaaagataagtcatgaactgcgtctgattttccacaaactgaatatactgcaattaattggttgtagtgctatagatatgagattatgagcaaagcaacataaacataaagggtctattttattgagtggacataatcttctatggctcctttccaactctgtctagtgtgtgaacaagatattttctgttgaattaaactaacaaagagggtgagtgagcatttaaaccccaaggactattcttggagggtgttacacactgcttcaagattcttaatgacttcagtttaaatggcataattttctttctcagtttgcaaattggcttttaaaaaatactgaccatcagcctatatatatatctaattaaaaagaataaaatcaaaacttaatatttccatttttatatgaaagtcattgtatactatctgtgattttacaagtacaattactgtgatctaggattgattattgatctattttatgttactttttacaataagtatattttacccatatcttattcaaaatgaagtggaacagtaaaatactgtcggattctaaatggcatttttaaactgtttaaaatgtgaattcattctatgtgaagtaatttcattaaccaaaaaacatagcgtaattttgaaaaagtcaaataattaaatcttagtgtctaaaatttgacttatcatattttccagactgtaaactcttgtgttacattggcaacaatttgaaattatctggtgtaatgctaatttccttttccaacaggcattttcttgttgtttatcataaaagacaaaaggcattaacactatagttaattaggggtagtcatgtgatagaaaatgcagattgttgggaagaattaaagctttgtcagctagatttctaactccccttcattaagattagataaagtgctctcaagacagtaaactgattatgacaaccaaatttttcaagtaaatttatttagatgaatagcttaggaaattgaacaataaaaacagaggtaacataaagttccaaaacactgaacaaaaaaaatatgagttagatgtaatttatatgcttataattttactaaaaacaataaagaattaaaataagttatatatctatacacgtatgtatgtaaatatcaatagaggttaattgttagaaacaaaatggacatatacaaaaccaaaacttcctcctatatttctactttttgagaacgaagactgttaacagttttactctttcagccttattcatacctatattctgttattgttgttttgaacaaaaatgtgtcacaagtaaagttctacataacaagaccacctttgctagccaagccccttcttctcctcctcccataatgtattttgccatgatacaagcccccattctttctgtaacttcaagaaggaatatgagtttctgaactccattgaggaatggggagtaatcactctgtggttctcaccacgtgcacattaataaatttgcatgccatttctcctatttaaaacaaataagtaaagttctgcttctgatatttgtttgattatttcggcaattatggacaccatacaatatctatatgtacaaattattattcatttttaaaaattaaaataacttttaaaattgcattacataatagacatcagcaaactgagggaatttaagagttacatatacatatatacacatacatatacaaacacacatatatatattttacatagtacaaataatgcttcaaaaactgacatttttatttttgttaagctgaatatttctgtggaacaagtttttgaaagtaaaattttgaatcaaaagttatgtactttttctgtttgttttaatatattgcaaaactgtatctccagatgattttgtcaaagtacactctcaccaaaagtgaatgagagtgcaggaatgagaaggtgaaaaggcatgagatccagagcaaaagaacaagagtgttcttagagcaggggtgagggaggaggggccaatctttcatttaacaggaaggatgaacaatagaagagtagtgatagtaccagttttgaaaaaagctgaaatattcttgactgattgttgttattttcctaatacagtgtgaaacacgattatcagctgattttgagtggtcaatgatgatggagtataagcaatttgaaattgtaaaagaaagtataaaataatagcgttaaaaagtgaaacaaagatttttgctgtggcccctcaaaagatgtctatgtcaatctctagaatttgcaaatgttaacttttcggaaaaatgatctttgcagatgtaattaacgattttggtatgtgaagataatcctgaattatctgtgtgagccctaaatgacatcatgtgtccacaaaagagagaggaaaaaataatcacaacctgacagtgtacctgcttaaaagggattattttttcctctctcttatatggacacacagaagagaagacaatcaaaatagagagtggagtgatgtggccactaggacagaaatgctggggcaaccactataaactggaagaggcaaggaactgattattccctttacaaagcccctagagggagagcagccctgtcagatttcaaactttttgcctccagaactctgagagaataaatttcttttgttttcagccaacaagtttgtggtaaatactaagaaactagtgtacttagaaacaaatatactattgaagtattaaattagcatttgagctttgtagttataaatctgaagtacaattatttagtggaaaagaggatacttgctttcaattgtggttggaatatttgtagatatagtgaaacagtaaagaaagccattttccattttgtttttgtttgtgaagagattaattataatgaaagactaaacaaggatctagacttaaaagagaagggaagggtgataaatattatttttaaaaaggatatatagattgcatttctcaaagaaattgagcacacatcttgtgaaatactaccataagaaaactgtaaggaaagaattaaggtcactgactgagaagtcgctagtggaaatgtcacaagaaatagaattactgatgatgataaagattgtcattatttcatacatggtcaagctagcatgatggaaaatagttggaagtgagtaggtgaaggacatagatgttagagttttcatatgcactgtcttcatctatgtttgtaacatgtatttagctatatagcttgcagtagtttgacaatattaagttttgaatatttacttcatttgtttgggcttaaaaaatcttcctagcattaattccctctttttcatgcaaccataccctgatgttgatatgggaaaaccccgttttctcaacttgctcacggtattcaaccaaagctgactgcaccaccaacaccccttcaacctgactgtgtacctgcttaagaggccagatcaattgttttttttgttttccttgtcatgcaatgattctgtgatgggcacgaaacacaagtcaagcaaattagatcaatttagggcttgctcttgagctataaacgaagtgggtgtactatttccagctggaaataaatccagacaactgtatcccaggaaactgttcacagtgctcttgaaaccacacgggagaacgtacctaagagtgtcatgatgctaaggaaatgtatgcaaagaatgaaagcaaacaaacaactcccagtctgtaatttaaacaccaaattaaggtttctctgaccctttaattatttagctgttcagagaattttaaaaagtcctttgtttgaattaatctagttggagtagcattgttattattattgtttttgtgacatatgaagtacacatttcagatatctaatagttttctctaagactaccacatcaatgttgctgataatttcattttaagaggatagatctacactaaaaggaaagtaagtgcaacaaattctccttatatactgaatttctgtcatgactacgtccacaagtgatagtcattttttaaaaaatgagaaaggtcataccatagtaatgacatcaaatagcatagagaatctgtgcaactatattgaattctgcatctgtattatgtgaattaaaatcttggtttcctacaactgatgctttatcttccatcagtatggattttcatgctagcagtaaaccatcaaagacttacaagttgagtaatgccatttatgaacatggattttagataaattaacttttaaatgttcttcttgacttacatttttgtattttcttactgattacaatcttcttttgtaactcttctaaatatgcatccccaacctgctttttgtttatagtactgtagggtaatatcaaatgccaatccttattgcatttgccacagtgtatttcagagcttgatatgtgattttcccaggagatttttgtttcagaaaaatataccctttttacttctttggtgaacaatttgcagtaatatgctcaatgagtatttgttcactgaattcaattatcaggattaaaggcagctatataatataaagtaaatctacaaggtatattattgaaagaaaactgtcaattttgaaagatatattatatcaacagtaggagtcagttctataaagtgattaataggattttccagacaggcaaaaatgtatttggaatgtttccttgtctatgccagcaacatcataattctgattcagggccagcgcatgaaaggtctagtcgtgttgattaatttaaaaggcattgtgtgagtgtgtgtgtgtgtatgtatgtgtgtgtgtgtggagtgatgacaatagcagaaacaatgtaaatattgctcatgcatttgtattttcaggttgcattgatactcagctatactctagagaccacaccactgcaagagaaacaagagaggattcatgattattctcttgccttcaagatgctaaggaagtaaactatcagcataaactaacttaacacagagatagcccacaaacagttaagttgtctctcttaactaagatgggaagggagtgagaatgcttatttgttaaaatgggttagtgttcactaactgatagtggttttgtttccttttcattctgtaattgtttaattatattaatttgagaagacatgaattaaaaatagatatcgtggctgggtgtggtggctcatgcctataatcccagaactttgggaggccgaggtgcaaggatcacttgaggtcaggagtttgacaccaacctggccaacgtggcgaaacctcgtctctactaaaaatacaaaatattagctgggcatggtggtgcatgcctgtgatcccagctacttgggaggcagaggttgcagtgagccaagatcatgccactccactccagcctgggtgacagagcaagactccatctcaaaaaaaaaaaaaaaaagaaaaaagaaaagaatagatattgtccgaatagacttattttagaattcctgatgtcaaacagtaattattcccacaaattattttaattcagtcttcacttgacagtaaaacttaattgcataaaatctggcaatcaaaagaaatattaaaaattaccagtgtaacctaatatgtggttaatcacaactaccaaacttatatgttacaacagactaaatgcaatatgaaaagtaaacacaatttatttcaacttaacttgatctaagagcagaatgtcttttaaaatgtatttttaaaacacacaataatttttatgttgacctctttcatttaataatatgttagaccttttgttttcaccaaccagtcctcaataagaatgattccacctccctattatgaaatatttggagagtagccatagcaaacaatattatgcctaataaaataataatagctcttcctctaagaatcatgactggcttcccccttattcaacaaaattgtaaaatgaaaaaacaggcataatcaccacgctagacgaattaagcatcatattgacacatactttattttactacttaaaagtgtgtttagatttttgttttggctaaataaattagaatttgaatgtaccactttttcacataagtgcttgttagtttttttttttaaattaacattaagtaaagtctttaatgaaaaaagtgcatctatgtaatgtcaataaaactgctaattaggaaactcagtatttataaacatagattgcataattgaaaataagtataaagcttaattatgcaaaaatgggttaagcaactttgataagaaaaactacagacataaatataaaggtaagtaatttgtaagttagatagtaactgatattgatgtaataaaaaccataagaatacatgcatttacaacttttattaaacattgtattttgaaaggaccttttagtcaatatgataatgcaattatgttagttctagtaagaaaaagaccagtgagagagatatagcaaaggaagaggactgactttaaaccataataattaaatgctaatctcagtataaaaataacacttttctttgactttgggcaacacataatgtctgtgttgaagtttgcatatgtaaaacatacataataataataatacctcagacaggtgctgtgagacttaattaatttctccagagtgctatggacatgagaaaatgtatgcagtctggacatttaatcattattatcctccaagggttttcttttgatattgcttagggaagctagatggaagactgccaaattaccaaatccctggaaggagttagaaacacattatattgaagagtaagacaaatgcaataaaagctagaccttaaaaagaaacattaaacaaaagaagttggccatttgagaatggcagggaggattaaatgaattaacattataatttaaagttaaaaatatatatatacatcggtgccaacagttttgaaagagaaagaagaggaggaaggaaaaaaggaagaagaaagggagagaggaagggagagagagagaaaagagggagagaggaggatgttaaatttctctttaacagatgaaggaaagaagaacaatggagtggttatgagttaaggtcattgttaaacactagtaaattggcaaaaagtcaattcagaaggttacaaaaaaattttaagtgttgggagagctgtcatatttcctaaaaatcaaaaagaaaaatttctgctgcagaattaagattaatatttacacatcaattttttgtgagacttttgtctcagagaaatgatataacattagttcttctaatcggggctgaatttgtaaagatttttgtcaggaaatattgaaaataagaagggtgcttaacaggtaagaagtactcaatacatttttaggaattattattattcaaattctaataatgcatgaactgaaattccactgattttttgctttttatctttaaatattttatgtttaaattattaactgtaaatgtgaataagttacatttgataaatgctatataagaataggtgtcaagtgatatgaaatttctgaagatatatttgcaatggcaattcataagagaaaaaacatccttaagaaagtacttccttctatcatactcatttttctgtactttttacagcttcccaagcaaaaggctgcacagggaaaggtgcccccatttgtaacaatagaaagacgtagtaggaagagctcattggactatctctatttgtctcttgttttgaaagtccctttgattgtagcagagaacatgaatttaaagattaattttaaaaacaatatccaaaagattgtttggatattgggacaaaagtgtccaactctgagacaaattcttaaatgaaataataaaaataatgtatattgaaagatctcaattactctaccaatctggcttgttctgtatatagcgaagtatgagctgaagttggttatttaatgactattgagaatcaaaacatacaaacattgaaaactctgaagtcagtagagcacaatgtgagcagagcagaaaattaggtataagtttgttacttcatacctcaaaaccaccctgtaaataaacaacttgagtgtatcagatcccagtgggagttcctgatcttactaatgataaaaaatattttagatcagaggttaccacataagtgttaattgaaagtattctgtattcatctctcagatacccagttatcttagttttatttgacaaacttataattttatgttccagtattgtgttctagactggaaatacacaaagataaagacacaattcttcctcacaagacacttacagtccaggtgaaagagaggacaaataatacttgctgatccctgcagcttgctaaaaagtgcttgaaacttgagatcagctatccctttcaaagggaggccttggtctttcaggtcaatatcatgtcagaaaaatacatgtttcaggcaacgtcattctcatattgatcactgtgagaatctcactttatgaaaagatctccccagaacaatataacactttttttttactgtttttattgacttatcaatccatctttgattctttagatgggaattatttgtggcccaagatagacaagttcaatgtaaattctcattcatgcatcatcatcaaaatctaaaatttttaattatacatctcaagaatcatgttaggtagaaaacagaaatcatatttcaattttcagttttatatagagagagctgtgtccaagtcctcttctgtttaaattatactttaggagcctagttcatgtttggatgctcactagctaacacaatatttggcacgtaagtataaaatatatgtagactgaatgaataaatactttcactgttgctttttgattagttaaatgccaacttccttgtcattgatggactttcattaggccctcaagtttcccccgtgtatttctgcaaatgctttccacactgccagtagagttagttttctgggttaaaatttgattatgactgttcttcaaaaatacctttgttggttcctggtaactcagctaaaatccccttcccatgttatctaggtttaatcatgctctgacctcctgccttgacaggctttctcagaacacaatgggttcctgttctggttgcatgcagctgctcacaatctttaggataccacattctcttctgtgcttccatgctttaatgtgaactctcatagtctgcagtaacatttctccatttcactgcttggcaaatgctcactcatgcttcaggattcccctaatctatgaactctttgaagctttcccagatgaagaagtcctttttaatgttctttggtgttatctttgctgttctatagagttttagttaaatctataatattgtaattccatgtttgtgtatttatctttcctgctgggctgtgagatagaaaccatgtctcctttcattttgtatttctggtgtagtgctagactgtaataaatcctgatgaataaatgaatgaacgaatgaatgaatcactcaatcgattaatatatttttcttagggaacaatgggagaaaatctctggatctatatcagcgtatactgccctgacagaaattagaacattttcatctaataggttcacagaaatagctgagccagctttgtaaaattgtactgctttgctattttaattgttggttttatctttaaaatgcttgtaaagtactttaatattgttaatatttatctccgtgctcactttagaaaagttgaggcaaccttcagagagaaagaaatctgagagagacataaaatttgagataaggtacaaataactaattggataagccatcagatggctttctgtacttagcacaatttacttgaaggtaaagagtgggcaattatagataaaagaatacaacatatataacacaatatattttctccagaaacttacacttttgagaccttgtcaggatactaaatttactaacagctggagtagcaagcatttaattagcaccatttcagcaccatctctggatgatgtttggaacaatccaaactagagcttcatctctttaaggctttaagtttttgttaaaatcactaagactttcacagaggtgatattttgattacttacaggtgtttgacattttaaagtgattagtacctaaaggcagattttcctggaaggtgaaggatagaggttgttggtatggaagttttaaagaaaaagtactgtgactagagaccataagtcctggtttgccctggacagttccagtttatgcccattgtgtgattggagtcattaatagcatcccatatcattctcagaagtgtcctggtttgaacaataaatcatattgtcaccttaacaatgataaaaaagaacagtggttgtgatgagatcgtaagtggctgaatgtgctaaaaacaaatctggacaacataacagctgaccctgatttcttaggactgatgcctacaattctaaaggaagctttacctgcaattcagaatttatacaattccgaaatgtaacaatgaagaaaaaccccttttgatctttccaaatagtgagtttatgaatccattactccagcttacatttctacgattgcaaatgaaaacacttagtgtcccaagtagattatttattaatgtaaatcattacctaaactcatttatttttagaactgtgattacattctgatgatagtttgattgacagctaggtgaaaaatagtcttgatcagtaaagaacatgtaagcacacagtgataagacctgacgttggtttatagattatggtgtcattgatgcagatataagcagagaggtggggggaagaaatatttcagggatccataagtatgcttatatggcattctgagggcttttttgaattagaaaatcaaagaaatttttaaatgcctaaccattcattttataaagttgaagtctgcatctcaaagattgattaaataatcctttcgaagtggtggaatgtcaaagacgcagctgttttaccgaattattcaggaaggtccttggtatgtaagtgttcaataataacattcacataacaaaacaaaatcagatatgaaattattcactaatgaactatttatataataattattatgcaagtagaccaatacatgtgagccaatttagtgcacgatattttgcaaatgcaattttataaatctttcaaaagaattatgtcatgctaggtacttcagaagagaaatattttaatttcaaagatttgagagacccttgggaaaaggggaaatccttaaatatttctcagaaaaaaatggttctcaatataatcatgctatgcaagtcaaacatgagaggaaagatgttgtaatgcacctaataaaattttgtcaaaaaaatgcccaaaaggacaaatcagcacttaactcattctttgcgtattttaagaacaattttaccattgcaattaaaacttaaattctgtctaaaataaaaagcaataactttattttaatgaattttatttatttttaagataaaagtcttgtgtagttattttcattcaccacttattgcagaattctggacagttttaagtggattgaatttaaatggaattttttccagtgccctttatcttgaagtattaagactttctatcatttcattattcacttactgaatatatagtaattgaatatccttctggaaatagttctatactgcaagcttgcaaaggttcaggaaataaaggttataaaaattagctagatatatccaagtaaaataaaaatgattatatgataaaaacactgagtgtaagggcgaaaggttaacataattaagaaagtattttgtaaccatgaatgttaaaaaataatagaatttgaaatagaaaacccactctttgaaattctatatttatttaaataaatcaacagttctaattctctccttaatatcttgtgttttcttgagctttcatatataattttctgcagtttcctattcttccataagaaatgcatttgacttcaaatctgcttttccttcatcccattacagtcatggatgaatagtggctgacctccttattaaggccataaacctagagcaccctgcactcttcagtttgccattatttccacaaatagtttttactggtacttctttaattcatgcatcctgtaaaattcgttgtttgtgcaggaagaaacaatgagaacaaattcaatttggcatttccagactaactatactaaaacctatcagacctccaggaagagtcttttaacttctttgagtagaaatttctcacatataagacaggaaggatgaattattgtgttctagctctaagattcaatgtacaccattacagttagagcacactcataattatcagagaaaaaattgaggaaaccctagtccatgaacaatattatatgtattgtatagcattgtatagataatatcgcatggtgttttttcttacataatataaatatacatttaagtgtttgaatattaaatgttaataatccaattttaaaataagttttgtattatgtactacatttataaactctcctgtaatctggatattatgcatattaacactaaactctcacataattacatattataaggaaatgtgataccacaggagcataattagaggaaatgcaatccaaatctcattcagtattcttgctaatgctgatatcaatgggcacagagaattccttggaaggaatttttattggtaacagagattacaggttgggcatttccaaaatatctgtatacaaatattttgaattttaaaaaattctagtctcagagctttttggcataacttgttcatggcacatcattatgacacaaaaatataaaaaaaattttaaaatatttatttccgtcaatatatactgccaagtctatttctacatattttatttccatttctaataagtagttttccttacaacctcttggccatgttttgatgaagacctaaaaataataaaaaataatttcttattcataatataaagctttgatcttttttgtgtttttttcacttaaataatacatgtcagaaattactccttatcatttatattgaccttcctcactcttttttatagctgaaacactgaagattctaaggtgagtaaaatataatttccacgagatgtgtagtgaggatgatacacacctaaacaaaaacacttagtaacattttaaaagtgactttattgaaggtatgcactctgttaaattacaaaaaagaagagttttcatacttccgcaaaggaagtctggttgagatcagtagagcaggccatgtttaaactggataggaaggtaggggttacccaagaaagaaaagtttggtgaagtgcttgacagacatggtgaacagcacgccacacgtaacaggaggtctagactgaatgtctttgcagagtggggagtagtataagttcttcacacacagaggtccttccaacatagttgataaatttaactcagcaaaagtaagagcaacaggtttaggaatgttgagtatttctgcatgtttggccataagaagtatggaggggaaaatcacagactataaagctagataagtagatttagaatagtcaaaggagaaatgtttttctccttattcttttctgacatggatttatgaggcagtagttaaagccattacaatgtataacttttcccagcaagaggtcagaggataaaaggacagaactgtagtgaacttctctaacaggacagaaagaaggcaaggagtcagcaaaagagatgaagagagtgtctagaaaggcagaaatatgatgtgtcatcaagaaggaaaagacaacctaccagatagtagaaaacatttacaaactgtatatctgataaagcgttaatatccaaatatataagaaactcctacaactcaatagcaattttgtaaagagcaaatggtaagagacttaactagacatttctccaaagaagacatattagtggccaatgggtatatgaaaagatactcagcatcactaatcatcagggaaatgcaaaccaaaatcacagtgaggtaatctgacaattatagtaattataaaaacaaaagaaaacaaacaaagaaagtaaaagataacaagagctggcaggacatgaagaaactggaacccttgtacattttgatagaaatgtgaatagtgaagccaccatggaaaaccgcccaaagggcccacctcctaatactatcacctcagaggttaggattttaacatataaatttgaggggatagacacaaacattcagaccttagcatgcagttaaaaattatgttgacaagatacatctcatgttatctgttcttaccacaataataatttaaaagccccccccatcaaaaggttatttgagcaatttaggcaatatagataaatgatagatagatgatagatagatagatagagagaagatagatagatagatagatagatagatagataacacaaaaagttgatcctaaattgtagtgggttaaggattgaataagaattaaaattagagaaaccagtggaaaatgttaagtatattgtgaaatagaagaaaactgttgaagagtggtcttcaagcaaagaaagagcaatagaattaataggcttgacagaaataaacaggaataactcttcttaagagataggaagaaaaaagtcttccagcttatgtacatttctgccactgagatgctcagggtgtaagacaagagtgtgttactacttacttttccacctccaccccctccgcactcatctctcacaacaaacacacacaaacgctaaggtagaagtggtttgaggagaatctggactgctagtaatttttattaattataaaacaccatgttagtaatttctcatattgaaatgacttctgcagaagattataatgtcataagcctatcctatcacagtcttaagatataacatttctccttaatgcctccttttccattatcagcagagaaagaaaaaatctttgataggctattctggatgcaaatagaaatacacaaactatctagttagaaaatctgtttttaagccattagagttcattccttacacactgtggaaagctgtaaggctctttttttctcatgagagtgcgatctgtacaatgtgttaaaagtacagtttgaatactgtattttaaaaaaatacattatttttgcctatcacttgattgtgttatactccagagatttaataggtcagagaagttatttaagaatcacatataaagacagttgtgtgattttgctctgcccaaattcatgaaatagaaacatgacccatctgcctgtctcgatgattgaaaaaaaatatcccatagctgtacctgatcataaaggaacattaatagcagtcactggtattttattaccatatatcctcttttttgagaactgattctactgcaaggaaatgaagaagactgactactgagtatgattgacacaattttcctatagagaatgggaacagcagggcagggcctgcttaatggatgtgtggcctgtatagtcacacagggtccactctcagaaaggcctcatttttggtttagtgcttttctgctgtgaccctgaaattcttagtaattttaaataaagggtccagtatttttattttgcagtgggctctacaaatcatgcagctggtgtctgggagcatgaagacatacttagcacatattcttaagtgactctgtgtgtacacacatgtgagtgtatttgtgtgtgactgaatgtgtgcttatttgtacatgtagttgaaagaaaaaataaaaatgatattaaaaatagcaaactaaatcttaagagacaaaagcaattaagcttgcagtggaaaatagtttaaaataatttcctcatattataaatgatatggcagtaattaaggcttacattctcaccaaaaaaaaaaaataaataaataaaaagaagacatatgagcaatgattttcaaagtgggagatcagaagatgagtattttccaacctctcatatgttttaattaatagcaagagcatatcagtcttaatgatgaatcattccttttaatttctaaataacgctatggattaaggcagtcttcaacaaggaaaaaagcctaataacatctcagccatcgggatggatatttccttgtgattcttgtgattatgtatatgtatacaaaaacttaaaaaaatcctttgggaaataccaaaatagatattattataatttttaatatatagcaaagctttctctttttctgatttttagagaagacagaattgcctctctagtaatgtgaaatttcatttaacatttaagatataaactggatttttaaaatgtgtttctttaaaagggaaaatagtttttaccatgtgctttttcttttaaatacttgcatcatataaataaaatcgttctgataaacacctggttcaattttgcatacctcatggaatatgccaagtaagacaattgcctctcactggtgccaggatatttcattaaaaacatatgattaaacaagataagataaacagatgtacaagcaagcaaatctgatataaccgccaggtaaaattatttcctgaagagaaccttaaatctatgaaatggtctgttaggcaatgttattatatgcagcatactaaatataatttttatgaaaaggttgtcatataaaaaaagacagaactaaaaaggaatgaacatttaaaaaaattgtctcagatgtacttctggaaatttcagagtattaaatgtactgcaacaatttgtccataccacagcaagctctgtctctgttatattgaaggattactgttgaaagaatgtcattgagagcctaaactaaatctaagaacttctacatcagaaagaagtttacagagatcatcagatcttaaagaatgatgccttactctcaaaacataattcccatgccatttctggatgtaacagtttaatgcatagatattagaacagtactgatttgaaataagtaattgaaattatttctcatttttaacttttatttccttgggaaaaacataggaagactttttttgtgtttaaaatacagtatttatctttcagtaatcacatttactaatataaaatacctattttatagattaaatgattgtaattatttataaattgtatgacagtaagtcatggtttcaaatggagtactgaaagggagaaaacaactctgtccttaatatagagatttttttttctatttttctttcttatttaggcagttatttatttttaattattaaataaaatgaagagacgactttgggcgtaggtgacaaaataaaacctcacagatctgggtgatttagagaatgaagaaaagtcagctaaacaagaaatgagacagctttccaagtgcaaatagcattacaaacaaagataagagacagcaatgggcaagatgtgttgcaggtaacctgtgcagactggtctggctagagaagatgattcggcggtcaaattaagaagctccagctttatcttgagcacactgtaaacctatttaaggttcttaagcagggaaatgacttggtcacatatctgatttacaaatataactctgaagatgatgtgtttgaggggacaaacgggggtgtgcacgtagttagtgcaaaatgaagcacagttatgatacaggtaagcgtggtcagctgctgcaaaacagacctgaaacaaactggtgaattgtaaattggtacaatttgatagtacccttaggaagtgagagtgggaataactgtgacagtgtgtacttaacactgttgagtgttttctcaagagtccaggtagttatagtaagttgtaattgagagaaaaatatatcatgttgggagggctcactgaaaacttgtgtagttcctaggttttcttccttttgaagaatgcaccccatatcatatcaaacaagagaaaaaatagtttctactatatatcatatgttccaaattataaaaataatgcaaaataatatattttaagtattttttcaaatgtaaaaaaataagtaaatgggtttgtatattgttttggtcttttactactgtacaatttacttataattggctatgctttctgtaaaattattatgcatactcagaaatgcttggttgataaagttacccagcatattaatttcatagtaataaacttttactgaatattaaattcagcaattaatgaagttataaaatgagtttgtgtggatattcatgcaaaaatttactaatgtcaattctaagtttcttttttttgtttttggagttgtttttattttttataattttcaaatatttttatatactactgaaaaagtttagagtccttaggaaatatgactataatgcttactaatacaaaatgcccctagataatgtagggtatttattttataatagatactttaaatgtctaacataacttctaagaacatgtttatttccaaaatcacagaagaaaaacagggaggaaataagaactaaagaaacattttgctaattttttttcttaatacaggtaattattttgtttttttgcagggaaaataaatcgatgggcagtgttatgatcaaacggcagttgacagttattcccacaaactttgaactcaccttttcagtatgggaaactcataaagcttaaaactgtatttatcagattcccttgcaactatagttttatatgctaatcagattattccaattagatgtagcctccagatatttggaataaataagagaacaatctcctgacgcttttggctatttttttctgttgacaagtaagactgtagagataggagttcacccctctctttgccagcattattactgcaataactgttctgctccactggtgttagaaaagcactttaaatggaagtagcttcctggtcttggtttcttggtccctagatcttagctatagtgagtggtgtgtctttgctcttagtgatttcagacagcacttaattgtctaccttcttgattgtgatagagtcagtagctccccatgtggtattctgtgactcatccctggaggaccatcttccagcttgctcttccagcctgtctacaaatttgaaagcacctaatatgctttattaaaatcctctctccttaaaatatatagtgttgttctttcttacactgaacttgtctgatgtaattagtacctctttctttatggctgttttattaataatagaatagttatatatattatttatttttgaattatctctattattacatttgtatattttgcattctactgccttagggtcttttgtgagcatgactataaagaaaagttgcctaaaggcaacccctgtagcaaccacctccagcatttgtatctgacaatataattcaacatgctgtcctaggagtggaaggagagagaaaaagacttggaaggatagaaattcctttgcttctaccactagctacctcttcatgttgtcattaacaagtctctattcactatttttctttctgttgatttcaaaattcatgtagacattctacccaagaactttttacttgacctcctcatttccaaggaaattttattttactccatcgcaggcattcatttacatgctcaaatacaagactgtgtcatttccaagaaaggtactacccttaaaatttccatatcataattctactctttcctctagttcattattcccataatgttctctcatttcttttatttcacatccatcattatgattatttgtctgcacacttccctttttttttttttttttttttttttttttttttttttggtgttgcttcattgttttttcctgtaaaagtcgtagccctggtgaagttcaaatttcaatatacttcaagagtagacctactaagttaaatgtggttggagaaaaacttcaatagtgctaactgcctcacagttaagtgtataatcaataagaacagggccaatccaaccactgtaaaaggaaagaagtgagaataaatatggacagatgaaagttgatagatttggagataggcaaatacgaaagttactttttagctgtggtacctaccaagggcaaagtaatgggagtgatggtggtataggcattgtctgcaaaaactttaaaaaacatagtaagtttttttatcttagttctgaacagaagttcacaaatattttctgtaaattgtcagagtaatttaggctttgcaagcatagaccacgaataaacatggctgtgtctctataaaactttatttataaaaacaggcggccgggcgcggtggctcacgcctgtaatcccagcactttgggaggccgaggcaggcggatcacgaggtcaggagatcgagaccacggtgaaaccccgtctctactaaaaatacaaaaaattagccgggcgcagtggcgggcgcctatagtcccagctactcgggaggctgaggcaggagaatggcgtgaacccggaaggcggagcttgcagtgagcggagattgcgccacagcactcccgcctgggcgacagaacaagactccgtctcaaaaaaaaaaaaaaaaaaaaaaaacaggcatcaggccatattagatgcatgggtcaaagttttctagctcttgttttaagcaactgctgacaacaggaaaagactgtttcccacagccctagctttggtaggagtattattgccttctggttattgctttttgctcagtgaaaagagaaagatcattatctaagagtgagaaagaggagaagagatagaaaatctgaggagagagaagctaagtaggaaaaaatcagtaaggctgatgagaaattgaataggaaaatatatgatggctcagcagtgctctttgaataggagtcctgaagatttttggaagaatagtgaaaacaatcataatataacaaaacttattttaaattttaactttattttagttttgggggtacatgtgaaagtttgttacatagataaacaggtgtcacaggggtttgttgtacatattattatataacccaggtattaagctcagtacccaatagttatcttttctgcgcctctccctcctcccaccctcccgcatcaagtagatcccagaatctgttgttttctttgtgctctttagttcttattatttagctcccacttataagtgggaacatgaggtatttgattttctgttcccgcaattagtttactaaggataatagcttccagctccatccatgttcacacaaaatatatgatgctgcttttttttggtggtataatattgcaaggtatatatgtaccatattttctttatccagtctgtcattgatggccatgtaagttgattccatgtctttactatcgtgaacagtgctgcaatgaacatttctgtccatgtgtatttatattagaatgctttatattcctctggatatatacccagtaatgggatttctgagttgaatggtagttctgcttttagctctttaaggaatcatcatactgcttttcaaaattgttgaacttatttacactcccatcaacggtgtataaggttttccttttctccacaacctcaccatcatcttttactttttgactttttaatagtagccattctgactggtgtgagatactatctcattgcagttttgattcacatttctctattgatcagtgatattgagctttttttcatatgtgtatcggccgtatgtatgtcttcttttaagaagtgtctgttcaagtcctttgcccactttttgatgggattgtatgttttcctcttgtgaatttgtttaagttgcttatagatcctggatattacaccttttaagatgcatagcttgcaagtactttctcccattctgcaggttatctgtttactctgttgatagattcttttgttgtgcgcaggctcttaagtttaattagatcccatttgacaggttttgcttttgttgcatttgcttttggtgtctttgtcataaaacgttttcccgttcctatgtccaggatggtatagcctttctatttaataaatggtgctaggataacagaatagccatatgcagaagattgaagctggaccccttgtttacaccatacacaaaactcaattcaagatggagtaaagacttaaacgtaaaacccaaaaaaatattttaaaattagaattagctcttcagacatgaggagcactctagtactaattttatccaataaatgaatattattgtgcagcactgtggcctaagtgatggatgaactgtgatatgcctcagttgctgaagctaggaaaatattcagtggttttatttatgaagttttatgctcccttggtttgatccaaatatgaggacgaacatgtctatttgcagttttgactattaaaaattcaaattataactagaagttttcttcctaccaaaagaagactaaaatatttctctgtcagtcacagagaaggattgaagactgctgcacaaagattagagtacactcagggcagaggggtcaggcaataagcaacaatgcatcaaaaatagaaagaaaagagaatacccagtagtaattattcataagcaatctgcgagtatgttgaatggaggaaaccccctgacaataaaatttataaagaagatactaaaaacgagccttctgcaagcacataagtcgatgtagagtgtggtccctattacaaaaataaaacaaaatccaatcttagactagtatggcataagaagagctttgtgtgacgttaagaaaggaattagtaattgttcagtaaactttctgggaatcataataaaaagaaagataactattgattgagaacataatttttaaaattatattattgtataaaatgtataattttataactaattttataagtataattccataattataatttaataattttattaaatatcaactatgggtaagtccccttggtgctggagttacagtaatgaatcaggctaaaatccctgctttcatatgccaggagaaagactacatagaaataaataagaaacataacaacttgatgataataaattctatggagtaaaataatgcagaaaagaagggaccatagatgctttgtatatgatagtaaaatttttaacagtatgactgcataaaagataagtatatatgcaagtttagagaagagaaagtataaactcttacagcaggcaggtcctggcatgttcatagaacagtaaaaaggccagtttggctggaccagaatgatccaagggtggaatagtaggagacatgatcagaaagatgacagagttcagatcatacagtgttaaaacaattcaattcctgctattacaaatacaagtttattaaaaaaaagttctaatggtagaaggccaattaaagtacagttgacccttgaacagcacagatttgaactgtttgagtccacttatatgtggcctttttttcaaccaaatgcagattgaaaatacagtattggaggtatgcaaaatctgtgtctatgaagagcttatttttccaagacatctgttctgcagggctgactgcaggacttaagtatgcatggatttggttatatgccagaagtccttgaaacaatcccctagtataccaagggatgacagtatagtagctttgtattaaaaaaaaaaaatagaattattttgatgtttactaaaaatattctttctttctgagagaatatgcatgcatataatcctccccagccctgcagaactgagtccattaaacctctttcctttataaattacccagtctgaggcatgtcttcataatcagggtgagaacagactaatacagttcccaacatctagctcagtcacaattcctctgacatcctacaacctaaagaatgtatgaaaaggataaccacacccaatataccttatattaaatggtggagaaagaggagaggaaagaacacaaattaattgatatataaattgcaaatatgtccataagaaagcaaggaagaaaatacttataagaataaatactatatgattgaaatataggtccatcaattaaacctcagaatctgtattacaaggtttacgattgctcacatatattttgatttccttttctttttgcaaatattcttatggatctgattttcaggtagtaaaatacctattccaatcactatacttttttcaaaataagaagtttaggtttttttttttttttatatattttacctattctcctctcacctgtttcacaaagtcacaagttggtaaccttctatcctacttcacagagaactctgaatcaatcagaaagaaatttccacagactcacatcattccctttctctacctaccaacttctatttaaagccattatttctttttattattattattttattttttaagtttcgggatacatatgcaggatatgcaggtttgttacataggtaaacgtgtgctgtggtggtttgtaaagccatcatttctacttgagcactaaattctctatgatgtcccctaatccagtacatcattccaactattctctctcccacatcatgtttccaatttttcctcttccattcgcccttaaaaccacccttgttaacctctctcccttcaagtccatggaaactgctgttgtaaggaataccaatgtctttcatctggcaaaactaaataagttgtttgtccttatcttgtggccctaacacactatttaaccttgttgactatcctctccgccttgatttcctttcttcataaggcttccaggacactatactctgttggtttttctcctccctcactggtctctattcctaagcctctttactaacttcggtatcacagtgcccaatttcagcccttggtcctctttttatttcctacttgtactcacttcctaggcaatctcataatcttatgctttaagtaccatccatctgctgaacaacccccaaatttttgtttttattctaaatgtctctcctaccttcagactcatgtatccaactgatcagttaatggcttcacaaagaaaaagctaaagtttagctaatagaaaatctggatgtgaatcagggactaagggaggagaaaagggtagaggatacaatatcatcatattgcaaagtgaggagtcattagatactatccaaatttattgaaaccttagactgatgtcttaaatattcattctgaagttataaagctaacaataggataactaaagaataaaaacataaaaaggagtcaagaaaaagaaagacaatatgagtaagattctatttttttagtcaatatatattctctaaaaataaatacaaaatagagatgtatctttattatctagagttgttgaggtaacaacctccaaaaggactgaaaatgaaaatagtttataaatgtttcctatagtgtaagaaggagaatttttattttttctaagcccttcagtatttgttaccgcgtgtgtgtgtgtgtgtgtgtgtgtgtgtgtgtgtgtgtgtacagagatagggtctccctctgtcacccatgctggagtgcagtggtgcagtcatggctcactgtaaccttgaacttctgggctcaaatgatcctcctgcctcagcccccttagtagctgggactgcaggcacatgccaccacatccagctatttttttatctactatgtatatttatttaattaacatatattaattccataatttgctgacatcaaaagatattacctaactttgataaatcaatgataagcagaaatagtatatgagttatggtggtgttataaaaaaataaaaatggaaaatgacaaaacctattacttttgggcaaagggttggagatgaaaagaggacacatattttcttgttcaatttttattttgtataatgcatctattgcttttacaactaaaataattcattttttataaaggaggactaaataaaattaaaataatacattttataggaggaatatatttcccttcctatttctggaaagaatgaacataattcggcagcagggtcagggttgataggcaatgccattaaattaaattgaattaaattgggaagagaaggcctcattgtaaacacggaaaaagtagtgtgcagaaatgtttcaggagcctctatatgccaggagttcttcctgactgtctaactggttttaaatgattttataaaagatcttttcatggaaagaacatcaagggagcattagaggaaatctatatagagtgtgagcagaactgttaaattcctgttaggagttaccataggaaatgcctgtacaagttccacacattgtcaactttatgtagtaacagcaaagagtttgctcacccaatgtatgaggagttttaaggacaatcagcttcagagttctaacttcctatcccaactttgtttgtgctaataagtcatctagtttttaattgactgaatcattttgtttttgtggtcttcatgaaaaaagaagttaatacaaattgccaaaatttatcttgaaatattaaagaagtttgagaaagaagaatggagctgtgtggctagagaaaggctgaataagagaaaagtctgatgaataatgcaaggtgcacatgcagaaagcacagcaagcttgacagaaagctgttagaaagtggccagacctgagcaataggaagtatacatcctggtattctgcagattatgtaacaactgaggatcctttgttcacttaggatggtacacagtacaaagtagttgagaaacctgattttaaaaagaaaaaactgctgaacagagctgtaaggccggatgtaatcaactctggtctccctctctcatggtgaaacctattatattggtggagataagagtcacttaaggtctcctttcgaaatatacaaatctcaaattttgcctaaaagatgaggagaggctgaagttttaggaatatgaaatatgttaagaagagaacccaagccctgatttggagaaaatcatggaggcttttattattctcccagcagtaatttcaagtgttttttaggaaaaaaaaaatagcaattatctctttttcaaaaagggttctaacaggaaaacagaaacttttgtcatttaggcaacaaggattaatacaggaaattagacgttaaaaccagaaaagagcaggaaacgtgatggtcaggatgggaagtgactttaagcattcagcaaatcagaaggtccaagaataacagggaatttgctgctgatttacttcaaaataggaaatctccagggcaaagtgcctgaaacctctggcaaacctctgaaatatctgtcatttgatgaagcccctaaacctgtctgtcccgttgaggaataacagcaccttctgttacccttttgacttcaaagtctcatatgagcacttcatattggagaaattgatactgaactctatagatgaagacatgtttaccccctccacaaaaggagaaatacatattcttagcaattactgttagttccaatatgatttggctatgtcctcactcaaatcttatcttgaatggtacttcccataatccccacatgtcgtgggagggacctggtgggaggtaattaaataatgagggcgggccaggcgaggtggctcacgcctgtaatcccagcactttgggaggctgaggcaggcggatcacgaggtcagcagatcgagaccatcttggctaacacggtgaaaccctgtctctactaaaaatacaaaaaattagccgggcgtggtggcgggcacctgcagtcccagctactcgggaggctgaggcaggagaatggcgtgaacccgggaagcggagcttgcagtgagccgagattgcgccacagaactctagcctgggcgacggagggagactccgtctcaaataataataataataataataataataataataataataatgagggcgattacctccatgccgttctcatgatagtgacttctcaaaagacctgatggttttataagagtcttttcccccacttcgttctgcacttctccttgctgccgccatttgaagaaggacaagtttgcttccccttcggccatgatggtaagtttcctgagacctccccagctctgatgaactgtgactcaattaaacctctttcctttataaattacccagtctcaggtatgtctttataaacagggtgagaacggactaatagagatcctaacacctaattccatcacaattcctctgatatcctacaacctatccttgtctgtatgacaaggataaccacaaccaatatgctttatatttaaatgatggaggaagaggagaggaaagaacacaaataaattaatatatactttgcatatattatatataataaatatataataaattaatatatactttgttaatatgtccataacaaagcaaggaagaaaatacttataagaataaatgctgtatttattttatttagttttattttattttattttattttattttatatttctgcaactggtcacaagattgagattatttgaagaacaatcttagccacaagggaaatggaattggtgctacatatcctggtggaatctttgcttcttgaggaattaagaactgcaaactaccagagcctaaagacgtggggattagaaacaaatatcgtctgagtgggctattaggtataatcgtgagggctgccacttccattttaacacttggtatccaggactccgttctgggtatgtgaaaaatcaggtaccatgtactggtcacttgttccaagtatatatttaatgcatgttttagaacatctcattaaacttgcaaagggttgattcctaccaggtgcttggaccaactgcagggctttctctttctctggtaaccaaacaacaataatgacaacttaaaactatcttcaggtgttcctaataggagtattttaaagagtagctccttacctaaaggaataaatctcaaacagcataatttcactggcaatattatggaaacagggaggcattctctctcaagttacttgatatatgagccctttcactaaatctgctttaattttccatcatggaagaacactttccagaaataggaattgtaagaaaaattcccaagaatataatttattttaccatctgcttttcttagaaaacaatcagttaataaaatcagttaataacataattgccttggcaccatgttctgagttgtacatgtactacgttagaatgaaaaatgcggtttgttatggattgaggaaagagttccttgaaatcgttttttctccctcctttaaaaaaaattatgtattaattttttttttttttttgagacggaagtctcactgtgtctctcaggctggagtgcaatggcgcaatctctgctcactgcaacctccacctcctgggttcaagcgattctactgcctcaacctcccgagtagctggaactacaggcacacgtcaccatgcccagctaatttttgtatttttagtagagacgaggtttcaccatgttggccatgctggtctcaaactcccaaccccaaatgattcacctgcctcggcctcccaaagtgctgggattactggcatgagctactgtgcctggccctcccttcttattttgagttactttttggaaatatattttattttgaccttcaccataaaaaacttttaatactttattttatcctaaagaatttggcaacattttagtatattaacacggtggataataatgcaacacattgatctatggaaagctttttttattaatgtttaaatgattgtttttgcttatatttttcatagaagtttgcaaaataatgcttggtttaaggaagttatcatagaaggaaaataacttgttacttcaagtgcaaataattattgtgacgatgttatatgtgcatatatatttagatgtatatatatacatatatgtaatattgaaaaactaagaaataattttatttctgtatgcttacatataagaggtcttgtattatcttctttcattcttttttagcaaacaaatatagtaacagaagctcccatcatcaatatagggtaattatttcatttaaaatattttttgtatctggctgtctcttaatttgggggaaaatagtttgctctgtgacctcagttctttgatggatctaagaagagcagttgatttttagtttgttcagtatttttctcttatgcacaggagaggtgatccctacataccagacgagaccagaagtctctaaataagagattttcaagattgatcctttgcatctaaggaattatataatttttaggccaggcatggtggctcacacctgtaatcccaacactttgggaggctgaggcaggaggattgcttgatcccaagagtttgagaccagtctgggcaacatgacgagaccccatctctataaaaaagtttaaaaaattatctgggcatgatggcacacatttgtggtcccagctactcagggggctgaggcaagaagatcctttaagcccaggagttccaggctgcagtgagccgtgatcaggcaattgcactccagcttaggcaatggcatgaaactccatctcaaagatttaaaaaaaggggccgggtgcggttgctcacgcctgtaatcccagcactttgggagcccgaggcgggtggatcacaatgtcaggagttcaagaccagcctggccaagatagtgaaaccccatctctactgaaaatacaaaaaattagccaggcatggtggcaggcacctataatcccagctacttgggatgttaaggcagagaactgcttgaactgggaggtggaggctgcagtgagcagggatcgcgccactgtactccagcctgggtgacaaagcgagactccatttcaaaaaaaaaaaatttaaaaaaggaaaaaaatatgatttttaaagtgcaactcccaaaatttaaaatattcttagcatatatctaattttacttcattatatttctaatataaattaagtcacaaaatatagctaacattaaatctttggtctaatcttgacacgagtccagtttctgcaggatcaatttcttatcatatattttaagtaactactcaaatagagaaactgaccaggtgagaactatattgtaaaatataagctttgtggttacaccatttgaattcaaactttactgttcaacttcataataataaggtattttccaagttatttaagctattcaagcctcatttctttatatgctaaacagaaaataataatttctacctcatgataacatttaaaggagataatgcacatgaagattttaacatggtatctcacacatgaaaagtgtttgatgaatactagtttttaatggggatggtatttattttattaacaaacttaagcaatgatttgcatttataagatacagaaataaatgcaaaacagaatttgtgtttcctatttgtatttgtgttgaggcaggattatataattggtttgtgaaattattacacaaaataataattcaaagacagggtttaattttataactctggaaatagcatgttttcgaagatatatagatttctatcagagtaatactgttcttagatttatagttttgcattactctattacacaagctttggtttaattaaggcaagttagtgataaaaggcctaaatttacagctgaagaaattaataaaagtcctccttggttctgactttcaggaggaagacaggatcaataaaataaacatctgtgagataaaggaggcttttccaattatattaagtgatacacatatcatgcctttgatgacccatcctaggaaaagctctctgtactatagaagagttagtgatattatcatcataaataattataatatgcttcaaaaattctctattagtgtcagaactcagggttcgtaaatagttaaaggtttatacaacctgaagagaaaccagaatgtagatttgagtcttgagactgataaagaaatcgtctatggtgattcataacatttatattacattgaaatgtacagaaacaatttttgaaattctatttggttcttactacatgatttgatctttgctggcaatatttaaagattagctactaaacagcaattgcatatggtgatagaacataatattgtgatagaatacccattctgtatttgattaatgtatcaagtaccatatgctattcaatttggaaactataaattgattttattttcaaactattattgtaaaatgtgttattttcgcagccttttagtgatctttttgctattcactgtaattttctttgtcagaatataatcttgactgaaagaaatcctatttttaagcaagattgtgtctcataattaccattctcagaataatagctattatttatttagtgttgtgggtgtcaggcacttttctaagtactttaaatgtgcttctttcaacaacactatgagatactgttatgaatcatatattccaggtttggaaactgaggcaaggtaagtaactcttcaaggtcacaatgctaataagtattggaatccaaataataaaccaggccatgtgactccagtactaaattcttaaccattgcattcattgccaccacactcccaaaacactattctataatcaattttgctaaaaattttcagaatcagatattgtgacaaataacaatcaatatagcaagcagacattagatcaaacttttaggaatgaaacctttttatttagcaaagtgagatgaattaatatgtactttttattcttcaagagcagtcactgacagggactaggagaatggggagaagaaggatttctcacttccttttgtaaagatagacccagatgacttcaagcaggcactttatttcagttatttgttgggacaacgtaaaatatttcaatgaaaaatgaaatgtgtcagttgtcacattattttcttcatttatacttcatgctaaacctgactgttaaattatcaataaccaaaaggttttctacataacttctatgaaaagttattacatataaatgtaaaacgtccattaataaaagatttataatatttgctaatggaaattgaagcccattaaattaacagtgcatattgcattgcttggatgcaatcagttattgtacaaataaaaatattcttatcatcacatttccccttgaacttcaatgagttttaaaagcaatttgtaattaaaggtgtttttacattttggtagacttattcccaccataatctccagcaccaatcttcatcttgaggcagaacagccaggccagtgctgctcttttaggggagggatagcccagcagatctgcaagggttttctagttcaaatgcattctgctttgagttaaaagtcttttgaggcattgtttctggatgaaactcttctttttaaagtcatagtaaaggacaagattcccttggagaagatgtgattattcaaatgagcttcaagaatcgtgccctccgaacatggtctttgtcagtacaagaatgtccatgacaaaaaagctgaagactgattaagagttcacttatatcccttttcaacagaagcagacacaatctctgttccaattttccatgggacaccttcaaattaccttttcaatttttctaatttatttactaacatagagccaactcgagatgtagttactggtagtttcatgccatagtttcttttatttctcattaaacatgccactgaacagtaatatctctatcatttaaaaaaagggaaaccaccaatggaattatttcaaaagttgattctagtttggtttgaaatacactgctaaattcttaacttcaatattatgaatatgtttttagaaaagtatgtagaatgtatttttacattacttagctaatttattcttttagctccttttcattttactgtctgatccacaatattttcaaagtaagctactaggatctatctataccagagataaaatatcctgtaaatatttttcatgataagtgttacccctcttctattttcctagtcaagcataaatcaagatgttaatatttgccaaaattctggctcttgtaatttgtatgaaagcagtttaaaaagttgtgaaccatatttacaaaaagtttttttttaagtctgtgcttaattcatgtctttaaaactatactatacaaacattttttattttgcatctccatcagtgaaacgttgtgcatgcacccatatttatttacttatcatttgtgcaagttgtgctagtgtattaatacaccatgttccatatacatatgtatccatgtgagtatatatgtgtatgtgtatgtgcatgtgtatgtaagtgcatgaggaatcaatgcaattggccttgtggtattgccagtggatcctgactttactgcaaccgaaaatcttgaaggtgaatgttttagttcacaaagacagctacgtggacaatagtatatttataagattttcacctttaatataatctatcatgcttgaaaagttgttattatgaacctcaaccttctggtttaccttctgccagcagtagaggtcatttaatacagatgctttgcgtaagtcaccaccagatggcattcttgtgtctttgatcatacacacttatttctgaactaagaactactttattatgtgaagtctttaactaaaatttatctgcatcatctttttaattatgagaacgaggcagcagatatgttactttgcttacagagacttaagttctagttttggattctttacccatattgggaaaattcttttacttttcattgtacatgtattgtcataaataaaggatatcggattagatgattcaattcaagcatgtattatcaagcagctgttctgtccatagcactgtgttaaatgtgatggaggatatggcagtgaattgtcaatgcttttaaatagtttaagctaggcaacagatatttagtagacctctttacctgacttctatttaattaaattgccagattctctgttgttttatattttcttggtaaacacactgaaaataagaggtgggcagattgtaaaaaatacaatatggcatacgaagaagtttgtactttattatagaatagattacatgaaataaaccacttaaagttatcaagttgttattgtttgtttgaattttggctggtttctgttaatgacataggaaattacataatcaaagttgtgtttcataaagataaatttgaaaggaagaaagcatataatagggatagagagaccagtgagagggctatagtgccagaaataacagaaagacaatacagcatgatatcactcatatgtggagtctaaaaaagttgatctcataaaaacagagagtagcatagtggtaaccagatgctgaaatcttagcgatggtgtgttgggaagatattggtcaaaggatgcaaagttttagtcagatagaactaattagttcaagcgatgtattgtacctgatgactataggtattaacaatatttctagaaaaatgctacgagagtagatttaaagtgttctcaccacaaaaatgataacattgtgaggtaacatatatattaattacctacattcattcattccacaatgtacatatatttcaaatatcatgtcgtagatgataaatactaatattttgtcaagttaaaaaaataaaaatctttggcatctgctcaaaaaattacttattaaaatgataaaatgaaaaaatcttgttgtgcatgtaacaaatttgacttggacaagttaagcttaaaaatttgtggtgaacctgatgaaaatattaacaatttggtacagagctcaagaaagaggcaaaggaaatagattacagagtaaaactcctatagaatattgttagataaatggatagtaaatgcttctactttttaaattatcctaatatatttactagtaccacaaagattattttaaatttaatagcatcaccattttattcaaataatatttgaacatttgaacattgaataatatttgaatatttgaacattttcattttaaacaactattcagatccagatgctaaaataatgcatcctagataaaaaataagagcttctacttctatttttattcctatgaaactatattattatatgttagttacttcgtgttaaaagaaaatggagtttgctattataatttttttttattttatttattgagctttgcttctaaatgaacagaaacaaaatttttggtatagaggataaccctctgtttcatgtgggcactaaattactttcaaaatgtaacaagaatacacattgggctctggacaagagtatgaagcatagatgcttctcaaattttcctagcaacacatgaaattctttagctttttttttcttgctggcagctccatatctaaaaaattccaattaagccttttcttcctaacttataagtagctgaaaatactgaatttccctaaagttttaaacttttatatcttcaaaatgaatttattagtggtccaacataatatcttactttttctacatggtttttaaaacgaaccacttccaacaggattaatacaagtgacatttcagcaatttctatactgttgaaatgaactaagaaatggaaattttagtgggaaaaaatgtcttttagaaatacatccatggcttccattgctatatttacatactggggagagatgtaaaggttttattcaatgagtggagggaacagcattttcattttaagcaaaaatttaaaaacttcttgtttctgatcttattaaaatcaacatatgattctttggagttttaataaaaataccaaaattagaacaaagtaaagaaaaataaacagtgagtttcaggatttaaaaaaaaaagtacttatttccaaacatcggtgaatttacattttaactaaaagtaattgagtctaattttaccacacctttaaaataaaaggtgtctttcaaatatgcctttaaaattcaatttatcatgtttaggctcaatggtaaacttgagggctaagtgtacacagttcaaaaacttttcatttgttatttctcttaaaagtaatggctaagcagttacaatgaaatggtttatgaagagtttttattatattgttaaaaattagtcaatataacttactatatacatagtaagtaaatacatactcattttttaagtattcctgaacttgttttttaatatgttgtatgttcaaaaaaatttcaaaacctttgctgttagcattaataagtttgaaagttaaggtgtctttacaaatgagattagtaaataattttgtttagagtaatcatttagactctgggaagtgtagtggctatggttgagttgaggggatatcagaagaagattacaaattatatgtagagaaaagattagtatataaagcaagcaaggaagggagatataaagtagcatggctcattcaagaaacaaaatatttctggtgcacatagtgaatgagaggtaagaggaaaaacaaggaaaaaaggtggacagcgtcataagatctgatcatgaagagcttttaatacctttataaagatattagattttacacaacagatgacggggagtcactaaaagtaaaaaggagaaggaacaggtcagaattatatttcagattttattgtgagcaatggaaagtatggttttgagaaaaacagggaaatcagagggatgatttttaattgtcaggcaaaaaatgatgaggtcttgaggatttggctgaaaaaaactaccaataagaggctgaatttggatttgagaaatacggaagggctggtggaagaaggaattagtgagagtcaatgcaggaactaaaacaagggagggatataggatgatgccaagatgaatatcatcattaggtggttgaatgtgtgcgactgaattcttttattaagtacctgattcgggacactgtttcatgaacagtgaaataataagacagtataatccagcgtgcaggaggtgattacatcgttttctatatgagtgtcaggctgcagcttcctaacctaatttctaccactcatgttcaatatgtttcttgactattcattcttcacttaataaacattttcaaaagccttaccatggctaagttcttatttgctagaattttttcccatgtcctcagtctcaattgtttttcaatttttcattggaaaacatttgttagttcaagccagctcctttctttgcatctggattgcaactctgcggtcctgtatttctactcggaaagatctcctaggtatatttttcagatgctcgttgaacatcaaggaatattgcatgcttcacctgactctaatatataataattttggatggtaattagtggagagactagagttttccattgcctgtaagacctgatgatttggaccactaacttttccctaaagtgtttagtttcttttatgcctcagagctaaccttccccatactgctctcacttcctttagcctttccctcactgagtttccaatgaaggaaaaaatttctacaggatcaatgattgtattgaagaaaaggtctcacttctctctactctccacaggtggagaggagttggatacagatttactttttgagggaaaaaatataatcacatacattaaacaaagtaacttcaaaaaatttaacctacctgatttaaatctaatccatgtttctccatactgaaaaaattaatggtaattaaattgtccagaagaagaagagatattcttggaatatatttttttttttggtcagaagttggaatgtcagatgtagcacttagagtgaacagagacctctctctaaatccaggaacagaaattaatctctctctcataatttgctgtgtctttctttatttttatattttctaagcacttgaatttgttaagttatatatttgataatgaaaaaatacatatatttataaagtagcaaaaagttactgctatagataaagatgtctcagcaactcatacctgagaagatttactaatgagggctatgctgtcaatttttaacaatcagcatctttactagcaatgtaactataattcagtggacaataaacggtaaaagcaaaaccctgagaaagcatttctgctgcacttcatagcccaggggtagaaaggctgatttcctttgatagttggccactttgctatgaccagggggcaagttaatgaaaaaggagaagcagcagcagagaaacagaacttatgttccaactttggagatcagtctttctattggcacagcaaactgtgatcattaagaactctggaattagaaatggggggtttaaatccctgctcaaccacttactagatttgcaatcttgagcaggatagcaaacctctgaaacaactacaaaatataaatagtgacttagcttgtaagacttttagaaagacaaagggaactcaacaataactgactatgcatcagggtttagcttgtagaaatgtactataaatggtagagtaatcactgataattgttttctatagtaaattttgggattcctgaagtaaaaatgaagtaaggagtaataatataggaaaacaatgatgaaaagtagagattatgaagctgtacatgaagacaatagaaaaggaaagtagagaagcaaattgagtttacaaagatttacagaaaaatgcctcagaaacaatattacaataatttgacattgggctacttggagagagacagtggttaatttgagcagagaagcatgaaggtagtgtggagcaacataaactaggacaataaatcaagtttaacagaaccaagatataggatgatacctaggcaggttggaaaattaccgacaatttattagcaagaaatagactcaagttttgaacatggacactgaaaccatatggcctggaaccaaaccttggcttactagttatacatccaagtacaagttacttaacctctctatgcctcagtttcctcacatgtaaaactagtgagtaataatacctaccccagtaggattgtttggagtttaaataaattaatataagcaaagcactagactcatatttcatacctactaactgaattgtaagtatagctattattattatttttaataatgtccaagggtatagtttccttgaagatgtccaactcttctgtatatgattatccacttatgtatctactcctaattttatcattaatatcaattttaaataccctcataaatgaccttgctgtttaacacccattgaatgaagctatttatttacaagcccctttccctctgctagaatgttaattccttgagttcattgagcaagccttttatatctctgaattcttagcaaagtagtttccaagtctggctgtacattagaataccctagggaaacaagaatattaatctctgggcccaatttagatgaatacaatcaaattatctgctgggtaggatatatttttaaagtacttcaggtgaatttaaaggacagctatgactatctagtgttttgcaatgaatttgacatatagtttatgttcttctttcttttaatcaaaactcagatgatttacaaagccacataaatatgcataatataaatatatataaatataaataaacagtatatgcataatagcaggagagtttgatatccagaggcattaataaagatttaataaatatgtcagtcaggatcctggcaggcaacgaatggcacagaaaacctgggtgtggtgagagttcgtaaaaactaaaaaacagtgaagatttactaatgagggctatgttgctttcactttttatacctgtcctttttccctattgcttaaacaattttattccttcaacttctttgatgagactaaaagtaaagctcaccatatgtctgttataatctcctacaaaataaggacttcttccagaatgtaaatcaatgatgtccttaaacacagtgttttattgtcctgacacatttttagagtgaagctttgtaaatgaaagaaatagtgcactgagttacattctggcacaaactcattgtctcctggtggactgctcacgtacagcttgtagaacagtactttgagtagtagtggactagactttccacatcaacatgagaacttgctgaatatctttcatacaaaagacaaaacaaaacaaaacaaaacaaaattcctttgccccatgtttccctccaattcttttacagggttgtctgtgtttattatgggtaactcctctttcaccaaccattcataaagccattcccatcaggctttgtcaaggtcacctattctgttaaatcagtagtcagttttcagtcttcatctttcttgatttctcagtagcatttggcacaatagatcatctgtggcaacctcaatgttcagctatttattcacatatccaattacctactccatatgcttgcttatttggatataaatgggcatttcaaagtttatacatgtaaaacataatttttgaattgtttttccctgaacctactcttctcacattcttagctcttctgactcttaccaccttgctctaatatggaatgatctctcacctagattcttggaacatcacctaactactctctctgtttttgtgcttgccttcttatgatatattctcaatatatcagccagagtgatctctggaaaatataaaacacataatcacttttctgctcaaaaccctccaatgacttctgaattcagggtaaaatccaaacacttctaagacctgcatgatctatacagggatgctcctatctttgctactaactctgtgagcttgtctaccaccgtcccttccagacactgttaaggccatgagatccactttgctggtctatggaaacattttgatattagccacatttcagggatatgtaaaaggtaattacattttaaatttcacatttgcaccatcaattaaaaacaaagtgctgaattttaaatcttatgaataccatgaaaatattagaaaagatttgaatatcatatttgtggacattgtaggcctgtaaccttcactggacataattggctaataatatttttaataagttgcacctcaataattacacttttagaaatattttatttaattagatattttggttgtcttgtaatgaatcatcatttgatttattgagagtacataaaagattttttcttttggctaccatcagagttataattaaaaatcccatattttcccacaatccattgaacatttatttaagttgaaaaaattataaaatattttttcacacacatacatattactaaaataaagggaatctatggcagtgacaacctaaaattaatgtacaatagtgtaaatatattactctcatgtgtaactgaacactacaatgaaccaaaattaaattagatttctactaaaagcaagttgtatgttaaagatagacagttttattaataataaatcaacacaaaagcacaattttagctttcaaattattgcaaatatcttgaaatacaaagtggtctgtcttattaatcttcttttatttcaagtacatgaaaaattaaaaaaagctcatacaactcgttggctccatcaagtaaactgttgctatgttttgaatgtttgtccacctccagaattcatgttaaaatttaattgccaatgtaatggtatgaggaggtaggacctttaaagggtaaaggtgggtttaatgcctgtgtaaaaaagctcatgaagtgggctctttttcttgacccttccaccttctgccatatgaggaacagcattcctccccttcagaggatgaagcgttcaaggcaccatcttggaaacagatactttattcccactagacaccaaacctaccaatgccttggttagacttctcagcctcagaactgtgagaaatacatttcttttttttaaataaaatacccattctcaggtattctgttacaacagtacagaacggactaagacaaccacatttcaagttcattgggtgttgcctcattgtaaaatgtactgaaaatattaatctcatcagttccaatatctctattatgattgttactcaattacgatcttgatcattcattattttaaggatcataatgaaaactaaaaatattgatttaaatttaatatacaaaagcattgcttatctatataatataataacatacattatatttctacatactgacatcaatttttgagaaaagaatgagacttgtaataagaaaaccatttagtcagattttacctataacagctatttgactctgatctattcacttaattttcctggcctcccacttcttcatctgtaaactaggattttcaaactgatgagttctaagctgtatgtcaattctaatgtcaagattgtataataatgtctggaaaaaaatggtggttgcctgtttccaaatttcctccacactccctctaaaaatctataaataaaatcaaggatgaaaataaaaccatacatgcatgacatataccttcaacattaattggaaaaagagaatgctatactcttacttgtctggaaatagagaaaaagaaaaattcccacagagtccacctgcaaggagaaagtcaaacattcaatgttaaagtaccaaacacacttggtagttcacagcactgattaaatgaggagttttaaagtgtgtgggggcagagtgtggtggtttacgcctataatcccagaaatttgggaggtcaaggtgggcattcacttgaggccaggagttcgaaataagcctggccaatgtggcaaaactctatctctactaaaattacaaaaattagccagacatggtggcaaatacctgtaattccagctacttgggaggctgaggcacataaatcacttgaaaccaggaggtggaggttgcagtgagccaagatcgtgccaacgcactccagcctgggtgacagagtgagactctgtctcaaaaaaagaaaaagaaaaagaaaaaaaagtaaagtgtttgggattgaaagtagcagtctcagagagcaataattaatttctaatgagtgctactctttctctatacgtatgtatctccctcacaataaaaataagaaccacaacaaaaaaataaatgaagaatcccaaagaaacaagaaggaaacaacaatgtgtcttatccataccaacacaatctataaaataaattgtagagaagagtacagaagagggcattcttaaaccataaacattgttcatgaaatgaataggaatagaaaaaagtcaatcacatctacacaacaatattgtggtaaatcagaaatggaaacgacgcatttctgaggaaaacaattttccccctgaaagcaaccgaatacagtaaatcaaatatactcaaacacacaattgaagatataaaaacttccttgaatcagaaatataaatactagaattataaatggacataaaacagattttaatgaaacaaaaaatgaattaactcaggaaagatacagaaaaaatgacaaagtcatatcagaaataaagataaattataaggggctcaaggtagaaggtttcaaatgaaaatttaataaagggcattgactaaaaactgtggggaaaagaaagagagatcagattgttactgtgtctgtgtagaaagaagtagacataagagactccattttgttctgtactaagaaaaattcttctgccttgagatgctattaatctgtaaccctaccccgaaccctgtgatccctaagacatgtgctgtgtcaactcagggttaaatcgattaagggctgtgcagggtgtgctttgttaaacaaatgcttgaaggcagcatgcttgttaacagtcatcaccactccctaatctcaagtacgcagagacacaaaacactgcggaaggccgcagggacctctgcctaggaaagccaggtattgtccaaggtttctccccatgtgatagtctgaaatatggcctcgtgggaagggaaagacctgaagttcccccagccctacacctgtaaagggtctgtgctgaggaggattagtaaaagaggaaggaacgcctctttgtagtggagataagaggaaggcatctgtctcctgctagtccttgggcaatggaatgtctccctgtaaagcccgattgtatattccatctactgagataggggaaaaccgccttagggctggaggtgggacatgctggcagcaatactgctctttaatgcattgagatgtttatgtatatgcacatcaaaagcacagcacttttttctttaccttgtttatgatgcagagacatttgttcacatgtttacctgctgaccttctcttcactattatcctattgtcctgccacatccccctctcctggaaacgcccgataatgatcaataaatactaagggaactcagaggccggtcccagcacaggtcctccacatgctgagtcccagtcccctgggcccatttttctatctctatactttgtctctgtgtctctttcttttccaagtctctcattccacctgacgagaaacgcttacaggtgtggaggggcaacccacccgttcaaaaacaggaaaaaatgctaacagaataaaaatgaaataaagaataaacaaaatggatcagagagaaagtagctgacatggaagagaaataaataagttgatttagtatccttgaaaaagcaagtaaaaatgatgaaacagaactattatttacaagtataatctataaaagttttcaacaataaagaagtctccagtctagacttgaaagggattactgggtactgaagaacattgacctggtacaatcactctgagacaaattctaataaatctttttgttacagaaaattaaaagaaaaaatattaagagcctccaggtaataagttgaaataacacacaaaaagcatgagaattagaaaggtatctcaactttccaaagcaacatgtacagcaagacaacagtgaaggagtatttttaagaaacttaaggaagtaagagtgccctaagctttcctttgagtgaatagactacagaaaaaagctttgaacctgaagaactaaaggaattgtacacatgtgctcttctaaggaatctaccagattttttagagctttattcaaccaagagaggactgggaaagttttggcaaattaaccgatagtgagaaatttatattttaattttagaatgaagatgaaataataggtggggttataaatagacgaaaagtatataaatattatatttcctgccaaagtagaaagaatgtaacaaaaaaatagtaacataggggaactctgcgtgagcttttaggaaagcaagatatagttttccaatctacatttggacctgaggcattgtgaggctagagcaactacctccatcttggtactgtcttcacctacttgtcctcttgttttaaatgttttaagcacaccttgtttcttaattcaaataaaagagaacatatcagctatggaaactcatactttttttggttctttctctataaatttatctgcatcaaattcatcctgacacattaacttctggtacatgacgacatgcctatccctgctcatgattattctctccatctacaaccttgaaatgatgccttataattttctcactgacacctgggtgcactgttgagttttcagttacctaattgccaccaaatctatcaaaatttatatttcagatatgtaacacacctctgaattgtggaacttatctacacaacatacggacatccaccttttagctgatagtacctacttgtttctcaaatcttcctgtgagaattttccgtactttattcccaggttttccatataaagagcccaaatctctttcttgagttccagctgcaaattaacagctccaattttatgcctcacggtgaaattatatgcactgagtcgaaatctactttatttttctacttcacaccttatcttccctctttacattatatttttgtaatgtcatagcagctgttcacccagtcactaaagaagaaagctgtatgttatctttgattatcccctatacttcaatgctactttcacacctgtttgggcattagagacaattcattttgtcttttaaaggtcttcagattctattggctttaaaaccccaactgtcaatatcttgggtaagggcttctatcttttctgtataattgcagtagcctcttaattcacatttcacctttgattcactgtctatacaatttacagaataatcatatccaaatataaatcatataatacaactgattgcttaaattcctctgatgacttcctaaggtctaaagccacatttttaatctcatctgctggtgctccctccttgttaccattatgcttcagaaataataagtacttatagataggcctttggagccaggctttcaggattatacactgctttttatgcagtgtaagatgcccaccacttatatgcccccactttgctgacctgatatcacctctcatctgaagactgccctgataccttgtccctttgtcaaattaattacagggctttctccaatgcactaccatcataatataatattattatatgatatattatcataatagaaacttgtactaaaacttctattattatgttaatgggtatacatttttatttgttcatatccatgtctacctcttgtctaacaaggcagaaactgccttaaaagaagaactcaagcatatagcatctgtcatagcataaatccaaaaactagaagtatttaataaatgttagttgaatgaatcacataaattgtgatttaaatatcactgaatcaagcttttatcattttgaattccttgttacttatattatatacaataatttataaattaagtttcgttttttagtaagtcaagttgtaatcattcttcttttattttaaatcgtagcaaaaaatattttggtgaataaattaacatacttgaaaatttacacagactttctagttacaagcaggcaaaataaatcaattattattcacaactgagtgggcctcaaagtcatatgattatttaaatgtaagatgtgacaaactaaaaataaaagtgagtctcactgtcatggatctacttaacccactttgccaatctagttaattcacaaagcaatatatttgtatttcctaagcacccattgtgtgttttaactatcttccatctttgcataaaatatacatatttagaaaatgtgctaattttcacaatagtattctaaatctgaatcataaaaactaataccttttatctatatatagaaagttacctttatttgctgtagttttacaataattaggtcagtattttgtaggattacaactaagacagcacatttacaacttctagcatgatacttgatatataaaaggtgcccaaaaaaatgttaggatctgtctcattcctgacaattgcaagtaagccacataaggagaaaatagatttttcagaggacagcttatcttttagaaaatgatagagcctcatttacattttcctattgactccttatttaaaccatgggaaacataacagccgtatcacctgtatatgcacaataaccataataatttacattgtgaaaggaaattcagtggatacaacaaaataaggttcttacccaatgttgctttttaaaattattattgtattttaccccattattgaatcatatttctcagtttttttattatcttcataaattttcctactaaataatccaccaaattatttttcttacgaaaatacatcatcatcttataagcttcaacttgactaagatttaggcaacaagaatttgaagtgtcaaaaagatataatttactttctttcatttacttttggtatgctgctgtctaaatcctgtcttctagactaaggtcagattttcaaatctcatattttctatggtgtcttgcaattctccattttcttgaacattaatcttctattttcagatctaaaagggttggaaaaattgccttaagacatattgtgagcagcaagtttgaggtagtgtgagcttgaccaaaaatcctattacatattcctggatgctaatgaatatttgaattaatttttaaaattgtcttttagttctaaagcaatgaccattatattgtttccttacatttccctcagaagtttctatatgttaattctatatcaaggctgtttgagaaacacatccttgggtaaggaattttagttgattcactcgtgtgtaaagattaacaataaatatacaatttaatttattttaaatctcatcatatatttttattgacctcccaacctctgctgtaaaaggatccgaaacataaatgtggctctggatagaatgattaagcatgggaaaagcttttgtacattttttagtatgttatttttccatcttcattttcttcttttaagctgtatttctggagggttatgcatcatttgtgaccaaaatttggagatgctgtgcccaaaaatgaaagacaagcaaaaataataagcacacaatatatttacaaatacgtgttattgataaaattcagcaaactttccaggctttgtctggttctttcatttaagtaaaagcaatatgaaatttttctcccacataatttcacagaacacaaaccacggaaagaaaagtagtatgtttaatgtaaataaatattggttgtattttatactctattttatagcttgtgttgtttgaatttttctatttgtataaggcattttcatcctgtttaggatgcctatttaatgtatctaacagctttaaatgcagatacttcttaataagtattagttgttgatgatattatttatgaaccataacaattgccagtatgttcaaacacgattattttaaaaggtgtaagccaagatatttatacaaagataattcaatttgagtttctattgttcctcaaagaaacaaaaaatgcattttcttctatttgaggaattgctttgaaaatgccatgacttggtgaccacgactgaattaaaagacagagacaatattccatttccttatcgctactagggatatatcaagcagaaaatgaagacattattattttgaatgagtttttcaagtcagtttgagtcaaagtttgcctccaacatatatttaatgtagtctgcaatgttgtgaaagctgaaataaacatgaatgacacttgagagcactggccagaatatgttgcttactgatgccctgatacttttttttaacctaaaacattgccatggaaattgagtagtagactaaatcagaaaatcatattaaatatatcagtgagaacagccaccttaagctttccaatgcttctactaacacaaaataaaacattttataaatatttgtggacaactttggaagtagtaatgactacttttttaaaaaatcaataatctttgtttttagagcagttttgtgttcgcagcaaaattaaacaggaagtacagagttttcatatactccctgccctccttcacgtacaacctccccaactaccaacatcccacactactatggtacattcgttaaaattaatgaaactacactgacacatcattatcacccaaagtccgtagttcacattagaattcaggcttggtgttgtatattctgtgggttttgaaaagtatgatggcatgtatctactattgtcatattatgtatcatagctttactgacctaaaaatcctctttgctctgcttaatctctctcgctcccacctaatccctggaaaccactgataattttattgtctcaattgccttttccagaacatcatatagttgaaatcatatagtatgtagacttctcagattgatttctttcacttagtaaaatgcttctaagtatcctccatgtcttttcatggcttgatagatcatttctttttagcgccatagtttatttatccattcacctactgaaagacattctggttgcttccaaattgacaaatatggataaagctgctgtaaacctccatttgcaggtatttgtgtggacataagttttgagttcatttgcgtaaatttcaaggagcatgactgctggattttatggtaagagtatgtttagttttgtaagaaactaccaaactatctctcaaaatggctataccattttgcatttccaccagcaatgaaacagaatttctattgctccacatcatcaccaagatttgttgccatcagtgtcctggatctgggccattttaataggtagctagtactatctcattgttttaatttgcaattccctaatgacatatgatgttgaacatattttcatatgtttaattgccatctgtgtatctttttccagtctgttcatataatttgcccatttttttaaataaggttggtcattttcttattgttgaattttaggcactcattttgtattttggatagcagttttttataagatgtgtctttgcaaagattttctattagtctgtaacttgtcttctcattatcttgacactgtattttgcaaagatgtgtgtgtgtgtgtgtttgcgtgtgtgtgtgtgtgtatatgtatttaacattgacctcagcagtagctcaaagtttttcattaatatgtgggttaatctttgtggcaaactatattattattttaaaagattcaccctcttccctcatatttgaggacagaatctactttcctgtcccttaaatctgagcttgacaatgtgtttgatttaaccaatagattttaggaaaaaaatgcaagtagagctttaaaaatagttgtacaattaaaattttagcctatgaacttttttcccttgtcagaaaaagaccatgcatggctttgcctactggaccaaggagaatgaataattcatgggtcaaaattcagcctttaaattcaaaattcagccatcttcagcccatcacagagttgtgaaaaaaatagttgtgttaagctattgaatttgggatggtcagcaccatcaaagtgtccatcaaatgatgcaatgccatatttagaaaatgacttattcatataaataagtacctctttgcatgtagtcagatcagccctattctaaaattctaaattctaaattttattctaaaattctgaatgaaaattatcaagatttctttctcatgtgagataagcaaaaagcaaaaatcacattgggattttatttaatcaaatgaagaactctgatctcctctgctgttaaaaaatcaaattctgtaaacctaaatgtcacacatatatcctattttatcttctacttacagtaaataaggaataccattttactaatatttcactaatgtttcttccacttgaattaatatttttctttgatttagaatttcttccccaattagatataataaataatcaccactatatcatatttaaaattaaatgattattgacattgaggggaaaacacattcttttcataggaattgtggtgattatagattatttgacaaagttcttatacagtaacgcaaatgtatttgtcaatgtgacaattacatataccctggcgccatgtagaaacgcaaagtgtgaagcaatatagtacaatataaagtggcattctcagatacaatagtgtatagttccccattggctcaggcactacttataggaactataagagaagtcaaacaatctttttgagtctcaatttccttatcttaaaggaaatgaatatattcaataaaattatctaatcatctctaccagattgaaagggcaaagtaaggcagctgaatagaatcctccagtgaccgtcaacatctgacacacaaaatcatcaaattgaacatctatccacacaagaaagcacttctgtaagaaccaaaaatcaggtgagcaaccacagtacctgcttttaatatcatgtcaaggaaagagacactgaagggggaagtaaagacagccttgcactgcctacaccacacctcccacatcgtccagcagcagtggggcacacagaatctgtgtgcttggagtagggagaacacaacaattgcgtgactttgcataggaactcagtgttgccctgtcagagtggaaagcaacatagggcagaattcagctggtgtccatggaggaaacatttagaccaatcctggccagaagggaattgtctatcacagcagtgggaatctgagtttggactagccctactaccataggcgaaagtggtctgggctctaaataaatttaaaaagcagtctaagccatgaggactggaattccttgacaaatcctggtgctgtgctgggctcagagccagtgaatatgaggttcatacaacctagtgagacaccagctggggcagttaaaggagagcttctgtcacccacccctaactccaggcaatgcagctccaggagagtctgttgctgcttgaggaaaggagaggatagagtagaggatttgtcttgcatccagctcagccatagtaaaataaatcaacaagcagactcctaaagtccctgattccaggtatttatagacctgccctggccagaaggaaagcacttctctgaaggaaaagacccaggcctggaaggattctgcataatctgactaaagagtctttgggccttaaataaacattagtggtagcccggcagtacttaccatggttgtagaacagggatggccatgaggtgagactccttctacttgaggaaaaaagaggaaaaagtaaaaagaactttgtcttgcaacttgggtaccaactcagctacagtaaaataaggcacccaataaataactaaaattcataactccagatgctagctcacagacaacatttctagattcaccttggaccagaaagaaaccaaccacctggaagagaatggcactagtctggtaggattcatcatctgctaactaaagagcacttggaccttgaataaacaccagcagtagacaggcaatagttgccacaggccttcggagacagccagtactgtgatggcttcagctgtgacccaacatagccccagtggtgctgaccacaggagtacttgtgtcatccctccaccaactgcaggcagctcagcataaagacagagagactctgttgggaggaaagtaagtgaagagaacaagtgactctgcctggtaatccagggaagtctcctgaatcttacctaagaccactaaggcagtatctccataagactgcaagatttatagcgttactgggcttggggtgccccttaatgcggatatggcagtagtcacaaaatacttaatcacaatactcaatgctttttgattacttggaaagtcttctcaagaaggacaaatacaaacaagcccagactgtgaagattgcaataaatacctaactcttcaatgcccaggcatctacgaacatccacaaacatcaagaccattcaggaaaacatcatcttaccaaatgaactaaagaaaggaccagtgaccaatcctgtagtgaaagatattcaaacaaagaattcaaaatagctgttttaggaagctcaatgaaattcaagataacacagagaaggaattagaatcctaccaaataaaaaaaaattaacacatagattaaaatatctttagtaataaagtagaaattatggagctgaaaaaggcaattgacatactgaagaatgcatcagtctcccaacagcaaaattgatcaaacagaagaaacaattagtgacctggaagacaggccatttgaaaacacagagtcagagcagacaaaagaaaaaagaataaaaataataaaggatgcctaaaagatctacaaaatagcctcaaatgggaaaatctaagagttattgcctttaaagaggaggtagagagaaagatcagggtagaaaatgtattcaaagggataaaaacaaagaattttccaaacctagagaaatatgtcaatattcaagtgctagaaggttataaaacatcaagcatatttaatccaattaagaataccacaaggcatctaataatcaaactcctaaaggtcaaggataaagaaaggattttaacagcagaaagagaaaagaaacaaatagcatacaatggaactccactatgcctggaatcagatttttcagtggaaaccttacaggccgggaaagagtgacataacatatttaaagtgctgaaagaaaaaaaaaatctatagtagtatacccagtgaaaataaccttcaaacatgaaggagaaacaaatactttcccagacaaacaaaaactgagggattttgtcaacatcagacctgtcctataagaaacgcttaaggaagttcttcaatctgaaagaaaaaaatgttaataagtgataagcatttatataaaggtaagacattcactggtaatagtaagtacacagataaaaaagaaaaacacggtaattgtggcgtgtaaactactcatgtttttagtgggaaggctaaaatatgaacctttcaaaactaataactacaacaaattccaagaagtagtataatgacataaacagacataataaaaatttttaaaatgtgggggataaagagtagagtttttatcagttttctttctgcttgttaatttgttttgcaataagtgctgttaatagtttaaaatcatgggctataagatattatttccacatctcatggtaacaaaaactacaacagatacacaaaaaaatagaaagccaagaattaaaacataccatcagagaaaatcaccagcacataaacgaaggaaggaaggaaggaaggaaggagggagggagggaaggaaggaaggaaggaaggaaggaaggaaggaaggaaggaaggaaggaaggaagggagagaagggagggagggagggaggaagggagggagggagggaaggacggagggaagattataaaacaactagaaaaataacaaaatgaaggtagtgaattcttacttatcaataataacattgtgtgtaaatgggctaaactctccaatcaagagacatagagtgactaaatggatttttaaaaagtcctaaatatctgctgcctagaagaaacacacttcacttacaaagatacacatggactgaaaatacatggatggaaaaagatattccatgcaaaaggaaacaagaaaaaagcaggagtggctatacttatatcagataaaatagatttcaagacaaaaaaaaaacataaaaagagacaaagaaggtcaatacatgttgataaaggggtcaatccagcaagaggatataaaactatacatatatatgtactcaacaccagagcactcaaatatataaagcaaatattagtgctaaagaaagagatagattctaatacaattatagctggagatttagcattcaagtttcagcatcagacaagttatccagatagaaaatcaacaaagaaacactggacttaattagcaggataagccaaatggtcctaatagatatttgcagatagaataaaactagaaatagataacaagaggataaatacatgataattaagcaatatgctcctgaatgaccagtggatcaataatgaaattaagaaggaaattttaaaatgtcttgaaacaaatgataatggaaacataacataccaaaacctattagatacagcaatagcagtactaaaaggaaagtttatagcaataagctcctacatcaaaagagtaaaaaaacttcaaataaacaatctaatgataaatcttaataactagaaaagcaagagcaaaccaaacctaaaattcgtagaaacaatagagatcagagcagaaataaagaaaattgaaacaaaaaaaatacaaaagttcaacaaaatgaaaatttgtgtttcaaaaagaagcaaaataaacaaaccttatgtcatactaagatacaaaaagagatgactcaaacgaataaaatcagagatggaaaaggagatattacaactgataccacagaaattcaaaggatcattagatgctactgtgagcaactatatgccaagaaactggaaaacctaaaagaaatgaatcaattactagacacatacaacctaccaacattgaaacataaagaaatccaaaaccttaatacaccaataacaagtaatgagattgtggccataataaaatgtcttccagcaaagaaaaacttgggacccaatggattcagttgattttaccaaatatttaaagaagagcaaatactaatcttactcaaagtagtccaaaaaatagaggatgagggtatatgtccaaactcattctacaaggacaatagtatcctgatatcaaaacgagacaaagacacatcagaaaaagaaagctataggccaatatgtttgatgaacattgatgtaaaaatcctcaacaaaatactcccaaacctaattcaacaatgcattaaagagatcattcattatgaccaagtggcattcatctcagggatgcaaagatggttcaacatctgcataccaattaatgtgatatagcatattaatagaatgaagaacaaatctatatagttatttcaattaacaatgaacaatcatttgataaaattcaacatcctttcatgataaaaacccacaaaaatgagtatagaaggaacatacatcaacagaataaaagccatatacaacagacacacaggtagtataatactaaataggaaaaaaatgaaagcatttcttctaagatctggagcaagtcaaggatacccactttcaccactattattcaacatagtaccagaaattgtagctggaacaataagacaagggaaagaaataaagggcatccaagttggaaagaaagaagtcacattatcttcatttacatgcaatataaatttatatttggaaaaatctaaagagtctaccaaaaacctgttagaactgattttaaaattcagcaaagtttcaggataataaaatcaacaggcaaaaatcagtagcatttctatctgccaacaatctgaaaaagcaatcaagacaagtgaacaatctgaaaaagcaattaagacagtaatcccatttatgatagctacaaataaaataaaatacctaggaataaatttaatcaaagaagtgaaagatctctacaatgaaaattataaaacatttacgcaagacatttaaaagaacaggaaaaaaaggaaagatatattacatttatggattagaataatcagtattattaacatgtctataaagcaatctgcagatttaatgcaatccctatcaaaataccaatgacattcttcacagaaaaagaaaaaataatcctaaaatgtatatggaaccacaaaagacccagaattgccaaagccatcctgagcaaaaagaacaaatctagaggaatcacattacttgacttcaaattatactacagagctatagtaaccaaaacagcatggtagtggcaataaaaacagacacacagaccaagaaaacagaatcaagaacccagaaataaatccatacatttgcaatgaactcattttcaacaaagatgccaagaacatacactggggaaaggacagtctcttggataaatggtgctgagaaaacctgatgttcatatgcagaagaaggaagctagacccttatctcttgccataggcataaaaccagatcaaaatgaattaaaggcttaaatttaagacctgaaactactaaaaggaaacactggggaaactctcaggacattggtctgggcaaacatttcttatttattaccccaaaagcacaggcagccaaagcaaaaagggacaaatgaaattatgtcaagtttaaaagcttttgctgtggcaaaggaggcagggtgaagagaaaacacacaaaatgggagaaaatatttgcaaactatctatttgacaaaggcttaacaactagaatatatatacaactcaataggaaaaaaaaaaccaataatctgaataaaaaatgggcaaagatctaatctgaatagatatttctcaaaagaagacatgcaaatggaaaacatgtatatgataaggtgctcaacatcattgattattagagaaatgcaaatcaaagctacagtgagatatcatgtcactctgataaaaaagactttttttattattatactctaagttctgggatacatgtgcagaatgttcaggtttgttacataggcatacacgtgtcatggtggtttgctgcatgcataaacccaaaatctacattaggtatttctcctaatgttatccctccctagcccctcacctcccgacaggccctggtgtgtgatgtcctccctatgtccatgtgctctcgttgttcaactcccacttatgagtgagaacatgcagtgtttggttttctgttcctgtgttagttggctgagaataatggtttccagcttcatccaggtccctgcaaaggacatgaactcatccttttttgtggctgcatagtattccatggtgaatatgtgccacattttcttaatccagtctatcattgatgggcatttgggttggttccaagtctttgctattgtgaatagtgttgcaagaaacatatgtgtgcatgtgtctttatagtagaatgatttatattccttttagcatctacccagtaatgggattgctgggtcaaatgatataaaaatgaatttcttccaaattttatccaaaaaacaggcaatagtgaatggtgaattctggcaaggatgtggagaaaagagaactctcatacactgttggtgagaatgtaaattattactatggagaacagtatggaggtacctcaaaatactgctaggtatgtacccaaaagaaagaaaatcaggttatttaagatatatctgcactcccatatttgtcgcagcactattcacaatagccaacatttggaatcaacctaagtgttcatcaacagatgaagggataaaaaaactgtgctgcatatacacaatggagtattattcagccagataaaaggtgagctcctgtcatttggaacaacatagatggaactggaggacaacatgtaaagtgaaataagccaggcacagaaagacaaacttcacacattctcactcatttgtggaagctaaaaattgaacagttgaactcatggagatagagagtagaatgatggtaaccagaggctgggaatgaaagtggggtggtcgggagaggaggtatgtggtggtgactggatacaaaaatacagttagattgaatgaataagatcttgtatttaatagcagaacagggtgactacagtgaaaaataatttaatgtacattttaaaataattaaaagagttttattggaatgtttgttaacacaaagaaatgacaaatgtttgaagtgatggataccccacttaccctgatgcacttattatacactgtaggcctgtatcaaaatatctcatttatccataaatttatatccctaccatgtacccataaaaatgaaaaattaaatttttgttttaaaaaagtctctttcagctccaatgttctatgattcccctactttaataaatactgacccttgtcttcaggggaaaattgggaaacctgcatacatgaaaagggaggagtgttcttttgcctgcattggagaaatggacatcttttgtcatcatagctatatacatgccttttacaccaaatcatggcatgttctttcctgtctttcagctttatctagtactactcctaaaacacctctctctccattcccaccacgcatcctagaattctctcagctccaatggaaccacttgcacacattggttatgctgccccagttcccacctcctacttagccacaggtctcattcaaagttcaccgcctctggaaatctttccttgaaggctgcattaggtgtcttattatagtctccaaaaaacacattctgtttttcatttttagtattaatcgcacttaaaattatttttaagtatcagtctttgtcccactaaactgaaaataatgactaagtcttttatattttacaatgtaccctatccccttcacaatgcctggcacatagaggaaactctataaaatatttttaaattgacataacttttaatattctactaccactcattctaattcttggcatgtagaaacaaaaggcttagttctcacagcaggttgggacaaacaaaattaagttagacattttagaagcagttgttttctgaaagaacttggtatattgaatgtaaaataaaataaacctctaagttaataaagagcaagaacaaacagaatcaaccttactcaaatataaacattttcatgagtcatgcttaaaagccctctttattctgagaggcagatggaaatgttatcaaaaaattcccacacaaaatatcacatgtgacttggtaatttttcctaggcaaaagaaattgtgtcttacagactccaggatttgttttttaataaaaattatataaagagacatctcaaaagatacaaaaatgtgaaaacccaagtctttcttggctcagtgctaagagaccatcatcagacaataaggtatcaaatttgtgcagcaagttctgagagagagtgtctcaggattcatacaaagaacatttgtcccatttaagatatctcagtttactacaatgaatcaatattgagtgcaatatttttggatagcacaataaatatatcaatatcaaatttaataaaagtatgctagaactcaaaagaaatgcagagactacttaatctaagcttctagttttaggatatggaaactgtccttacagcaaacactaaatcagcaatgcatatggaacactacagagaaaaacaattatttaaataaatgagttttgactccaatctaattgtatgaacactgaaatgtatctgtgtaacatgcttatattatgttagtatatgacagataattcagtcactgaaatgtatctgtgtaacatgcttatattatgttagtatatgacagataattcagttcctaagaaactagaaatttcagttttacttttcacttaattaaacaaagtttttattattgacataatgctgttttaaagaaacgtcaaatcataattttaggattttctatagatgactttgatcccactaaattggatttcacttgagttaaaggatagaatatggggaaatatttgtaaaataaaaaagatataactatgccttacataattttattttactaaattgatttgtaccactagaaaactaatgaatgcatgggaatattggggaattacaaactttaaacagtcctgacagatatttattattcattcattattagttttctgctttaatacacatttttattattaaaagttaagaatcaacttttaatagtacagtaattatttaatattaaaagccatttgggttttacattaaccaatctcttttacagattacagattgatatatttatttattgtggtaagtactgtggggttgcaatgatgtatagtataggatctctgtttatatgtgctaactagacaaataaatatacataaaaacgactcttgccagatatcatttcatttctccactatacaaatatatggtgaaaacattttttaaacctgactctaatcaggaatatagcaaaggtaaatcttgggattctacaaatggtaggattttttgagaaatactctaattaagttttggaaaatagcaaataaatggaacaaaagtgaaaaaaaatcatatatatggagaaaaagaaagatgtttccagtttcaaaaaaaaaaaatcagttcctcacaaaagagcaagtcagatatttcttaggcatgtaccatcaggattaagtggttgattataatgaattttcactttgtacaactttgcataagcctgagtattttaaaggaaaatggaaaaatgaatgcaattttcagccctttgtttggtgcttggatataaatttcccctatcgtaatctctattatatctttgacattcttgtttgtaaccgatataacctactgagaaaaaaaagaacaaaccttcaactctgcagagtataaccacttcaacatttaaaaaatgaattgtgagaatattttcttctcttctacttactcattttgaatgaaacattgttcttgcctttttaattgttgaaaatattctgcttataatctttttcttattctctcaaaatagaaataccattgaaataatacagcttacactagcgttcagtttgaaatgataattggtaatattaacacatttgtttacagattcattgagatatgatgaacaataaaccactcatatttaaagtatacagtttgataaattttcacacatatatgcattggtgaaaccatcaccactgacaagataatgaacattaaggccaggcacggtggctcacgcctgtaacctcaggtctttgggaagctgaggctggaggatcacttgagcccaagagttcgagaccagcctgggcaatgtggtgaaactccatctctataaaaaatacaaaaattagccatgcatggtggcacgtgcctgttgtcccagctactcgggaggctgaggtaggaggattacttgaggatcacttgagagagtgcagtgagctgagattgtgccactgcactccaacctgggtgacagaggcatatcctgtgaaaaaaaaaaaaaaaaaaaaaggaactaatgtgtctatcacccagtaaaagtttctccagcctgttgctaatctatcccttccttcatccaagtgcccagaaaacataatctgctttcagtcactatagattttgttagcattttctagaattttaaataaataacatccttctctttttcatctggcttattttactcagcatattgatattgattttcattcatgttgcatgtgttaagagtattttcttttttattgatgagtagtattctattgtgtagacatccccaatttttgttatatactcacctataaatggacatttggattgtttccagtttgtagaaattttaaaaaatctactatgtatattctcatacaagtctttatatggacaattgatttcatttctcttgggaaaatgtctaagagtaaaaaggctgggttgtgaggtagacatatgtttaagaaattgccaagctgttttccaaaatggttataccatttttatcttccttctaacagtgtatgagagttccagttattccgcttccttgccaagccaacattttttaatcttcaccactctagtgggtatgtagtagtatctctttgtagttgtaatttacattaccttaataacaatgatgttgaacattttttcatacactttctagccatctgtatctcttctttgtgaagtgtttcatcaactcttttactgattttaaattggtttgtttgctttattctgaatacaggtcctttattaaatatgtttctgcaaatattcttatccagcctgtgatttgaaattcatttgcttaacagtgacttttgatgatcaaatacttttaattttgatgaagtccaatttatcaatttttttaatatcttagttttctcctttactattataaaattccatagcctgagcagcttatgtgacaaaaatttatttctcacaatctggaggctgtgaattccaagatcagggtgccagaatagttgggttctggtgagggctctttttctggcttgcagatggttcgtttctagctgtatccacacatggtgaagagagacagagtggtctctggttcatataagggcactaatctcatcaagaaggactcattcttatgatctcatctaaacctaattctttcccaaaggcctcatctctagacaccatcatatatgggggttagaggttcaacatataaatttgggaggaatataaatattcagctcataacagatagcatgcttttggtcccctaagataatttttcctaagctaaggtaactaggcttttcttctatgttttattccaaaagttgtatagctttagctcttaaacttaggtctataatacattgcaagttgattattgtatattgcatgagttaacagttaattttttttgaatgtggctatacatctgtttctgcaccatttaaaaaatatgtatcttttctgattcaaatctctagcttctttgttgaaaatcaattggccataatatgtgggtctatttctgaactattcataacaaaaatcttaagggtgaaaaaatcatttaaaacatttatagaaagtttacagaaaacatttactacacaatatggtttgagtgatgagaaacaattgtttctttctgccattatcaatcatataaggacaaaggaattgatgctacttctgaaacacgttaatttttctcatgatttgagaacaaaactgaatgggaatacaacttactgtgtgtatataaatatgtaaacatatttatattgctaatatattaatttaatatattacatattaaattaatatattaattaaatatattaatttatatactatataaatattatatataaatatataatatacaaaatggcattaagacacaggtgctaagataaagaaatttgctcatgatgaatatatactggtagcagaaggtaatcctcatatttctatgtttcctttgctgaaaaaaaaagagcatagtgaacattaattaactcacatataactgttccttcctgtgggtacacattttttcttgggcccatctgcactgtatttccatgttaacatatttttaaaataaagaaagacatgtatctgaaagcattgaactatagtatagactatttcttcttactgttgttaaaataaaaacttgcagcaaattaaaattaacaaagtttaactgagcaaagaatgattcgcaaatctggaagctcccaaaacaaacaaacaaaaaaaggtttgcagagacttcagcactcctgcatagtcaaagatttatggacagaaaaaggaaagtgatgcacagaaaatggaagtgaggtacggaaatagctggattggttacagcatgactgtaataaaaccttatttgaacgtggtttgaatagttggctgcctttgattggccagaactcagtgattggtaaaagaagaagtcacatcctgtttactcattcaggtaagttatggttcactgtgtatggagaaacctttaagctgaacttaaaatatgtataaagaggaagatttagactaaacttaatttaacactgtgttgaaataattaaacaaagacataacaaatgtgtttatcagggttcatttagttgagaggctaatttagtgacagaaactgaactcaccatgtcttaaaaaagaagtttatagcctcacacaattgaaagaccaagttcctttcaggaactgctaaatttaggagttccaattatgtccacaatgctatgtctttctttctattcattggttctgccatgcctctatcagcaagttattaatattaaaaaaaagttataccagtatcaccaagtgaaatcacccttagaatttaccaccttagaaaaaatattttcttttacccagaaactatatcaattgccccagatgctggactgataaacttttttttttttttttttttttttttgagatggagtctcactgtgtagcccaggttagagggcagcggcgcggtctcgtctcactgcatcctccaccttcccaggttcaagcaattcttctgcctcagcctctggagtagttgggatcacaggcacgcaccaccacgccctgctaatttttgtatttttagtagagatagggtttcaccatgttggccaggctggtctcgaactcctgacttcagatgatccacccacctcggcctcccaaagtgctgggattataggtatgagccactgcgtccagcctggactgataacctttcaaagggaattctgattagtttggcccaaacctgtagagctgtacagaattaggagaaataaggtttatcagagtctagaatagttcagtcactagtacaaaaagaaagaactgccagtcagggataaaagcagatgcagtcaaagagagaaagagaaaaaaattacccccttgaaattaacgtacccataagtaaaatatcggtatgctatatctttattatttttttcaaagaaacttttgttaaaaaagaaaatgtacatgaaatgtccatatatttgaaaattattgtgtatgacctggaaatttttctaacaaaatataagtgaccagcattaattgaagaagagatctgaagagatttatagtcaaaggaacaaaaattaaatttgttaaatatttacttttaagtaaaaacgtccagatagttttatggctagggtctttcttactctaaaaaacatgtaacttttatgtttgttattcatactattccaagtcactgacaaatttcctgactcattctttaatactaccatattctaaaactcaaattttataaaaccaacacaaaaagaaactctaattcaaattcacaaatataattattttagtcaaactgttagcaaattgatcccagggtgtactaagggattggtcatcatgttcaaggttttattacagaaatgaaagtttgtcccagtactggaaaaaaaaactatgaatacagttaaaggagagacataattaaatacatgattgtgtcaatggatacagaaaaatgtttgactagaagttagatgaaatgtatttgaactctctgcagttggtaaagattcttttccacatacccttgtcaaatatattaaatgttcaaatataaattcactgccatccaaagaagaataagacagaaatgctagctctcatcactataatttaatggaattttgaggggtccaatcttctcctacaatagacctctggcaaaaattataagattgaggatgaagacaaatatgctgaggatggtagagggaattcaagaacgcacctgagtctcagataaaaataacattggtgtataccctctagacatgtcatgtggcaacagtaaacacatgtttgtttaagccacaattagttgggttttctgtaatatgccaatacatgtcttcctaattattacaatgcctaatcatgaaataattaaaattaacaaaagcattaaatactgtggccaaataccacacaagtatacaaaaatcaaaaatttttctttataaaagtaataatcagttagcattcctaaataattcaagtcttaagaaataccaagtaactatatgaaaataaaaaaaaatgcacacatctcctatgtgaaatcagatggtttttgtctgtgtgtgtggttgtgcatgtgcacgtgcatgcctatgttttattttgatgtgtacctgatgagctaaggggagctcagtaatttaactcagtcttttggtgttctcctgctcttcacactgattagggtttccagcttttcctaaaaatctctcaaaatcacttaggatataatattgcataatggaaaaaagaatgaagtcagtaaactcagagttgcaactatattctgcaatatgattatgattaaccattcatgttcattcatttattcaggcatcccacaaatatttgttgtttgctttctgtatgttaggcatcaggctagattctgggaatacagcaataaacaaagcagaccaaacttcctatcatcatggtgcttaaatcctagtcagttttctcatctgtaaaaatgagtaataattcttacctcttatcgttctaatcagatttaatgagttaatgtaggcaaaataattggaatatgcaaggctcttcataactgttaattattgctctaatgttccttaagctaagacaaagttgaaaatatatccaaaaagtagctcaatgttaatggatgttaatgtgtccattgaaaagaactctctttttttcttgcattctgattaatacgcatttggaataatgaccctataaaaacaacaaaacaaaactaatgtttctaagggaaatggggcaaggtggacagctaggttatacttccttttcagcaagacatttagttcacatcttaaataatagttttggcaaacaaaaaaaatctcctgtgaatcagaatggccacgactttgttacatctacaaggatgttactgatttttaaaagttaggaatatcattaactacccaagaggttggtggcattttattcatttatgctatggtatacagtaatcagcacactgtcatgaacagaaacacgaaatgaatcctagttgaataaaaattaactaaatttagaattaaggactgttttcttgatttgcaacatttgttgctttttatgttttaaaatagacattttccaaactccatagaaaaaagcattcatagttccacagatttaaagcagaagttctaaagttaatgacaacttaatcaggtaattatgtactattttacattcatacataaatttttgttcctctctcaatagtacagtcttagaacagtcattttcaaactatatgttttggagtcctaaggttcttcctacatttggagggaatgagaagcaatcagatcaactgaaggtaccaagtcttcttcccatccttgttctaccagagaagcccagcttttaatcttttttctattttgagtttctaacagaaaacgtcatttgaaattatatttcctttaaaataaagtttcaaaaacactctcttaattagtaaaacacaatttaggaataaaactatatcacaaaaaacaaggactaaattacacattttagtcactatgtttaaaatgttaaaaatttgagacaaactactcaataaatagatatatttaatttagaggacatgtacatttaatactgtctcatgcaaaatctacagattacaaaaccagaagatatctttagacaaatctggaaaggtttttagcaggtgttccatttagaaccaacacactactcaacaaagagcatggtaattatgaaaattatttttagtaggtgaacttgctaaaactatgtgcacatcaaaatttgtaacttctcaacgtgaaccctacttcaactatgagctcaggttttaaattatgtagaatgcaaaaacatgattttcacagtacaaaaaaaatcctggtaaactaaacttttgaggacatattttgcttagtattacctaatttatataggcctaatataaatacctaatttatataggttcatttattcagtttaattgaacaaataattattagctacctataatgatggcatggatattgctagcagaaatacaaagacaagtaagatatattttctatttagttatataatacatatgattcacggtttataaaatagaggaagtggtcttctgtgatgggtagagctaacgaagtcttcatagaagagtaaatatttgaactttgccttgaaggatgagcgagaaggtgctaagttaaaattaaaaacagtgattcaggtagatttactgaatgtccaaagaagcagagttgtgaaacaacttgcagggttcagagagttatggataatttggtaaaattagagtttatggaaaaagaaaattagatggagaaagctggaggaaatgatgtatggagattttttattttatctctagggataaaaaaacagaattttgagcatgagagtaatatgatcatcattctgatgctggaagattatcattagtaatgtgcagcaggttggactgggagagacacttccagtctaaggaaaaggagggagaaaaagtagggcattattcatttagaatgtcctgggttggtttcaaatatatcatctctgtgaattgtttaattactattgttgaaaactgagcagacggagaacaatataatgtttaattgtgctgctctacaatgtacttccagctcttgaaccgcagcagaggggagaactgtgtaaatatcgatagaactccctgttgctccaacctattcatgagttttaataaatgtttcttgttcaagcattatcattaataattcatacagtttctaatgtttaaatcactatagattttctgacaggtaaccttcgtaagatggagaaaataacagaaacacaggaatataagaatgccaggtttccttagccatttagagggagaaggggaagaaacagaaaaagatacatttcaagaagtatgacgaggtgagaggatctgtactccaaatcagcattacacaatatttccaagtaacaaatgtgcacacagaccccctgcatgtaaaatacaagttgccggaaaaaaaagacagataaatacatgtaacataagccaattgttctttaaattttgtaaccttgttttatttactggggatagaggtggattttaaattgaggaggaatatattaaaactataatcaagctaacctttttaataaactggcatttacatagatttcttgaactattcaaattaatacagtaccaaatttagtcacacaaaaaaaaacacagaatgaatgtgttctgtctctctgacaacatcatgcattcattttcatgtgtccagaatcaaaagcatgacagtgtttgtaagagaaaattctaattgaaaattattatgcaagtaaaagaatttttcacagtaattatttaattggtaagatagaaaataataatttttaccacaatagtaatgataattcaagcaacataacattctgatgatctcttgtatatttttgtttttaaaaaatagatttttaattgagcttattagtaattttttcagtcagaattgcaaatttgcatttctaatatgcacattgtgtgtatgtattggttttaatcaaggtccaacatgtgtggaagatatctatgacctcacatgcttgcatctatttctgataaatgaaactagaataaaatattttgttaaacacacatagttaatcattgatctgtatctttactgacactgggatgggcaaaagcaatttcacaaatttgtgagctatatttatatgtttgatagattacaaaaaaagatttgtacattggaatatttagggatttcagacctttactgttatatttaagtatttaataattagtagaatctttgccaggaaaattacttaaagtacataaaatcacatgtctattttggggaaggctaggagtctacagtgattgaaacacaaggatagtataatatactgggagaaagatgaggtatgcaaaatagacacattttaaaggaaaaactcattttatttaaagataagtgtaattaacatttgtagttaaattaaggaggaaatgatctttgttgaaatgtagcatgtgttctgcaaaacttttaattttgtagatgcaattaaacgtgaatttaaaaatattctctggtggtattaagataacatttcctatgtagaaattaatcattacctttgtagttaaccttgaaaccaacagatccaacactttcgtccgtttgaaggtgcagccacatttggctactcatgctcactatcaagtctggtacaaagcttccagtcagcctaaaaagagatggacaaagaagggagagatgggttattaaaacatcctctgcatacaaattataagacagatgtgtttctcaatactttctttgctagaaaaaaaagtcagataaacatagaggagtatgtgttgatgtgacagaagaaaaaactacacaatttagtgatcaaggttattataaaaatattattctgtgtttaactaggaaagatctttcatgttcctgaggcaaggtcatgatattttagaccatcaaaaactcctacacagtacttgtcttttgaactgaaaagaaaaggaggatctatacaaatattcaagtatttttaacaccacaaatatatcttaacattcccagtttcacagaactttgttctagagaaatattgttaaaatatttctgtgcaaaacaataaagtggccaagagtataaccgaaccctttgcaatactgatgtcgaatacacaagccttaaaatatagtacctacattataggctgcccatgtcacatatgtttttctgtaaatagttttatttaaagaaatatgctgcaaatctgatgcagcataactgtatccattcattactaatccctcattcagtaatgcacagttttgtaaccataagaagggaaattacttcacgttttgtctatcatcaatgatattgtaattgcatattagaactgaagccaaaggtcattagaaggatgaaagcaaattagtaaataagaccttaggttgcggggaagtccatcaagaataggaaagaggaaaaaatggattcactgcagagtaaatgtccacattgataagagattctaaattatatacagaaagacaggtttccaaaggaagaaaatactgaatgtttgcctactttattgctaaaaccataaggattgctggaaaattacatcaggaaagtataaagtttcctttcattgtaaaaacctacgagagtgtttagtctcttaaatagtggctctactatgaatacaccagcagagggcagtgtagttgaccatatcctggaagtgactatggcagcaaaatgccctgtgcgtagtcaactattaaaacaaacctcatttgcagtacaagtatctaaccagtggccagtgttacaggatttatgggaatttgtcacaaagaaacttggtaaactactattatttaattatgggattatatattacactgaagaacaccataagataccaagataccataatgcatcatggaacttcagattatcttcatttccttcttcctgccaaaaaccattttaaattaccataatataaaacaaactcacacatatatattgtctatatatacacataatcatttgaaacatcttttaattaaattttggggcatgtgaactttcaaattggtgattcttaggtagcagttttttgagctactgtagagaggcaggtgcaggtttatgggaaagggtaaacactccagcttggaggcagaatagaaagtaaagtaaacccattattaaacgggaatgagagcttatatttacatagcatgtacatcagctataccatatcaaacataccagcaaactacctcaaagagaatactaagagttgtttttctgggaaaattgaagtattgctcttttttacatcctcctataacattcataatcctgaactgttctattatcctgaaacttctagaatggtattttgtcagttcatgaagaacaactaacacttgcaagctaaattgttcccttactaacttatcctattgccctgatttcacctagttcccaactcattgctggtgtaagggtatatgtcatctaaaaataataataaaatatatatatttttaaattttctgatgtcaaaaattaaaactcccctcaacttctctttagcatttcttttagaaaacttgaaattataagttccatttattttagatgtatcaaaatattttaatagttaaatgagacttttgccagtttttcattcctggaatttctctcttggtggccttggagccacctctttaaactgtgaacatcaaagaggatgatgccctgtctctacttttctggggagttaaagcctaggtacttagtacttagctctttgatttaacttcctgcttgtcataatgataggaaatgttttattttttgttttgatgaaggcaattaacatgtatgcaatggattgtatattcctagctatatattatttctcttttttgcaatctccttagcagatttcctatgatgcacatcacagtttggtttaatcctattcaacagaaaaactgtttcatttttccctccattttatggagagcttttactgagctggcaaaagattttatttttaatcacatttccccaactacttggtaaagaggattgggatatgaacggtagttttgaattgagtagaccccacagcagccatattataattataattataaaagttctcccttcttgatctttgcttttttgaaatagtatctggatagaccactctctccaaactcaaattttattaatttaaaatttattaatttaaatttaaaattttaaattttattaatgagtatgcatgggtaatctggactcaaatcccatcaggattacaattaactttgatggtggaaaaataggggaagccaaggatattgcctgcaattctttctcctaaacagctaatatctctgtcatatttggaatacatacaagtaccaaacctttcagaatttgttatgattctttgacctcatccccagcaaatgaactgctggcatttattggatacatattattcttggtggaaacttaaaaagatctgcataactagaaggaaagattgagaagaatggaagaggaaatggataaattaaaggcactttcattgattcttcttcctttttctgctatctctgctctttctgcatcccttgtgtctctttatccttctctgccttagtagactcctgagaagatcaaagcaatggtgttttagacctccagttctcctagttagtgtatttccctacaaaggacaaggccacaacttctttcgctgataatgaattatctgccttgtttgaggaaacagatttgtgtgcctcatgccctaaccctgagcctactcaatgttttagcacatactgtgcccccaaaagtcacttatcatttatatttcatgtatttaggaaagcagaaattatgaaggaacgtgcttggggaataattgggaacttgtataaaagactgtccccacatgaagacaaaaagatgtagagtggtctcacttgctatttggaaaaaaaatagtcttagtctaataaacagtaacatggaaaataagccaaaaagtcatataattctacatttatcttgtcacaatgtgagaaagaccagctcttatttgatcaccagtgaagctgatgccattgagaagttatacagacctccttgccagctgatatatctcaaataaaagcttcttttccctgcttcccagaagtttgcaggcatcctctgcagcatgttttcagtttacagtcccgggcatggagatttgcacaggatacagtgtggagttctgcaatcagcagactccactcatgtgatggaacaagcacactggggaccagaagatcacccattgaaccaagaggtagataactgttcatcaccctccacaaataagggataactaagagatttggagactcactgaaagtaactccttgtagctgtactcgaaatctttcctctaaaagtgagctgcgtgaaactgcaatggtgtatccgaaagacaagggagtctgccattgatttccattagcagtttgttgaggctttctcagaatctaccggtatggatccaagggtagttcaaaatttttgtctcaggtcctttgatgactatccaaattcaaattagaggaagggtattaggatggcaaggacagattcaaatgttagcagcagttacttagttttgggacaatctagagaaatgtgaagaagaaaataaattaaaaaaaaaactgatatgttaattatccagtaagaactatttagtaaaaggcataacccctattctggccagcctgtagagtgagcaaagaaagaaaacaaaaccatatgccatactgcgagaagccagatgttggaggcgggactggagaaaagagaatccagaggatacagcaactgcagaaataagggaatcaggaaagcccagaaggctgggaaataatttgggaatgacctaaaactgacagattgaggggatctcagatgtgggaactgatgatacgtacatttcaataactttctctcatgctaactcattgcatttattttattttattttattttattttttttgagatgaagtctcgctctgtcactaggctggagtgcattggcgcgatctcggctcactgcaacctccaactcccgggttcaagcaattatcctgcctcagcctcctaagcagctgggactacaggtgtgcaccaccacacccagctaatttttgtatttttagtagagacggggtttcaccacgttgaccaggatggtctgagtctcttgacctcgtgatctgcccgcctcagcctcccaaagtgctgggattccaggtgtgcattttctagtagttgctggtgctacttattctgtgatttccccagaaaagtcttactttccatctggtgttaatgaacacacgttgttggtattttgagttagccttctacttgctctttttcttctgcagttcccacacaaatagggcctcatattgggaataggttttcttagttttctcctgatcctcctgtaaacctattgcagggagacctgctgggaaaattaaagactaccatattctatattccatagggagtgtctgtggaactccctggaataaaaggaatctgattactgtgtaccttctgaaagaaaaggggtattccgaaaagcagctttctcacactgtgctggataagtgccctgaactgaaacaagtcaattcatcactttgggccctagcaagtggtttagtttgaggtgtagaatcaatagaaattctttacaaaaaacataagcaatggccatggtcaaacaataccctttgtcaaaggctctactagaagaaataaacacagttaaaaaaattcaaagacaagtggtaattttataaagacactcaccctgtaatattaatactgccatacttccagaaaggaaagaaggtaaatgtgataaagatgattgacctgtgtacaagatcttaaagaagaaaataaatttattgctccattcacgcctttagtttctaacatcagaaactttagtactttgctaccatcctctgcaaagttttttctccgatttatctatgatctgttttttctcattgctctagtaaacaagtttacatttctgttgctgtttgctgttttacttagaaaggagttcagtatttatgaaaaagtattcaaggatttcctgactctccttccatttctctaatcatttacagaaaaaacttaaagaaatttgtcccagtgggggatctgtaagtcatcagcatgttgatggtttgctggtaggctcagaaactaaagagcaataaaaaactgacacttcagctttgttacaactcccccttcacaagggcataagccttcaatagacaaattgcaaaattgccaaactgagataaaatatttagagcatctgttgatgctgaaggcattatgtaggccttaaaaaaaaaaactattttgaggactagtagaatattgtggacagtgaatttcagttttgtaaagtggccaaaactctaatgaaataactgtgtaataattcctcggatccttttatttggtcagtagaatctgaagaagtgttccaattaaaattggctatagtataagctttgggagttccaaattttgcaaagactttccacttgctttgctatgaaaataaagcggctacttttggaattttaactcaaaagttgggaatagatgacacattaataacaaatttctcagtttccttggaggtagtggcactgttgatgacaagattctgtggaagtagcatataaactttttaaaaggctcaagcccttacctgcagtcacttatatgcgcgtcccacatgctgtgacagctatcttacaagtgcaaaaaatccagaatgtgtgggtatgccaacagactagttaagaacaagcattgatcccagtattgtgcttaggagatgcaatatcctaaatcatgttactcttttaccagatcctgatcaaatagatgatcatgattgtattacaggggtaagagaagacactaagctctgatgaatttatctgatattcttgtctgtaatgaggcagagaaaggatggggcctcgcttcagctcacctccactagaacatcctttcttgcattcccccgatcacaaacctataccactacttcactgataacatacctgttagtagtcatacaaggaaaaaagccattctatgttcttcttctgtgctctcataatgtgtaaccatgccgtttgtttaaataattccagaaactggccttaggagattcgaaatcaaaccaagtttgcagtttcccaccttgggaaggaatgctgcacaattgatttacagccctgttgcctctggccagaccaccaggtggcccactgctcaagataaccatcacaataagatatgctgacccatgtactctaccacttatgtgctgtgcacagaacagtctgtgtaccttacccctgatgtcaattcccatgagttacctagtaaagaaaatccctactggctttttttggagagccagctggaggacccttgtgactctgccgtctccctagtgcttaagcacaagccctgaaataaataccttgtctgggaaatctgctgggcctcatgttaatttccattacatagggagccaaagagcctgtggtttttagcaatgacaatttaataatatttactggtggacatgtacttgggataaaaatggccctatttaaggttttgtatgctatgatgacctcttatacgacattttgaaagcttatgctttgcctagaattaagctgacacaagcagcacagttaatagaagttactggagttgcaattcttgataggtaggtaggtaggtaggtaggtaggtaggtaggtaggtaggtaggtaggaaatacatgtttggtgtccatcaaataggagagcaaatttggagaaatagaagcttctcaactttgaggggaagtaaaatatctcatggaaaactgatagctgattttttagaagctgtacaactgtcctgtcagatcagtaaccatttgtagagctcacatagagcagaatgacacaatttttaatgcaactattttgctgacagagctgcaaaagcaactgttaaaatgtaacagattgtaaacttggaagcctcacttttaatacaagaaacttttgttaattttcaaaaatatgcttcacaaaaggaaactgatgaatgaattataaaggaggataaaacatttgactgaactatgaaaattacctaataaagtaacccctataccatacttattattcatttgattaatagtgtgtcattgacatactcatctaagtaaaatggggactttaaagaccccagactattactgtacttacataaaaataaaattattccaaaaatattaaagagatgagctgtttgtcagaagaattatttacagtctattcctaaggtacatgtggcagttttccccaaccagctttcccagaaattaagtggcagttggatttcatagaattaatgtctacaaaaagtaagatattttgtctagttatagtatatatgatgtttggatggtctgaagtctttccgtctttaaatgtgaatgtgcaagcccggtaaagtatcttttaatacccatgatttccactttggggctacagaagcataatgaatcagagaaaggaagtcatcttattgtgatatcctaccttgttttaactggaattgcctctcccttagctgagagagccggacagactccattttggttccttcacttgcagccccttacccacccccacttttcttcaaggacttaacttgtgcaagctgactcccagcccatcaaagaatgtaattactgataagatactgtggcaagctatatccacagtttccaggaatttgcccagtcgatagtaccctaagcccccgcatttgtgtccggttgatagcacccaaagccccgcgtctatcaccttgcgatggatttaaagcccctgcacctggaactgtttgttttcctgtaaccatttatctttttaaccttcttttgcctgttttacttctgtaagattgcttcagctaggctccccctcccctttctaaaccaaagtataacagaaaatctagccccttcttcgaggccaagagaattttgagcgctagccgtctctcggtcgccagcaataaaaggactcctgaattagtctcagagtgtggcgtttctctacaactcgctcggttacaacattattatcactgtcacctagtaattatgcaattatttatagatttctataagatgaatggaactcatttgctgagattaggcaatatactggataaaaatggcctagcattttactgttagcattgtcaaaaattagaatgacatctgcaaacaagcgtgatatttttcccctttgaactaatggttgccagacctatgaaattcagtcagaaaccatgtcctgtgcccaatttaactgaattctctcttaatcatgttcatacttcaaggtgcttctttctttcctagaatccctaagacacaaaaccataaggacctggaaggacctgttgaaagaaatttgccaccctattgaccaggagattcgatttatctgaaagtattccagaggtaagattagctgatcctgtgctagaaggatcaagtgctcttgatgatccacatggctagcaaagtgaaagaaaatctcacgcagattcatgtggagccagcacctcagaagaatttgacaatagttcctacaaaggactcaaaaaaattttctagataagtaattttggctctgaactcaactgaaagaagaaattctagtgagcttatgctcatagactgctttgttgtcctattcacagtaacattatttcaattactttaagaaccacattttattaaaaaaatgttatttgttacactactttttctttgtgtactcctggtaataatagttcccacaatcacttatttccaaacagctaggaattggactcccagtgattaagatgggcttaatgttccagtcaccctaactaaactttagaaaattttaggtgggtttctttctgactacaggttcctgacctactgtttcttaaagcatttaagttaaaaaaaaacttgcaattataaatccattctctacccctttggatgtaaatattcaacaaagaatatctttctcaagaacctccaagccattcctttgaaatgtaatcattgaaggaggtagcacctgtctcccagtctctatgggaggataggagcttaacttcaacaagaaacaattgaaacgcagatggtctgtatacattgactaatctctcatctaaagctttccagtgattttccactaactcactccactgcttaaaaaccctcccactttttgtttcagcagagttgagttcagtctctctcccctactgcaatagttttaggaaaagtcttgtttgtttgacttgtctggtgcaatttttcttttacacaagaataggtatgatctgcttataagttcaacagtccaattattggcagagtaaaagtgagaccatcttcttactaattttttaataatcccaaagtaaaagtaactaatatgtgtctaaatattaatccataaatttcacacatacaggcacacacaattttttaactgatttaaatggaaggataatttagaatgaaaaacatctaattaacagacaaatctgacgtttataggtaagactgcaaatgataagtctaatataagttaattagctttgggacacaagtctctccagtccaaatatcaatatagaaacaaaagtaaatgtctattatttgcagagatttaattgactgttattataattaaattattgatttgggcttatgtgaaacctataggctttttccacaagaattgtaacaattaaagtcatgtatattaaatactggaagttcaatctgtacccttaagaggtgcctcataaggatactagaaaatggttgtgttttccatctccaaaaaaattggaaaaatgaaataaatgctaaaagtcctagattatcttataaatgtaatattacttacgtgattgatgaaaactctgaataagtattttggccctccaaaaaatattttatttaaaaatttagatatttgagttctagggttaagttacaccttaggcttggtttagtaagatgtcatgaggatctacaaaaataatattcaaatagataattatttgaaagtataagcaatgtagataccacaacagtttataaaattaatggatgatggagaatttttgttcatggctaatcaagaatctgcttgaactattcactattggttcacttaaatatttaaaggttattccttcaaggctaataatacaataaatttataaattaattcaattatatttctgataattaccttgctttgtattttacattggatttgctatatattttgataactgcaaactgcccagagaagagtagaaacagcaatacacataatttaataattatcgtgttataaaatagtaacaaaaaagaaaacttctaagtataaatgcaaatctttaaaaaaatgtaaaaattttcttgaaattataaaggtaagagaactcccccaaccccccttctctttagaatttcctatagaaaacctaaagttgtagatgctttctttttctttcagatatgtgtaaatgttttaaaagctaaagaaaacacttacaagttttacattctaagaatgtccttcttagaggccttggagctatctttttgaaataagaacatcaaggaagattgtatcctgtcttcctgtttcactgagtgttaaagcctaggcacttggctccattatgtaacttcttgattattataaagatagaagtgtatatttttcttttgataaagacaattaacatgtgtgtaatggattatatctgtcaagctatataaaaagggtgaggtttctcttttttgaaatctcctctacagattgcctctgatgcagatcacaatctggcttaatttttatttaacagaaaagctgtttcatttctttttacattttgtgaagcggattcattgggttggtaggtgattttattttaattatattttctcaatacttgatgtctcactgaaaaccctgctctttgtataaaacctcaatggccagttcttctcagctccctctcaaacaccttggtttagattcaaatggtagaaaccttcaaccctgacagtaaaggatgctgtgggctacagaggaaagagtcatattcttgtaagactctcaaatgagtctttaaatagctgtgttacagtaagtagtcagacatgagcagggcaggaaagggcctccccacaccaggaatattaggtgatcatcaggtgatggccaggcagttattaaactgtctatctaattgatgcagccagcaggagggaaaggcagtctcccaatagatagaaacacctgaaactggtgatcaacagcttcctgataagatctcaggagttgggtgagtgggcttaaacatgtatgctaagaggtaaaacattggagtttaactgtaacacttgactggtaagaggaaaaatgcctcaagtacacaagcatagaacttcagtaaacacactgggcatgtggcccatcccaagtgctggcaggccactgtgcatgcagacagcccaccccaaggaaaacctggggagaagagatgcaaaccccctggaagcatgccaacatataaaacccaaagtcaaaggtcaaaacacacacttaaatctttcaagtagcctgcttggcccttttccaaatgtacttcacttcctttcattcctgcccttaaagtttttaataaactcacttctgctctaaaatttgcctcggtctctcactctgctttatgcctctctgttgaattatttcttctgaggaggcaagaattgagctgctgcagtcccgaacagatttgctgccacagacagttgtatcaatatttaatacatctttttgaatgtattatttgttaatttaaaaaatgcttctttaatacatgtttatttacaggctgagtaacttcagtgttcatagttcattctagtcttcctagtcagtcacttcctgctaaaatgagataaagtcctaaataggtgcgctcaaaaatatttttcaagaattgaaatagtatataaaataaagaacataatctattacacttttattagccttgtgcagatgaaaggccttagcccacttcaaaagttcattgaaaaatcaactcacaataaggcagattaataagagaaaatgttgtagaaaaaaacgagttcttgtcacacgaccaggaaagattgggctcatagagacatctaagtgttaacgcctaaggttcttgcctagccacgccaaagaattggtgtggcggctgaccacagtgagtgatagagacatggaccaagagagagaaaaagctgtaggctttattgagcagagtgaaagtacaaagctcccacagcatggaaggggtcccaaacgaatgggtagccagagttagattatgtgattgccttttaaactctttaaggcaggaaatacgtggggcaatatgttaccagagtgaaaaacaaaggcaattaaccatttgtgatatgtcttagatcttgaggaaaaccggaattgcaacttaggttttatctactttatggcaacagcatggcaaaagagataggattgtacaggactttacaaagtatgttcacaaggaattcaaattgggaggatagataaggcccactggtcacaggaaaacgggcagttaacattacttttaactttagttttgcgggagggggaagggagagagggagagaaggatacagggaaacttacagcaaaattttcgctgtttatagctttcttggggaagaaaatacatgcacaaatcctggtgttaggaatattttaagcatttatcttcaatagtgttcattcaggaccaaagtaagtcctgatgcaggaaatgagtgagtttcacagtttctgagcccctactcgacccagaaagcccagctggcacctcctcttataagggtgagtagaggaatttattgggcaaaaaggaaaaacaagtcagcaaaatgatatggagtcctgtggttcttcacctgaccaactgaatcccacgttgccatcctgggacaggaaaggccaggctccaccccctgcaaatggtgcaaatgtcccaaggcttcgccccgtcctcccagtgcacaagccagttggaaatgctttggggaacttcccccttatctgcctcttgcacttatcaaataggcatacacatttatttaactgtgagcacaaggagaatcacagagtgattgcctgatgtcgaagtgagttccagaagtttatatatcatcttgaggttacagaaagaatggggacttggatcctggcaaaacaggttaggggacagagagaagaggaaattgattcaggggcaataagtaatcactagggagaatgattgaatagaggaacagaagttaaaataacttgtaaatagttctttttggaatttaaatgatctttggagacagtcattgtattgaaaaagggtgtgttcaggtgtgcttacattcctggtcttctctcttataatgtttaataaaataacagggagggaaacaagaacaattgttctccttagtgggtcagtcttatctttatgtagatatagggaaaagtctcttccagcacttgatctctaaggccatttaattcaaaatgctcattatggctgggtgcagtggctcatgcctgtaatcccagcactttgggagaccgaggtgagtggatcacctgaagacagcagttcgagaccagcctggccaacatggcaaaaccccatctctactaaaaacagaaaaattagtccagcatggtggtgtgtgcttgtaatcccagctactggggggctgaggcaggaggattgcttgaacctggaaggtggaggttgcagtgtgctgagatcataccactgcattccagcctgggcaacagagcaagactccatctcaaaaaaaaaaaaaaatttttttttcattataccaagggagccctattttggggtgaaatttcctgcattccttaagacctattgcctgactttctataatcactcaaggcctttggatgcatccattagacatgagaattgtagtcctatgttctaacatattttttgtattatacaaatatgcaactttcgctttttatgaaaaatgcatttaatatttttccttctagtacaatgttataaaaagtaatgtatatgtttatttgaagtacacgaaattcactaaaatgacgatgattagaaaagttaagttaaaaaaaaaaagaaaaaaccctaacacatcacagtagagtgacagttcagaatgtgggccaatgcagtggaagaataatgtatggtttttaaaatcaaaatgtataaagcattatggaataatgggacaatataaatgttagttcacttagctgagttgtcaataattgttgttttaactttatttagggacataggattcagaagttttaatttattggctaattcaaaagcataataaggtaggataatgtttgtcatgggtcttattacttttacaaatagatttctatattgagttttatttttagaaaactgaatttgaaggccaaatctttagcatacacatctttgtattcaaagttggaatatggatacttcattgtatatatttaagactccaatcaggtcttgcttataacactcattatttgtgggaagaaatccagcttgtttatatattctttctatattttcccctaatttcttcttctacagccacctttgaaatgcctgctacagtgcaaatattcctgagaacaaaaggaaaaacaactaaaaattactttagttcattttaaacaattcaatgtattcaaaaacaaatacatatataaaacaaatgcaagcaaaacagaagtaaacccttttttcagggaaatcatcagttttttaacattagacatatgtagcaaaaatcacaatgaaaaaataatgatgaaccacacagaataaattattccatatatttagtcatttgttgccaataaacaaaatgacaaagattatttttgtattgtggtctaaagtaattctgcgttccaagagcatatatttattattgccctatagcagatcatatggataactacatgtgaaatctcatccacatgatgagaaaactgctcccatcagtttggttgattttcctggaagtggtatcaatgagtgctaaaatccctaggtgggactacagagctctacagctcatggcatatctacagctcatgactaatatttacaaagataccctttctgttgacatgtctcagcagatgtgtcttggagtagaatatttttccctcttcctttataattgctgttaacacctaacaatagtaacacaaggctttctgtaaggaattcaggaaaatctgagatgaatagaagatgattgctgccctcaagggatgagtgtgtatgtttgtaagtatgcatagtgaaagaggaaagcgagggtgcaagatagagaaaacggcagtaagaaaacatttatttttcttgtcttaataattataacacaaggggctaagaatttgtctgactggtcaattctccaagcccttttcataccgtggcaattaatctctaaaaaatatcacctttcgccatatttagtatatgctcttctttcattagcccatggtctttgtcggtatttgttgaagtcaaaagcaaagttaggaaagtataactccttggatgcagaagaatttgttcaaggcaaatatcatgtttactagtatgttgccaaaaggagtagggcctagattttaaaaaagaatgttgctgaatagtaaaaacaatagtatatatctgacaaaatatagggctcaacaaactaagagcaatgatagtcatctatttacaagcctaacagaaaacagaactatcttttccataaagctagtaagaatattatttattaaaatactattaaattcaataaataaaaaatttatttataaattattatattaacccagaagtgtgtgtgtgtttaaaattaaaaggagaataatcaggaaaaagtgttgttagcctaaactaacatatttctgagaatgagatttgacattgtactaacttatcctggagaattcagaattccaaagtgatagaatgaagaaggtttagatatccatacaagcattttttaccttctttaagatgtttgctcaattcgatgtcatccaacgttagtgcatactcacaaaattttcagaggtgtcttaatagaagatattttaaacttttatgttgcttgttttcatttagttcttacagtgttaccatgaatctaatgagtctaatagtgacacatgcaaaagaaaatgcagaaaaatgaaggagtatcacatatctggtagaattaatgtctcaccctcttggtctgctgtatgcagatgaaaagggtagactaataatcaacatctcctggagagctggaagtaatctcaaggccagtaattgcattaccatcactattagttctctccaataaattatatacatttccactatcagatgaatttatacgtaagtgtaaaaatagcacatgggaaagaatctgtgaaacaaagttcttttgatatcctttaaaagattaaaatattattgttcaaatcctttatctgaattattatcaaatgtcaagttcatattctgatctctattgacttttgtcactagacgactctgaagttgccaggaataaatgctatttcaaactttgggaaaaaacatcctccaagtaactctaatggtgtgaaaatgaacacagagatacagaaagagataatagagatagagagagagagagaaaagataaaatgggccatagatatggcacaacaaatgacagatgcaataaatctctgaattgtgagtttaaatttgcagtttaaattttcatcattttagaaatttttatctatatggcaaatttagcatggcgtatgatgtccaattacaatgctttctctattgctaaataattttattggtcataactttgtaatgaatatttccttggagctaaagcctcaaggtgaaaagatatggcacatttcaattatttttaagttagcaaattacaaaaaaatttctttatacttcataaaaaaagaaattttataattaatatttttttatgctttgtaactgattttttttttgcaggagtattttagctactgaatatgttatgactttatgaactatttttttatggaatagaataagtaattgattttaccttttagaacctaaatactgaaacaaaatgaaacacaaaaagccttatatttacaatacttaattcaatactttgacggaattagaaaatgttagaatgttccataacatgttaaatatgtatcaaagtgatatattatgtgtttattaaaataattagaacataaaaattgaatataggctgaagtcatcttctaataaaagacttaaatattttgatatgagatggcttcttcttttggctatgtgttcttaccttcagctattcaatctttttaaatcaatttacttgtaaaataattttggtgccaaaattaactctctagcacatgaattaaacttaaaaagcaaaaaggaattcacagacaagtaaagagattgctgaataaaatgtctaaatgaaaactagtgttaactgttagaaaagcattatttaaaatacatttccttcagcttaggttttaaaatacatttttgaaaatttaccatgccctgtgtttagtactgttttgaaatgtgggcaagatgggccccttctctgattcttcccctgtagaaggccctcctctgacctttctctagtttaactcttgctcaggaatgtgcctgcctggctgaaatctgtgtcccttctccacctcccctttgagaccctgcagtagcttccagacaacaacatgataaatacagaaactgtgtgttacctttcaacatttctagagccatttgaaaaagtaattttatgtctggtgaatttcataatgaaaattaatgagcttgtatttattgtgttttatttcttttttttctagaaacttgttataaaattatcagttcaagagggatcagaaatcaaaatcaaatctattttactgtttgtttgcaaagcactgttctagaacacacaggtatgtggtacccggaattccctgttaccaggaccagcataggccttttttccaggtccatatcccacaagtagaacacacacctcacctgtgcatccctaggtgcaatgaaaggctgtttgcagggcgggtggaccgtttgaacatgcaggctgggctgacatgggttatgatgaatgcagctgaagttgagaggaaatgaaaggctgtttgcagggtgagtggacactttgaacatgcaggctgggttgacatgggttatgatgaatggagttgaagttgagaggagagggtggccaattggtctctgggtctggcagagggactttccaattcctccacattccagcagagaaatcatataagtcttaaaattcaggttcactcaaatttatgtcagcttctttggtgattataaatccaggtaattctgctatcacagagtcctagagttcgaaggaacttttgattcaactctaagtctgtaaaatcttttagccagtcagccagtcctattaaaacacctctaggaggtgggcccaagccaagttctgtcatatttattcctacttgaggaaaagagagttacattttcagagaagtataattttgtttctgagggagaacagaaagttttagaaacacattctctgattttgaatggaagaatacagaacaaaactagaaatcacagatttttcaaaattaatataacttctcagagtgacgacattgtacatgatgaagtatttatactttgatagactacacaaactaatgacaacatgacaacagtcatgtggaaatataaaaaaaagtaacactattttctttcattttcctaagagtagcagaagaaaactcagctatttccacttgactattcacttgggatgtaagggaatgtcccatcaacatatttgttctttttctggttttatgctgtctagctaattttggcatcaccttcttcaaaaaattagttgcggtcttatttcatttacttaattatccaatccctctagcctcatctgctacttgatctcaattatttattacataattaaattcattttaaaacatttccattcctgccctccaatatagaaggaaagaagggtatcatatgtacttaataatgagaacatttagaagtctgacaaaaccaataataaaaaatatagtagattatttgaggcacttgacatcaaatgagaatggattaaaccctatgagaagtaggtatgaacaaagtgaaaggcttggtatgcttacccagaagtgtcatttgattaagaaagaggtcaattgttaatcaattgctatatttaaaatacatagaggttttcctttcactacctaaaaattgtatagtaaggaccagtgccctctttttgagtttcacaaaaacataatatacataattacaaaaacggctaaatctgaatttctctgtgtgcctgatagtctcatagttttatgattgtttaaatagaactgattaaaaaaaaacttcctagattgctcacactctcactaaagggcaaatttacatccattgaatgaacagcctaaaaggtattggttgtggaatgaggccttaatttttttttttttttttaacttgaagttcgggatacaagtgcagaacttgtaggtttgctacgtaggtatacacgtgccatggtggtttgatgcacctatcaagccgtcatctaggttttaagtcccatatgcatttagctatttgtcctaatgctcttctctcttcctccactcaccaccaccgccaaccagttctggtgtgtgttgttctcctgcctgtgtacatgttcaactcccacttatgagtgagaacatgcagtgtttggttttctgtttctttcttagtttgttgaagatgatggcttccagcttcatccatgtacccacaaaggatatgatctcattcctttttatggctgcatagtattccatgatgtatatgtaccatattttctttatccagtctatcgttgatgggcatttgggttggttctgtgtctttgctattgcaaatagtgcttcaataaacctatgtgtgcatgtacctttatatagaatgatttatattcctttgggcatatacccagtaatgagattgccgggtcaaatggtatttctggttctagacccttaagaaatcaccacactgtcttccacaatagttgaactaatttacattcttaccagcaatgtaaaatcattcctatttctccaagcttcccagtatctattgtttcttgactttttaataatcacctttctgactggtgtgagataatatctcactgtggttttgatttgtatctctataatgatcaatgatgttgattttttttttcatgtttgttggctgcataaatgtcttcttttgagaagtatctgttcatgtccttgacccactttttgatggggttgtttgttgttttcttgtaaacttttttaagttccttgtagattctgaatattagatctttgtcggattgaaagattgtaaacttttttcccattctttaggttgcctgttcactctgatgatagtttactttgctgtgcagaagctctttagttaatttagatcccatttgtcaattttggcttttgttgcaattgcttttggtgtttttgtcatgaagtctttgcccacgcctgtgtcctgaatggcattgtcctggctttcttctagagattttatggttttgggttttacatttaagtctttaatccatcttgagttaatttttgtatagggagtaaggaaagggtccagtttcagttttctgcatatggctagccagttttcccagcaccattcattgaataagaaaccctttctccattgcttgtttttgttaggtttgttgaagatcagatggctgtagatgtgtgatgttatttctgagctctctgttatgttccactgatctatatgactgttttcgtaccagtaccatgctgttttatttactgtagccttgtagtatagtttgaggtcaggtaccatgatgcctccagttttgttctttttgcttaggattgtcttggctatacaggctcttctttggttccatatgacatttaaagtagttttccataattccgtgaataatgtcaatggtagtttgatggagatagcattgaatctataaattactttgggtagtatggccattttcacgatattgattcttcctatccatgagcatggaatcttttttttcacttgtttatttcctttcttatttccttgtgcagtggtttgtagttctccttgaagaggtccttcacatcccttgtaagttgtattcctaagtattttattctctttgtagcaattgtaaactggagttcactcatcatttggctgtctgcttgtctattgttggcgtataggattttttgtgacttttgcacattgcttctgtatcctgagagcttgctgaagttgcttaccagcttgaggagttttggggctgagacaatggggttttctaaatatagaatcatgtcatctgcagagacaatttgacttactctctttatttatttctctttatttcctctctttatttctttctcttcaaccatcctatgttgaataggagcggtgagagagggcatccttgtcttgtgtcggttttcacagggaatgattccagcttttgcccattcagtgtgatataggctgttggtttgtcataaatagctcttattattttgagatatgttccattaatacctagtttattgagtttttaacatgaagaggtgtcaaattgtattgaaggccttttctgcatctattaagataatcatgtggtttttgtcattggttctcttttgtgatggattacacttattaatttgcatatgattgaccagccttgtatcccggggatgaagctgactcgattgtgggggataagctttttgatgagctgctggattcagtttgtcactattttgttgaggatttttgcattgatgttcatcagggatattggcttgaagttttcttttgttgttgtgtctttgccaggttttggtatcaggatgatgctggctttataaaatgagttagggaggagtccctccatttcaactccctggaatagtttcagaaggaatggtaccagctcctctttgtacctgtggaagaatttggctgtgaatccatctggtcctgggctttttctggttggtactctaataattattgccttaatttcagaacttgttattggtctattcagggatttgatttcttactggtttagtcttgggagggtgttatgtgtccaggaatttttccatttcttttaattgtgatgtcagggtgtcaatttgagatctttgtagctttcttatgtgggcatttagtgctataaatttccctcttaacactactttagctgtgtcccagagattctggtatgctgtttcgttattctcattggttttacagaacttcttcatttcttccttaatttcattatttacccaggagtcattcaggagcaggttgttcagtttccatgtagttgtgtgattatgagtgaatttctcaatcccaacttctaatttgattgcactttggtctgagagactgtttgttatgatttcagttcttttgcatttgctgaggagtgttttacttctaattatgtggtcaattttagaataaaggccatgtagcactgagaagaatatatattctgttgatttggggtggagcgttctgtagatgtctattaggtccacttgatccatagatcaattcaagttttgaatatccttgttaattttctctctcactgatatatctaatattgacagtggggtgttaaagtcttctgctactattgtgtgggagactaagtctctttgtaggtctctaagaatttgttgtatgaatctgggtgctcctgtatcaggtgcatatatatttaggatagttagctcctcatgttgaattgatccctttactattatgtaatacccttctttgtctttttttatctttgttggtttaaagtctgttttgtcagaaactaggatttcaacccctgctttttttttgctttccatttgcttggtattttgagcctatttgtgtctttgcacataagatgggtctcctgaatacagcaccctgatgagtcttgactctttatccaatttgtcagtctttgtcttttaactggggcatttagtccatttacatttaaggttagtattgttacatgtgaatttgatcctgtcatcatgacgctatctggttattttggacattaactgttgcagtttcttcatagtgtcatttggtcttcatattttggtgtgtttttgcagtggctggtacttgtctttcctttccatattgagtgcttccttcaggagctcttgtaaggcaggtatgatggtgacaaaatccctcagcattttcttcttttgaaagggttttatttctcctttgcttatgaagcttagtttggctggaaataaaattctggattgaaaattcttttctttaagaatgttgaatattggcccccattctcttctggcttgtagggtttctgctgagagatccactgttagtctgatgggcttccctttgtaggtgacctgatttttctccctggctgcccttaacattttttattttatttcagccttggggaatctgatgattttgtgtcttggagttgatcttcttatggagtatcttagtggtgttctctgtatttcctgaatctgaatgttgggctgccttgctaggttggggaagtttacctggataatatcctgaagggtgttttccaacttggttccattctaaccatctctttcccatactccaatcaatcataggttcagtcttttgacatagttccatatttctcagaggttttgttcattccttttcattgttttttatttaatctagtctgcatgccttatttcagcaagacagtcttcaaaatctgatatcctgtcttccacttggtcaatttggctattgatacctgtgtatgattcacaaagttctcctgctgtgtttttcacctccatcaggtcatttatatttctctctatactggttattctagttagcagctcctgtaaccttttatcaaggttcttatcttctttgtatttggttagaacgtgctcctttagctcagcagtttgttattactcaacatctgaagcctacttctgtcaattcctccatctcatcctctgtccagttctgtgcccttgctggagacgcactgcaatcatttggaagaccagggacactctggccttctggattttcatctttttgttgttgttgttgttgttgttaattctttctcacattcatgactttgtctagtttctatcgttgtggctgctgaccctcagatggggtttctatggggacttttttgttgttgttgttgatgctgctgttgttcctttctgtttgtttgtttttctttcaatggtcaggtccatcttctgtaaggctgctgcagtttcctggaggttcacttcaggccctattcatctggttcactccggcacctggagatgtcacttgaggaggctggagaacagcaaggatgggtgtctgttccttcctctgggatctctgacctcaaggggcacctatctgatgccagtaggaacactcctgtatagggtgtctgagaactcctgttggagggtcttaccaagttgagtggcatagggaacagttcctgtttaatgaagcactttgactgtcccttggtggacagggtgtgctttgctgaaaggaaaatcactcgtctggtctgcctggattgcccagaactatcaggaggaaaaactaattctgctggtccctggagactgtggccacacctcccactagggactcaagcccagggagatcagagttctgtccctgagcccctggctggagttcttggagttcctgcagggaggcccaacccagtggggagggatgggtcaggttcaggtctgaagaggcactctggccacagtctgccacagccagtatgttgggctatgggggatacctcttgagaccaagccattcagcctctctggctccagcagaagaaaagcgtggcctggagctatagagattgctgccacccttcccctgccctgggagcttagtgtgttaggcagctatcagtcccagtgttggctaccaaccctcccccaagaagctcaaatgacttagacaacaggcagccacagctgagatgctggccaccccttcccctgagagctcggcaggcttaagcagattctagatgagtggctattgagaatctgtgtggatctctggttgggaccctaggccctggtggcgtgtgcttgtgactgggatcatccaatctgtgggttgcacagttccatgtaaaaaacatggtttctcaggctgggtagcacactccctcaccacctcccttggctatggaatgggggctcccctgccccatgtggctctcaggtgggctgctgcaccacactgctctttttcctctccttggatcatgctagccacctagtcagttctgatgacagaatctggatatctcgattgccagtgcaggatttgcatactgttgtggttcttttcaatggcagcctccgatctctgctgcttctagttggccatactggccctgccccaaagcctaatttttaatccctactgaagatgcagttctcattggaaactttaaatttgatggtgtaggaacaaccatttgggtacttggtattcttttgaaaaataatacctaatagtcattctatgttacttatacaatgattttctgtccaaaaaggatatcaattggtacatcagaattcatgattgtcttccgaatttttctaacattgaaatagggtgaaaaatatggttcaaacacacattttttttaacattagggattgtacagaccactcctcaatcccaacaaatgtactctttttatatttaaccagttctaatagttgagtatttaagataattttgacatctttcttctgtattttactaggttaccataaatatatatatatatatatatatatatatatatatatatatataatctttctacccacaattgtgtgataccaattagctcaaatagcttttttttgtttttttaagaaaacagcaataggaggacatagcatctatgctcttggatgtcagttggacaagatgatttctaatattttatccaatgctgagatggaagttttttttgtggcagatacatgaatgaaagcttcttaaaaagtattttttagtcaattgactagccagcctgccttttcttgtccatgtttttaagaatctgaacctaaaatccagttttctgtcttaaggagaaaaaggaaaagatatctcatcaaatacatgttttacaattttatctctaaagtgcatgtgataggatctaacaaacatgtagagagaaacatctgcaatgtgtgaggattaatcaccaaatttactatgtatcattaatatccaagaaacttcagtgtttatgagtgtcaggtaaagaaacaaacatattcacttgcaaaacaatgaataaattgataaagaaagcaatccacattttgtcttatatcaggtgtcacttaattagctataggcccaggcaggcaacgcaaaggatcttagaagctcaagtggaaaatgatagagggattagggccacaaagaggccctctccataggaggcagaagacagtcctagccaatttttgccacatgactatgaagatctagggtcaccagttttacaagaagccataaattcaaatttttacatgtaattttcagttccttaaaactctgtatttgacaaataatgataggaaaaaagcacagctaatcatcagagcagctctgttgctgccaatttatatatatacaattttacagtatattgcatgtaaaatatatgcaattttatattataatgaaatctaagctatcaggtataaaactacaataagatttagtagaaactattgattatttctggaaaatgtcagttcagtatggtaatatgcctaacaggctcaaattgttgctcaggtgcaacaaaaatgctgatcattttcaagagaggaagtgttaagaatgaagttacaaaaatgtgagcaacataactgatatagtttggatttgtgtccccacccaaatctcacgtcaaattggaggagggacctagtgggaggtgaatgcatcacaggggtggatttctcccatgctgttgtcatgatagtgagttctcacaagatctgatggttttaaagtgtgtgggacttccccctttgctctctctctctctttctctcctgccaccatctctctctctctcctgccaccatcctggcttcccctttgctttcggccaccattgtaagtttcccgaggtctcccagtcatgcttcctgttaagcctgtggaaatgaaagtaaattaaacctcttttcttcataaataatccagtctcaggtagttctttaaagcagtgtgaaaacgaactaataattgaacatataaagcatgtaaaatgctggcccatttgtccatcacaccttaggaaacacaaaacagaactgtagtaggccagagatagaccaccaaatcatgttgatcaatgatatccacgttgcagacaggggaaagaggttgaagttgaggtcaagagtgcatgaagacaggtgagtaagtttggtttttgttttgttttctagaaaagtaacactaaagagcagtaatattggagcccacaacatactatgtgtgactatgagtttaacccttggtttattacaggattctggaataatagttctaggaggccttcttgtaaaattaaaaagaaaataaaaagaagagggagaagagaatgaaaaggaaaagaaaaaaaaaggaaaaaaaaatagcttacctttagtcaatttacatacaataagggcattaccagtagtagctgtctatgctgatactaatttttttaacatttatatcagttgttctccaactttgatgtgcataaggatcatgcagtgattctgttaaaatatagattgataaattcacatcctggagatgttgattcactaagttcggcttgagggcctaaaaatctacattttcaaatgtgcaccaggtatttgtgatgcatttgtgatgcaaaaagaccctattttgagaagcatcaggttagatgagcaggccctcaccagacgtcaaatctgctgacaccttaatcttgtatttcctagccgctagaactataagaaatacatttctattgtttataagtcacccagtttactgcatgttgttagagaagcccaactgaactgagacaaagtgccttaaatctcattgaagaagcactaacagattctatgaaagttaacaataataactaagttactgtgcatcttctgctggtagtagtgggagcgatcaatgtaaaacaataatttgaaagtaaaattttattagtacccgataggctaaggcaaaaatgaaacattgggaacttacacttggagcactgtcctaggatctccaacttcgcccccatcgccaattgtcaaggtatcatagccaatctccagatcaaattcttcaaaatttatctggataacctagcagtaaacagaaacatgcaccttaaatatactgcgttgtgcaataaaaacaacaaaaaaagcaatgacagaaatgcattctttgtctctctgcacacacacacacacacacacacacacacacacacacacacaagcagttcaattatgtataaatatatatataatttcatagtatggcagcaagtcatgttagaatattcttaaagttcaatcatatcattacatgacttttacttgctgtattgtattttctgcattaaattttcaatgaaattgcatggtttctgtttatagaatactcttacttgaagaatgattaaagcaaatctactttaagaaggctttataaaaagtatatgtaggtggagagtggttttccacatatttgcatatatattttataaagttaacatgcagaaacagagtgtgctatttccattaagtagtaaagcttaaaatttgttagagctaaacttgaatctagattgccagaatggtatcaagtttatttttatgtatcgtttggtaaaagaattcctcaaatatattaaaatgagcggcaaaactgggagcacaatactttgagaggcacactataccatgctatgtaattcagcattatttcttgctaaaatatactcatgtatccatatattgtttatatacctatgcaaaaattcaaatttaattaaattgcaattttaaaaatagctataatattgaaaaaatgtaattaagaatcagtacagaaagaaattacataaaattacataatgtcctgcatagagtcatgctttgagcaaaaaataatttataacaaaatattattcatcacctgataaaatgaatgcctgaagttaccatattatgagagaataaatgaagaagatatttctttagtaatatttataactatttgctactttgttattataaaaataattaaaaataaaggaatttatatcttggcttttttttgttataataacaatttttttttttttttttttagatggagtcttgctctgtcactcaggctagagtgcactggcgcgatcttggctcactgccagctccgcctcctgggttcatgccattctcctgcctcagcctcctgagtacctgggactacaggtgcccgccaccatgcctggctaatttttttgtatttttaatagagacggggtttcaccatgttagctaggatggtctcaatctcctggcctcgtgatccgcccacctcggcctcccaaaatgctgggattacaggcgtgagccactggacctggccaacaatttttgactacacatatttcttgttttataaaatattttaatatttgcattgactaaaacaattgttttggccaagtttaaatacagcatgtgtataaagactttgaactatacattttacatgatcataatttaaaaaatatgtgtatttgttccacttatagtaaaatataaatacttcccattaataattacctgtcaatacagacttagattgtttcccattttctttcttttttttttttttggctactataagcaacatggtcatgagcagtattaaacatcttttggtacacattttcaggtatgtctctaggcagtatacttgctaggtaataacagcaaaaattcattttataacctagtaccatatggttttccaaaattgttttaccaattcaaatgttcacattcgtgtacattgaatgcatttattcctaccactctagtagatgtaaaagtgtttttttttttttcgcattttccttaatactaattgagttacatatctttttatatgtttatatatcatttatatttccttttctgtgacacaactgtttgtgttttggcatcttttttcctcagactgcttgtctacttgttatcatttgcaagaattctttatattggtgattctgaaaacattccattatagcacactttgaaaacaataatatttgtaatacacaaaggtgaacagatgaagctgcttataatggaaattttatttttattttttgcccaggaccttctgttccatagagggagttaaatcaatatcttagttctacctgtggctcactcatagtacaccactggatctggctcactagttgagatcagctttatatattatggatactaatcccttacattatatgtgttgcaatagcttcaagttcacagcttccttgttagattatttataagaaaagttattaattttaccagagtaggacttacttatctactcataaaataatagataaacaaatcctactctggtaaaaattattaatattaatgacacaagctcataaagatgtatcttcatatcttttatcttttgtgaattgacttttacagaaactgcaaagtaggaatgtgtgggaggcagaattctaagatgtcttccaatattctaatccctcggtgtagataacctatataatatcctcctcttcagtgtgggcaagacctatgaaaatgacggattatcaatcctatgattagtttatattatatggaaaaggtgaaggaatattaaagatgtgtaattaagatctctaatcagttgactttaagttcatcaaaagggagattatcctgagtggccctgactaattcaggagattccctttaaaagaaggtccagaaatgagagatcaaaaaacaagcaaacaaaaaatcagaagagatgctctcctgttggccttgaagatacaaactgccatgctgtggaaaggcacatttagcatggagcagtgggtggcctttaggagctgagggcctaagtcctacaaccacaataattgaattctgacaacaagtgagcttggaagaagccctacagtttcaaatgagatcacatcccagaccaaagctttgatttcaccccggtacaaccttgaaaagaagacccagatatccatgcccagactcctttcctgtggaaactgtgagataaaaaatttatgttgtttcatgttgctaattttgggtaattttttacacagcaatataaattagcacaatattcctttcatttttccctccaatatgaacatccagttgtctcaatactttttatttaataaatagcccttctttctccaatgatcagcaaaccctaaacatatatcactattctgtatataagtatgttggattttggattctggatcttgttctcttggtaagtttgtatgtacccgaactaccacaaattggcttatttttattattgctataagataagactgtaccttataagtcagatactccacacacttaatacttttgttctttgggagtattttgactactcttggaccatttgtctttcacatatcaacttgtaaaattcttcaaaaatttattttgggctttctaatggaattgcagtgaatctgtaactgatttggtgagaactgacatcttaaggtattgaatatccctacacacaagcctgacttctctcttcatttatttggatctctaaatatattttaataatttttttagtatattacttcttgaaaatgctttttgttattgaaagtggtattttatctttatatttggaacttttttggtatatagaaaagaaatttattttttgtttattgatctaactaggcactggataaagcttccatattatttaaaaacatttgtaaattatttttagtttcttacatagcaagcatgtcttctgtaaataatattttaggttcttcctttccaaattatgtaattttaaaatcttaactttcttggatatctggtaaaatgtttactagaacagatgacaattagtctcattaaattgtacctcatttaagagggaatgcttccaatatatatgtgtgtatgtgtgtgtgtgtgtgtgtgtctgtaggtttgcatggtattcatacatagttttatacatttcttttgttttcttgtgaactaataatgacatgaacactaccatgtttcttatatttcagtgagagtaactctcaaagtacctcatctgtcatcctgccagaaggataaatcccatgatcttcatcaccccaacctatttcacagtagatatatgagtgcactgtaattaaaattagagaatgtttcctttcatatgacttaaaagtctaataggctagtggatacaaattaggtaaatgactgcctaattgattgctagttctatgccaaactcttgatatccattatagtatgatcatatcctaaagactttggacacccatttaatggtagattttattttgcctaaattgtaactgagactcatgcatgtatgtatgcaacaatgagagctctatctcactttaaattaagtgatgaattaattactaactaatccatatacttttggataagcacttaaccactgagctttcactgaatttttagacacttaataattcttgaacagtttcagtgacatacaattactgagaagctagaatattctgattgaatttttataatacattcattttagtttgattcatttatgcttatttttaacattattattgaaatagtccacagaagtaaaacttgtgcattaaaaaaataaaaattagctttgccttatttgaagccattaatataagtaaggtattacagtaaaactccaacttagtatattgagatatggttaaaagaaaaatatctttaatagcatgtgtaaataaagcttaggaaaacaaaaacaaaatgacaacaaaacttgttcattctataatgtaataagtaacatcaggagtctgatgtaaaattttccttctttattgatactttaataatatgaaagtggccaaatagacatttccacccatttatttttgtataatatagaaaagttaatataaaaaatcaacaaatagtcataagtataataggaatgcttcctctacatgtttatttggtagtagggctgaaacatttagtaagaaaataggaaaaatattatgcatttagtgtaaaaagaatgccatacattttgcctgttttacttcttcctaatcatttgtggagtaaataaacaaaaacataaattgcatttagcacataggactaatgaaagaaaaactggaataataaaatatacccttaaagtatttaaataatgtataattgtcttgatttttttaaaccaagtaagtcactctcttgatttccattgtgaaatggtaattccaactggattgcttagtgttgcttattgaggtttgaattaaaacatttaatctactaatgaagtcaattaaaaataacataatgctttttaacactgactttccagaagtaaaaaatccatagatagcattaaatattaaatacttggtagatccatttctcataaggctcaatacataggtttttacaggatattttgttaaaagtggtacagaagctatgtctcataatctttctgtgaatcttgcacagataatttaataccataacttctacattgtcatattttctgaagccatgcggaattcccacttaatacccattaacatgagttttttaaatggaacatatttatattatgtaaaacactggtctcagaattataaatgcattattttattttgaccctaaaagtctatgttgtgtacacctatacattattctggctgcccagcacctgaatatcctccttttgtctgggaaattaggaatcttggtaggaagtacagcatacctcccaatatggtcagatcctagattccccattattcattgtatccagtgtacaggcatgagaactaagattcccttatcaatcagatacacatcttatgtgtataaataaggaaacaaagattgaattctggcaaagagtgtcaaaagcaacagaaacacagtttcaggggcaacagtggttgtaatatgtagtggcactgaaattctagagcacagcagtcttgttcaacaggtaaaaataaatcctctcaggaatcagagccagaagctgtggagcactatgacaaggtaaatggattctattacattccaagcttatctaggaactcattccatttctagagaaatcagtattcactagtcttatccagaaggacatgatattgttctgtgacccagtaaccactctgtgtagcttcaattctctcttcttctgagtgggagtttttatggagttaccctatttgttttctatacttttatattggatttgggatagcctatgttttagccacagttctttagacaatgaggaactacctgtaaatataatggagaagccagtgtatcacttagggattctggacatatctttgtatgcagtaaatggatgaaattttaggttttctctattaatgtagatagaaagtatgttttacataggtattttttccaaagtgaatgcaggagaagaaaaatgggtctggagaggtatttgataaccaaaggggaaaatgtggcagatgctattgattgcttacccaacagccaccttccgtatttacccttgaccttttcttctcaacaggacatatattttgttctcttgtattcttttctgtacatcctaatactcagggactgctcatccaattatgagtttcctgagatgggtcctaatcactctatgccccattccatttgccagtgattcgattacacgtatttgacctaattctggccactggaagatgattagcaatttgctgagaggcttttgcaaaatgatttcttggttttcaaagaagtacaaaaaatcagtctgctttgaggtaattctatctgaatgtattcagctattacaaccatctcacaatacgtagtttgaagataaagcaaaactacatgttgagatgtccagaacctaggaacggtgtttttctgtgtgcgtggggcttgcatgcttctggacagtatgctttttaaataatgcatttgttatttaagtcattcgatttgaggtttcccatatgtaaactgaagacattccaatgaacaaatcgttttaataaattctcagtttaaaggaatgctttgcccaagtaattttcccatgtttatttggctactggtgatgaaactaaacttcaagtttgcttgatgatagtaattacatgcttaaacatcatgctattctacgttaacaaagtaaacttctgaaatttagaaaatattttccgtgcatcccaaatacctcatatcatgttgttataataatttataaatatgttctttgatgttgggcatatgcctcatgtattaaatagtgatggcagggagagacaatttctgaaacctaacaactaataaatattacataaattcttcgggaaaaaaatatagaaagcatctattgatacaagttcttttgtatttcatggtaaagtctgtatttgttaattcaaaataattctgaaagctgaagaaaatactcaatattagacattttttatttacataattagtacaacattcaaattagcctttgatgatgtttaaccaaacaaattaatgatgctttaactaatgccaataccaataccaataccaagctatactcattagtgagacaggataatatagataagtccacaggaaaagcctgggattatagccccatttctctaaaaaaaagttatattattttgagcaattctctaacttatatgaaatagtgtttataatttctattttttaaggttgaaatatgtattacaataagcaaggattataaaataacacataggatgcttgatatatagtaggacctcataaatggcagttattattagctatgtcaattatcttaaaataggtattcgtatctgttcacaatggatcttgaggatgaagttcttttttcagcaatcccatttgattccaagataagagtttttcccccaaactctatgttgctaaaaatttaccttttttgggagcagcttttctccattatgattatttcagaatggcaataagtcactctaatattaacaattatttttgctccccggtgtggaaatcagaatgcattatatatgtataattacaaaatataaaaactttaattaatctcaaggtatgcaaataccacgttacacaatcaacttgacatctaattaaagcacttctttcttcatatacattctataccttggcaatcatagtccaatgagggaaacatgacataagcaagatgaatacaataccctgtgttgattgctttgggatatagacacactgggttatattagcagagatgacagccactcaatccagttggagactatagaggaaaggattccctgaggtggaaaaccccagacactgccaaggaaggtggagttgggaactgggaaagaacattctagggtagaatgtgaaatacggcaaagtgaaaaaaatattatttttgtttctgaaacataaactgtgaggcaaaaagtgatgagaaggaacactagcgatgaaggcagaaagcagaccatgttaaggactgtgaactttatcttctatatgaaaagcagcatattacgattttgaacaatgttgacagggttatatttaattttttacatgctcattttggcagcagggacaatctggatttgaaggataacagggcagggttagagagattgaagacctaaacttggactgtggaagtagggatggagaagagtggattcagacaaggtttctttgctctaaattaaaataattataatagttttttttccctttttttccatacacatgaaagcattattcaaaggcccacacaaaaatctatgccttggcaggactgtcttatcaaatgttattgcttgtaaatgtctaatgcagagagagcaaaatatggagtacctttattaaaaaatcatataattcagaataattctaaaacttggctgcttttgtggtatgtattataagtgacatacatttcacatctatatggaaaattcatgttaatgatgtttaagtaataatcatcctaaattagctacttaaaaataaatatacaaaggtaaacttatatgaaatttatgaaataggtaaatattgtatgatacaaaatgcttaaactatgacacatcagaattccttatttattcatttgaaagtgatatcattttagagaaaataataaatatctcatattctagaagaattatgcattgcaatatttaatattttacttacatattttattacagaatatatatcccaagactctaggctagaccattcaacagtgcaaaatgccacctcagggaattctctaggctaatccactttgctgccagcatcaggttaacagtttcaatcttgcaagggctcatattttagagatggggtggaggagagtctggggacactgagagctactgatggagtgataaaagcttttagctttgttttatttttctatgcctttaatatctgtacactggtcttctcctttaggggactgttggcatgtaacaatgacagattacataaagcactacaaatgtttcactgaagggaagaagctacataaaatgaaaaattcatcaaatattaaatccatagcaccacagtacaaaaccattggttcctttccatcatttattcatgcttagctactggaggatataatttaaattccataatacatataaatgatcaacttgaatttacagattttgaagaaaatccttgcagataatattcttggttttaggagactattcattacaaatttgtataagttaggtcgtatatatccaaaatattttgaaaaatatgtatgaggctaattcaaataaatttgttaagaagggctctttttctgtttttttgtcccttattaataatggggtcatcatggtctaggatacctctcttttcatttatttatctatatctatttttatataaaaaaactttgactccagactttgagaaaatgaaagttttgttcaaaatgattagatacacaactatagtagtgatatacagatatttatatactttcatatataatgaaccatgcaatgagttttaattccagcctcagtttatccttgttatttttcttaagacaccaaaagacaggatgtaagataccagcttctcaatgcatggtctttgttgttaaccttatttttgtttatgtaatttatttaaacaaggttattgagtagtgaatctttatcagtttatatctgtggaaggcccggtttacttctatgtcttcctggacaagcaacttaggcaggagtccaggaagttagggtacaagagaaattacctgccacagctatgcaggaggaaagacttgtagcccatgaatgaattctctctggagccagtagttaggaaaagactggggaagggtttttatttctgtctttgtgaaaaaggtcaccggtattttgatagggattttgtagattgctacgggtaatgtggacattttaacaatattaattcttccatttcacgaactcaagatatctttccatttatttgtgtcctctccaatttctttaatcagtgctttatagttttcattgtattattgtggttaccagaagctggagagaataaggaggaaggagaaactgggaaagttactttgtcaatgggtaccaagttgaagtttgagtgaccatagtaataacaatgtagtgtatattccaagatagctagaaaagaagattttgaatgttattatacaaaggagcaatacatgtttaaggtgataaatataataattattctgatttgatcattatataaggtatagggacatcaaaatatctgtatttcactgcaaccttgtataattctgaaccccagaaacaatttttatgtgtcaattataagtaaaactttaataaaaaaagagtgaggaaaggtagctatactactgtttcctattttgtgaactgtgcttcaaatagaaggctcctattttaagttttggaggttaagttaaaacacaaatcagataatataacttctatctaaaagctattgacttatttaattgtatacacatatttaaaaatatgactctttaccagcactgttatagtgatatagatacagactaacttttcttccttcactgggggaagaatatagtaaatttaaaaaatatataataatcttatagaatataaagtcttcaaacactcatatgtgttatgaagtgttttaaagaaagataaatcaaggtaagatgatagagagtggtggaggtgttcagtgatagaggaggtgagggtgaggaacttgagagaaatctgaatgaaaagaggaactatttagatatcacattcatcagtggtttctcattccatatttgaataaatctcaaaggggcctctatgatctaatctttctttagttctacagtctccatgttgcccattctcctctttacccactatgccaagggcccctgtaatctttttagtttctagaagacatcagggccataaaaatcctttatgaggactactcactctgtctcagacactcttctctctgcatttccagttccttgtcattccataatattggctgaaaaatcatctgctcagaaaagtatttttgacatttctaaggggcttcctctttattccattaagggtgatttctttacatgatgattatttattcctgtgtttatccttttattgtctatttaaagtgctaactagaagcttcctgatgttagcacatttgtctttctaaaaaatcgattgcaatcccaggttctacactgtaaaactgtaggatttcccaggtaatgtctagctaagatttacaatattggtattcatctggccactctaaggcacatgaggtgctttatgcttgtccttggatgttagagatcgtcacagactgagaatgtatagggtggacactgaagaggtcttagcaggaaaaaaaaaggtggaactactacatcctatctctgcagatgttgctcccttcaaaccttacccctaatatcattgatgtgggtgactttactattacatcagaaggggttaaaattcaaagcagatatgtaatactgagcaaaggaattacacacatttttacactttgatatgtacattatgtgattcttgctgtgtgagggcaattaaatcatccaaatgactctccttcacattgaatagagattccaggagaccaaaaagctgtaatactaagaagggcaagtgctgtgggtaacacaggtataatatcacattcctcctctctcttcacaacccagttgcagctattcttgaggtgttaggtagctggggtaggagacaatgttccagaaggttgagcatggccccactaactctaaggttgtcattaagataaccttccattctgctgcaaaatatctcagtgacggaaagcaaaagctcacagctcttgccagtttcttcttcaagctctcttggcagcagcctattctgacttagaagcatctgctgatggtttccggtgactaatatcagcagggagtctccacaagaatatttcaagatctgaaatgtatgagagtgtgtgttatctgcaccgtaggaaactaagctcaaacgttagtggaggcattatacccatctcgctctgggaatttattagtgttgttggtggtggtagcagttgcagtagtagttacaatagtaatattattaacactaatattttgaacatatatattccaggccctgttcttactgcatatctcatattatcctttcaagagtcataagaaattaaattattgagaccacagaagtccagataagtttttggtggtgatctgtgattcattacacaattatgcagtgtctatatttatatacaactaggtactttttatatttgtgtattagtatatgaggaattttagcatcaagaatgtaaaatatagaaaggacatacaatgaatatttactatttattcctaattattcaatgagtggtattacatcttcaaaagaatataaaatactcaaagtcaatgactattattgtaagtattaaactctcgtgatgttaaaaaaactatgttgattcaagatgttaaaatgaatctgcctctaactagtaaaattgcaatccataattttatacatgcaattatggaattaactaaaatatatgtgatgataaaagaagttgctaaaatattagtttaagaataaaataaacataaatgctttctagaataagcatcaattctatccaaaaagagagattttatgtttggtttctttatacttctctgtgcttttgtttacaaaaacattgattagaagaatgatgatcacactagatactatcatttgaatgtctcccctcaaaaattcagatattattaatgtgatagtattaaagatggtagctttaagaggtgatgtgccttgagggctcctcccttgtaaatgggatttagatgctcataaaagaggcagcattaagctcccttgtctttctcactttccatgtgaggacacagtgtcttctgctgtccaatttccttgttactcctcattgccacctgggataggcagaatacctaattaaagatgtccactccctaatccaaaaaaaagctgtgactatattaccagacatgtcaaaagggacttgaacttgtgattcaatttaagaatcttgagatgaaaagtttattctggatttctagagtgggccaaatctattcacacaagtcttaacattagaggaagaagtcagaagaatgtgcaaatatgacatcagaaggactagacacatctttgctggatttgaagatggaggaagaagactgggaatggacctcagctaagagccaagaaaaaataaagatattaaggaactacaaggaactgaattctgccaacaagatcgattaacaggaaacattctttcccagattttccaaaaaggaatatagtgtgctgacaacttagttttattgcagtgagccccatgctgaactgctgacccacagaattataaaataatgaatgttttaatttatattaatattattatttgttttaagccactaagtttacagtaatttgttacagtagcaatggaactgtcacttttataacagcatccagacttcatcattcttatttcatttaataaagccactggctcaccctgcaaatttacataagccacataagttttccaaacttgtttctgcacctatacaatctatacaataatattaactattcatacaattaataggaggattaagtgagaagatacataaaaatagcttagcatagtgcctgtcacatacactcaattcatctacaatttaatataattaattcaaaaaaatcagtaacagtaataaaatcatgagttttttcctaatatcttttctcttgctagctagtacttaaaagggaatattctttgttcactcatcaattttggactaaatatgtgtaacagaggttgtcatatctttccaaaacatccatgtactccttctcctaccatagtagaattcctagctggtagcaagttgtccttactaaagactatattttccattctctcttgtagctaagtatgagaatgttgttagattattgcaaaaatatgatataaatagaaatgttttgaagcaacatcaaggaatatttcttaagagatagcttacatttgtcctttgttttccttatttatcacttcccccaacctgcttcctagaagggttagacaccatgttgcaacctaagataaagaccacaaattgggaatggtagggtggtgagttagactatgactctgagaaatttctggatcagagacaccattagtcttggaccagatacatatcttgtttaagtctctgttaatgcgttttctgtcactgacatccaaacctaatcataattgaaaagcctgtgcatctcggttgttttaattaagaccttctttgcccagtctctctttttcctcccctatgccggccccagaaagactgtatttggttgtataaagtacattaattgccataatttatttgaattccttactatttatgtcaaattattattcaacacagctctgattatgcatatgattccggtataatcataatactgagattaaaatggtgggtatacccaatggttagtagtgggaacagtagtggaaaaaatacaaacaaaaatgctttgccatttgcatattttgcctactttgttggtaagaaccagagacattcctagaaagagctaaaacacatggaaataaacaagcaactattttgtctaggaataattgctcagttatttcaataaatattcatttgaaaaactcccacatgacagttacttcattagatattaaggatgcatggactcaggaactggtttttgtccttaagggttaaactaaggaaaataagtgcacaaacatgtaagtacaatgtaatgtgacaacacatgggtcagttatgcagagtaagctttcccaatctaggtgggaagataggacaggcttctaggaaaaggtaaaagattacctgagtcctagaagatgccattaataaacagggtcacaagactggagatgtgtaaacaaagtgaaaaagtatattccctacagaaggagcggcttatccccaaaatacagggtcctagaagtgctttgggggctaaatagagtgttgaagtatgagtctaacacaagagtagtttaggttgcccatggcttcctctataaagctatgcagaaccatttaaatattttacaaagaagacattatttcatctcagaataaaacatcacactgaattttttggaaagtaacaggcttggagtaagcagaaaaatgagatgaagatttgctaattggaaagctggttattaatccaaaggagaataatggaaacctgagtgagagggagttaaacaacttcaaggcatactaattaaatataatgaagtcattggactttgtatttagatatgtgaaggaaaaggggaaggatgtaaaatgaaaaatgtttgaattattaatatagaggaacactaatatttaaggataaggtcactagcaaaagcctggaaacgtagggggaaattcaggaaaacagagaataaagaggctggggaggataaagtttcaaggaaaaggaagtagtcaataatatgactcactctatacctatgcctttcttttacttaatttattatttaaaaatgtgttttcattataaaatgaagcatatatcttatttgatactttttttgttagtacaaaattaaagtggaaaatgcatgtaatcttctatctagagataattcttttttaacatgttaaaattattcttaaaaaagataattcttttttaacatgttaaaaaagaaatattcttttttcccctttctttctttccttctctctctctctttctcctttccttccttccttcctttcctttctctttttctttctttctctccctccctcccttccttccttccctccttccttccttttttctttccctttataaatacactttttaattttcttgagataggtgttgctctgtcacccaggctggaatgcagcagcagggttatagctcatccatccttaaactcctggactcaagtgatccttccaccccagcctcctgagtaactgggactaaagacatgtgccaccatgcccacttggttaatttttaaaaattgttttgtagaaaaagggtcttgctatgttgctcaggatggtctcaaattcctggcctcaagtgatcctcccaccttggcctcccaaagtagctcccaggtatgagtcactgtatctggcctcattttttctttattgatatttatttatttatatttattgatatttaattttattgtacttgcacagagtaattcactttaaataaagtatttcaattaaataaaccatttgaacaaaaaaaataagtaccattggtaggggttaggaatagttaaggtactgctatacagatatggttcacttaagaggaggggaaataaaagatcagcgcctttaaaattctactgccaagcctgggtgttctataaatagtgaccagagctacttttcttggcttggggaaccttgtagttggtttttctaatttccatctaattgttttgtatcaagatcttcactctgctactaggttctttctgaatcatgctttgttaagactgccaacctggctttaatttcagtttatccctgtactgctgcctcaggtttggtcttgttagtgcctgctccattgtagtagatactgtcaatgctccaggtgatcaataacccccttggatgcttcttgccctttctgttatctgttcattatcttccatacactatgcatttgtctctaaacgtgtatagctatgagtcttctggagactgctttcaggctacaggagcccacttggtccacacatgagccctgaaagatctgggtatcacttaccctatgatcatggggtgcagaagtatgagagcacagcttctttgccttgagttgggataaactatcaggtgtaatttacactgcatgagatccagcagaggcttggattttgtctgaaattgcaccttgcttaacttccttcttgtcctgcctctcccactcccttaatagtttctcctggatacactttcttaatgaatcagcagcatataattccttctcttgggcctgctttttcaggaacataactgaagacagctatagtctgcagaaaagtgactctctatgcctggctgaggtttcagacctggcactgaagcttggcacaagtaccaaatctccaaatatttggcgcaaagaactagtacctataaatgggctgactaaatgaagtggcaaaaggctatctctaaagatggaaaagtgacaagaattgttcagatgacagtgttacaggtgagttcaagagtgtattctgatgcctgaagactttatggggaggaagattaagattgtatttaatggatctaaagaaaaaacatgggcttaaatgtattgaatgtacaaaggtaatatttcacagtttaataattttaccttcattataaattggaccttcactacttgtttttaaaataagccaaagaatggaatggcctgtctgaaaaggaacttcatctcctactagaaaaggctgtcctttacctgaatttaagtttggggcaagtgtccataaaaacataagagcagagaaaaactcatttaatacttcacttcaacagaaatcaaatctatgtttcagaatgatatgaaatgttgtaatgaagttttatcagaactatatgaaaaacccagtaactatgccttatggtagctctagagaaaataatatacaggcacaaatatgatttaatataaatgtagttagcatttatttataaagcagtacaaataccaacaaaatatttgctattcattgtgcactcatcttagactgtgctgtattaaagcacctagtaatttccgaacaatatatattgcttattcatattaattaattattttatttatacaataaatgttaactggtcacccactatgagctaggtactatgcttatgcttacacatccttaaatactcaacatatctcaatatatgtataatggtctatctgataatgtcattcactaaaagttatctttggaataagggatgggatgaaaaataagcatatataattccttaaacttacaaggtagtttccaatgtacaaagtgctgttttatttattaacttgtgtgatacttcaagactcctatgacatggtgaggcatggatgattacccctaatttaaagatgagaaaactgagattcagagaggtgagatgatctgcacaacaattcagggcttttgactcaggttcacattctatccatgtcttattccacaaaagaaaggcttttataagtagggtgggaagctccagagtgaatttttaaatatgtacacttaaaatcataccagtcccttgacctccttcattaattcaccttggtcatggtaagccatattctctaaattttaagatccacaagtgatgtgacgcaaatttaaaacaaagtaaatattcatagttttaaaatacaaaaacaaatatgcttttgtctagtgttatgcaacattttttaaagccataatcaatacttattcttttgatgacatattttatttcttccgacaattaagacttctactaagctagcgagagttataatctgaagtcaacctcatatgcctgtctttattctctatgaattatattcttctatgcccagttaatttaatctttcattactcacctctcaaagaattgtattttcttcgttgtgagatttgctgacatcctggagtcatcaaaattatcctcataacaataactcaatattgataaaagtatattacatttaaagagagcagggggtggtcaaaaagccataaagaattatgctcctctacattttcagcttagttctttacattatatggaagaattgtctaattaaaatcattgtaattttactataatttacatgtttatattggaagaatcacatctcaaaaatctattagcaacctaacaaagtaaaggtagccaacactagcatgtgttttaatcacctggattttctccaaccagatatggataaaaatagaagaaataagcatattatcaattttcaggctatagtggaatgtgctagaattattctagaagcaaactgggatgttaaatattggattagactccatttatactagatcaggagataaaaacaaaatgatgcatatcattatctccctgtctcagagttttttggtgagaagtaacagaaaaccattttgactggcttaagtaaaatacgtattttaagttatggggtaggacacagaagcaagcaaaagctaaaattccagactaaataaaggatagaagcccaggaaactttgggttctaggtagtaggaaagaatcagtgatgactgtaagagtcaatgcctagttttgaatccagtttctcaaagttaaattgtagcctttggcaaattactttctctctctgactctatttcctcatatgaaaaatagggataataattgtacctacatgttagggttgttgtaaaactaaattaaatattgcatgcaaaggctttagaaacattcttcatatatagtaaacatccagtgaacgttaactattgttatttactattattctgaagtgttttccttctgataaatcaacaccaatatttttcagtgtgtgctacttttttcaaggttcagtaagaaatggagtgactaaacttgggtcacatgacatgaggagtgtattagtaaatgcttaataattggctctttgaaaaacatgcttattaaaaatttacttatataaaggatgtgtaacacagaatttacaaataatgacaaatatacaatattcttgattataaattccacacagccaaatgctttgcagaaaatgcttttgttgatgtctgccaaacatttgtatctgtagctaactcatggttacaaattgatgaatggactggtatagttctcacatgaatgttggttgatatttaatttatgttaatgagtgaaacaattataaaaatgaatacatatgttgaaacatcatttgtttgtcaatgatgtgaatgacttcattattgaaacagatcatagtttttgaatactggaagaatatttcctcaatttttttgtgccattcacaatgtaatcgctacagactcaatacacttcaaaattgaatctttagtatcaacattttcttcttcactttctatgtctacacaatgaagaaaagttctgatttcttgagtttgcctatttctatagtgtaaattgtaccactgtgtccaaattgaagctgccaaagagactgaatacagattggggcagagatgcactgtctttcatcattatatagtaggtccagcatatggtcaaaatagatttaaataacctcaggggcatagctaatagtaaagtctagtaaaagattatgaaataatgagttttgtgtagttattacttttatttttaatataacattatattttagttcatcttgtgtagttattacttttgtttttaatataacattatattttagttcagatgatttcaattttattattggatatgcttaacaaccagcttgttatattccttataattacatcagtgctctcaagagctgataaaagttacttccagcataccactgtatgagatcttcttggcaaatgaaggtggaagggttagggacagcgtaactttgattgaagtcccctccaggaccacccggaatggcagaaaggtagttttttggcttttaaaaattatggagaacagatggatgctgtgtaagcaaaaaaactaacatggattcaagtctactacaggcccagtttcacgttttttctcattcttccccctgataatctacctgagaacaatgtaaaacccatgagagagagaatcgtgacataaaggatacaagggaattgtgatataaaggacctttgagccgggcgcggtggctcatgcctgcgatcccagcacttaggaggccgaggcgggcagatcatgaggtcaggacttcgagaccagcctggccaacatggtgaatccccatctctactaaaaatgcaaaaattagccaggtgtggtggcgtgtgcctgtaatcccagctactcaggaggcagagacaggagaattgcttgaacctgggaggcgaaggttgcagtgagctgagatcgtgccattacactccagcctgggtgacagagcaagactccatctcaaaaaaaaaaaagacctttgaatcgtcagcttcaagaactacacctgggattagtagctactcaatacatacttatttgaatgaataagtaagtattccccagtagaaagaaagtctcagaggatagaatcagttgtaaaatttgagaggacacctattagataaatggcaacaagtagatggcagtaaaggaagagaaaggttattttgggaagattggttcaggggtcaacagagcagtgagggagccaggagcagcaagtcagaaaatttgcttagagaagttattttggtgggtttcaaagctccagaaaggagggtatggatcagcaataggacttcagtacctgaaaaagggactagtgatgacaagggaagatcccaacctaacaatgaaagataatagaatggacacatgggtagaaaacaggacagatttccaatcactaacaccaaacttaaaaataaatcccaaacttaattttcattatagggcatgtgataagattagaattaagggtgacttcaagttgagtcctaaaatatcagtttaggactgaaatttggatttttttgttttcctgcaaaagtcaacatttatacttaattgaaaaaagtggagtcaatgatatagtaagaaggactggacccagaatacaagaaagggactgcatgcttctctcatttgatcttttaatttttaaaggcaaatacacttgagtaattctgatcactgtattttatttttatcagtgctttccaatcttgaatacgagaagtactttgtaagtaatatgaaggaaatttgaatgaaaataattaatgggacactcacacgagatagagttgttcatccattatcaattaagaaaaaataggtcaggcatggtagctcacgtctataatcccagcactttgggaggccgaggtgggtggatcgcgaggtcaggagattgagaccatcctggctaacacggtgaaaccccgtatctactaaaaatacaaaaaattagctgggcatggtggtgggcgcctgtagtcccagctacttggtaggctgaggcaggagaaaggcgtgaatctgggaggcagagcttgtagtaagccgagatcgtgccactgtactccagcctgggtgacagagtgagactccacctcaaaaataaataaataaataaataaatagcaagtgttgttctgattatattaataatacaaatacattttggaatttttattagtaatgttatatatttacatttcaaatagtagttcaaatatacttgagacacttaatctgattcttccacggatatttgtttcctgggttgggaatgggcagtcttcaatcacataaaaatgtaacattagaagaagtatacagaaaaatatgcaagaatattttcaactaggcatcctactcattagcttttgccagttgttcatcactttcttttttcttttttttctttttttccttgagatggagtctgactccgttgcccaggctggagtgcagtggcatgatctcggctcactgtaagctctgcctcccgggttcaagcaattctcctgcctcagcctccctggtagctgggattacaggtgcctgccatcatgcctggctaatttttgtatttttagtagagacagggttttgccattttggcaatgctggtctcaaactcctgacctcaggtgatctgccctcttcagcatatcaaagtgtttggattaccggtgtgagccaccacacctggccgttcatccactatgtattctaactgtggctttccctctaagactttctttgagatctttcagtctcatggtttcaaataacatctatagctgacaatttgcaaactttcacctctatccttttaaaaaaggatatctggattttatatcccacttgatatccaatctaacaggtatttcaaatgtaacaaagataaactgttttttctcctaaaccagctccacctgtagcttttcccttttacttgaaagcaatactgtgctaattatttatctgctgtctcttagctctagccaacccttctgtattctgccctttgatatttgggttagaacactgcacattacaattctcagattcttttttttttctttagtggatgcctaaacctgctagctcacatcctttcctcagaggtgtgaccaccaaccatgaaagatttcctcctttgaaatttgagcaccaggtctagactgtttttactgcaagctcttaggttctggtaataccacagtttttacttttctttctggatgaaaaaaggatggtatctgtctacatagttattgcttcttcattaatttttactctttatgcattacatatgcaatgcctgtgtaacaattccccaaattaaattccattcattttaaatagctaatacagattatatttttctgactagaccttgtcagtgtagtcattcatatcaagagtgagcctaagactttcaaaaatgggttttgtgggagtggtttgcttattttttggtcttgccagagctgagttcttggacagtaaaaaattcatatgcaattacttatcttttgtgattgaaacagattttgaaaacaaaatttgtggggagagggcaaggggttgctgcacttgatggctaacatatccaagactacaaggacaatggagggagatggcaattgatgactgcattgaagccagaaagagaaattacagctcacatcatggtcagagaacaagagaccgtctatggtgaacctgtagcactgggcaggtatggctaaaacataccccaaatttaattatgcaagttacctaattagaatgtaatctgaacttacagactcacaaagtttcttatgtggaagctagggaattcactgagaaggaatgggatcatgaaatttaaaatggagacatttggatgctctgtgataaagtacagaatcttaaaacccgagttttcagagtcatttctgccaatttctgccattccatttttcctttccctgaagtcctagcaaaaacttcacctgaggcaattaccttgcaatgaggcatttattctcttcaatatccaccaccatcacctttcattctccacacagagcaatccaatagaaatctcagtggtgatggaaatggtcaatatggtagccactagcaatatgtggctattgagcactaaaaataaggctagtttgaactgtgatgtgataaacttgctagatacattctagatttcaaagattaagaataaaagaagagatggtaaattcttgcattaattttatgccaaatgcatgttgaaatcataatatctgtggttaaataaaatataaaattaaaattaatttcatctcttaaaaaatgtggctactggaaaatttaaaattaaagatgcagctcacattccatttgtatcggctagaccaatatccttcaaactcttgctcacataaataaaaagattttggaaactgtactttctcctacaattttacattgacatctattatttaaaactcttagtgtgaatagctgcaaaggacgcaatttctactccaatttcacaagtattttaaatatagttttctcaaaatcttgcatcattagttaactcaatttatggaaaatgtgcatgatattttataaatggaaaaactgtaaaatcaatcagacaaatcagaaactctttctgtctaaaaaagtcagactttgtgttttaattaaaattggcctataatatcctaagtatcatgagttctatataaggataaatagagatacaaatagagggatgaaaaaatagatggatggatgaatgacagatgatagatgaatgacaattagatgatagatgacagatagatagatatataacatacatacctgtatacacaaataaatacatagagaaatagatgatagagacagagatgcatagatgcagacatgggcatttctatgagtttgttgcttggttaataggatatgattcccttcaaatatgtcttagcgaagcttttttttttttttttctttgtctcaagatctgtccctgaggagctatgaatctggaatttcctattctaattctccagggttttatttacactcaagcaatgtaacatatttttattccagttggagaagtaatatatgattatcttttgaaacttggaaaaacaagtataagagggaaattaataaagaagaacaaacagattgaggtatgtcttcagtcttcatttcacacatggagctaatgttgaatgtgtaccttaatgcaagaagaacaattaattcaaagactaggtatgtttaaagtgctagtctaatattttaacttgctgttataaagaaaccctcaattattttcattactcaaatgccataattaaaggaaacattcccttacagaagcttgtggaaggggcataaatgaacatcaaaaatgtatattagtttagattataatgctcagttattacattttattttctgtgaacttaattgcaatgtctgtaaactgattagtaataataacttaatgtttaatgttttagaataagacagtcacctataaattattcaaccatataatgaaatatagaagaaaattatatgtaatgataattttgctttaatacatgttaagtccagtaaataacaggagggaagtatgtttctgaggagatggcagcatttggcaataaaaataggtgtcacttaaggtgaacttactttatataaggagtttcacatgttcttatctgtgcaaccttatgatgtggtattatgacctctactctatgaaaaagagactgtggctgggctctcatagtgagagtgacagcccagattgaaacttgtttaattaatttcatcaagttttaaatctcaggttactttttccatcaaccatgtactttttagtacatttagaacaccataattgctcaaatatacaggaaaacatgaacaataattactgaacaaattataaatgtagaggtattaatcaccttggttaattgggatgtatgccaactagtatagctgtatgcttattatttataccaacaatttccttctgaaaagggttccaaggagtaatctaagaaagcaaatacttctaacagtgtttttaaaactatgtgctataaactgttagggcatcatgaaattaatttagtgggacataatcaatgttttaataataaacagattacattcgactagaatggaaaatacaggagtgcattcatgtaagggaaaatgttttatatgtgtgaaactgtggtgtgtgtgtgtgtgtctgtgtgtttgaactaggtcacaaggtaaaatataatccttattgtggctcatgatgaataattcttgtaaacaaatttctgtaagacatcttaaaaaagttaacctaacagatcaaaattaagtgtctacatttattaataaaaaatagcaaagaactgaaagtaattatgtcctcctaagaaaataatttgcatttgttggagaaaaaggagaaataaatttgagtagattagataatataaacaagtagaaatgtgacaacctctgaaacttcaggtaattctgtaataataatgatttaaagttagcaaagcaaacatcttattgaacatgagataataccacatgttgatgacaattacatgtaattgcgaagacaaaacaatatctccatctcaatgcaagattaattaaatgtgtttattccatactttataatgaatttgcttcatgtctatcttggaaaaagatatttataccttactgtgagataagtctttgtacctacacatatctcataaagtacacacctctgacctttgctaactatgtgatctttgacaagttatttataggcttgcttaaatgcagacaataaaagtatctccctcatgagagacttacaaggattaaataattcataaaaagtgctagaaaaaaactactgagaatagtgtacggcatgctgctaagtgttcaacaaatgtcagttttccaagcacttcatgtttttttttttcctcaacaaccaataatttgcacagagaaataaaccaataaatatttgttgcattgaattgaactgatgacacaggttgggtggataacatgatttccttcatgcaactgaggggtttgatttagaaatttacccaagtttatagagataatttggggcagagtaggtttctgatctagttcttctgatttataaatcagggctcttctatgagacaaatctaatagtcccttggttgagttttaaaccaactctgctgatcttagaattaggtttcaagaacttgataagtgatcacaaaaattcccgggaggcaatatatactttaataacaatgaattaataatgtatttcaaggtcttattagctttactaacaactgtgtttgcattatcttgcttatttcttatgatactataaaatacatgtctttatcattcacatttcatagataaagaaacaacatcagagaggttaaataacttaaagttatctgaaaattatacatcagtatatgaaacacaatctgaaccaatttcatgagctcgaccaccaaactttaaaatctagcccaaagaagttatcacataatttgaagatttgagagaaatgatgatttttcctatttaggtcctctctattgctataaaatcacatcttacaaacagaagcaggatagcaagagcaggaaagaaaaaacagcaaaattttcagctgcatttacattcattgtgttataattttgcttgaggtatagtggcacatacatatttagatgtgttactcatattagaatcaaatagaaaggcaattcaactttttgaaatatccataatataaattctttattagtgcagagcacattaaaccaactatttcaaataaatagctatgtgatatatagcaatagagaaacattgaaattaaagtcagctatgtataaaaacaggattgacctgaatgatgtgtcaaacagaaaagacacaaaaacagccactattcatgattccttttaaaaaggatacacttacaaccttcaaaaatgtatctcagaaagcattcatttgtaattttaaccttttggtttatatgttagtagcttggagtagaattgtattatttttattttttcccaaatttctcatataaatctggtttataaactgttaagtagggaatattgcgccaaaatcctacttgagttataaattttccatactgcatgttccgtattatttctttgcctttgtctttatgattatgactttttttttaaatcacagatggtgttctcttaccttatttgtattcactgctgtgatgacccagacacattgtgcattgctgtcatactggaacggaaagttgggagatgtaaaggtaccacttggtccttgaagattagagccacacgttttcactaaaagagaaattgcattttaaaagatgaacatatgtcacatgtaaaattacaacaataaaatatcttgcaaatagactttacattcaaaatgacacaattataaccacattgaaatatatattatggtattctaatgtcacttatcaaaatacagtgtttttaacaccctgggattcacaagctcgatattttcaacattaatggaaaacactagttatgaatagaaatttgagggcatgataaatgcttctctgactttaaataggtgtgtttaattagagaaaggtatatgtacccaatattgtgttaacaaaaatatacaaagagagtgaaacagagccttgggttaatgaagcaatctaagaagtgttttcatttgtgtttattaagtaccctaggactcacaatagtgcagttgagaaccatcaatagaaaaacttctctttctgtacttataactatgaattaaagaactcagactaaaaaaaaaagcagttacatttaagtaattgtaatgaattcccacaaaagttgaaagttgtagcattttctcagttttctaacccatctttcttctacttaataaatgagctagtgaccatactgtttctgtttcttgcttcttgatgaccacaaatttctggatgccactgcttttgatttggatatctttgccccgttctatcaaatcctgcccatattatcattttctaatctgtcaaaaataatctattgtatatttaaatgatgaacagttaaatgtatattttcatatgcacttaaatctgtacatagttatcatcatcaccactttgaaaatcagttgatggacctcctaaaagtttgcttgacatggtcaaagtcatgcttctagtatacagtagtcagaatttcagcccaggtcttctgattcaagtcttgttttttacatcactaaaagtgtgtctttcttgtatgttacatgtagatttctttattagtttcttctcttaatagcataaatctatttcagacaactttcctgcaacttgatggttatatcttgtgttgatttaatagttacagtacttttaattatcttgtgagtgtgtgtgtataatttctgtattttaaccaataaaatcatattattttgtatagaaaaaataataaattgtatttttcttcccttaccattatttgcaattcaatcttttttccccatttactacttaacttcttgtaaatactctatgctcactactccatttttctctcccctttcactcttcaaaatatttcagtctgattctcattctcatttcagtgtttaaattgctttttcaaagccagcaatgaactcataattgctaaatgtagtatctcttcatttttccacatatttgatatctcagcagtaatgcaaaatattgataatattgattagctttgtttgaaattctctgccttcccttacatagtattaagctctcctgattattcgcatgtgttttaaatagttctgctctaccatattatttgttcttgttttatttttcccatctgacccttaagtagcataattctaaattgacttaaccttctcttttctatttgttcaatggtttctctgaatagttaaactaattcatttctatgactggaaaggacatttctgtgttgatagctctcaaatctacatcaccagctttggcatctctcctgatttctagactaattttctgtccgctggacattccattagatgctttgaggaagcactttcaattaaatatttcttgaatagactatccagatcctcgccttgcataatatatactcctcgaggtctattctgttttcctctgtggaaacatctctgttttgcttcatttcttctcttcccagtgtccagtgcttcttcctcatttttcttgtactgataatagctactgaaccccttttctagactccaacttctctattacatcctcctcactgctactatatttatctttctaaaacacagatttaattacattacctaactgcatgaaagcttggtatctatttccgatggaataaagtacaaattcctaatagggagtataaaattattcctgtgaggacctaaatttattttctagtacaatgacctgccattttacatagtcatacactttacttgtgccagaacagacatcttgctcttctttgatttaccatactctttataattttctatatttttcatgctgttttctaggtctagaatattattccttcttacatttacttgcagatattctatttacttaaacaaagccaaggtgatgtgccacttctttccataagaagggtttctaattcttccactaaggattctgtaatggattatacatttcatagcacattatttgaacagcacatttatacaagtgtttaggtgctagtggcctgataaggaatgtagcgtgaaagagtctaagacctttatagaaatgagaaatttatagcaatcacaaagcaattggtttgtagtggctatagctttctgattgaatatactccttctctgagtggtacttaatacttcgtaattctctggcatcctttgttttctaaactatatacacacttagaatcttttgaagtcaaggccttgtttatcatctttgttaactcatagtacaatggctttcatgatgtaggtacgtttgctaaagaaacaaatatccaagttctttcgcacagctcttaaattaactataaaatagtgctctcttcatgctgatgaagaatcttcataaatatgtttcacagtgaaaaactgtcttctatgaaaatgattttctttttctataagaataaggcaaaaacatttataaaacggcaagtaacaatcacctgtaaatattttggtctgtttatctgcttccatccaaacctgacagtaaccacttaacaagttgtatatctacagacatttttgttttgtggcactatgagtttttgcatatttcttgttttcttaatgtatttgtgtgttttaacaaacatagctaattctataatattagtctgaagatttttttgcatatatcatgacgactgttctaggtcagtacatataggtttttttcttttgcagatttagcagtatgaacagaagctgatagaactactggacgtttttgacaggcttccactatgagaatagcacaggatgattaggaggtttccttaatcctgcagtgggaaataagaagacatgtagaacagacctgctatttgaacagagttgcagcagttcacacatagcaacacaaatacagtgaagatcttggtacatttatgtattatgttttatagttgaaaaaataaaaacaaattcattattatggaaagccaaactgcaaaatctcagtggcttacaacaatgagtaattttctcttcaattccattgtatttgtgctttatacttgtgttattattgtaggattaattcttagaagaaatattaattagttacaatatgtgagcatttaaaactttgataaatatacctaaattactctccaaaagtttgttcagtatactcccaaaaataatattaaaaagagaacagttccccaggctgtcgccaaaataatagtatcaatcattatgcttttgtcattctgtcaggaatgtcactgttttaatttccaattctttctctacatttttagtatgctttaacagaagtatttattgttgtctctattttttgctctgacttttctctttgtacacttttcctcatttcaattttttcttgctgatctatagaaacttcctgggtgttactaatattaacccttttatatgtgctacaaatactttcttacagacttttgttgttttcgattttgctttgaattaacttttctctgtaaacataaaaatatgtgtaaatctgtcagtgtcttcttttagatcttgtattttatatctcactcaagaaagattttcttcaaatctaagattgaaatacaacctttatttctcattctttaatagttttattatattataattaaacttcttctacaaattggtttcatatggggcaaggtaaaggagcatttatagtaaattctatattattcgtcatgaactgaaaataccatttatattatatttatatagaccgtacataaatgtataagaaacccatatatgtatctgagcctttttcttaatattgacctactgatctatgattattcttttgccagtaccatactgttttaatcattttttacatagatgacacacatctctccattcttattcaatttcataatttctttattatccattattatttatatttccacaaactttagttgtgtccatttgtcaaagtaaaggagattggtgtctgtattcaattttattgagttcaaacattattttgatacaaatttgcctcttcaatggagcctttagtaacacaaaggaaataaataaacgtgattacagtaaagtagtacatttgagaaattcagctgaaatttcctagtatataagaattccatgcctacagtctcagaaaaatagaaatagtagaaaaagaaaaaaaaccttgtaaataaaccaatgaatgtatgaaatcaaagcaagtattgggttataaattaaatatgacaactttggtcattaaagattagaacaaaatgtggatccccacactagtgataccattcaatattgtcttagaggttccaggcagggcaaaaaaataaaaaaaatttgaagagttacataatttgaataagaaacacatgtcattatttacatgcaatataatttttgtcttacattcaagagatataataatttatctaacacaatatgctgtattattttcaagattcctatattttggttttaaaatatataactcatataaaaatgtataggtttctttcttttttttgtttttgttttgttgttgttgttgttgttgttttagacggagtctcactctgttacccaggctggagtgcagtggcatgatctcggctcattgcaacctccacctcccaggttcaagcgattctcctgcctcagtcttccaagtatctggaattacaggtgcccgccaccatgcccggttcatttttttgtacttttagtagagatgaggtttcaccatgttggccaggctggtcttgaactcctgacctcaagtgatcagcccgcctcagcctccggaaatgctgggattacaggcgtgagccaccgtgcccggctgtataggtttcttttataacaaaaatagttagcaattcaaatggaaaggtccaatttatacaagcagcaggaattatatataattttaaaaaatatatttagcaaaagacatataagacagaagtcttataaaggtaactactaaaaaaacaatgaaggggcattaaataaaacttgtagaaacggaaagatagggcatgttctgaatgggacagcttattatcataaaaatgctaacatcctgatttgagcagtttataatgaactaataggttagctaatatttatgcgtttcctatatttatgattatcttaacttttagtgctttagacagagttgatattttataaaatattttgcttatttcattcacatgccacctgtgtttttataaaggaagattaaaagggctaccctatacattttacagtcctgtttgtggaataaaatgaaccaatacctgcagagaccttgcaaaatactgctaacatcgatagaagtacagaagcagaagccaaaagatttattcctagcttgtctaccaatgtattcctattttttcctcaggtaaaacacatacagttaaccatgctttggaaaatgcctaggaataatgttaagtacagtgaaatatgtttagctttaactgtaaccttcaggcatttagatttgtgccagatacaatgtttcaactacacaagtaagacaggctgacattttattttttggctgagtaaggacatgattcacaggttaaggattcttttttgcacagaatatatcaactgagatctgtctattgttgtctctcggtccactgtgccctgaagtacctttttcactctctcctggaattttccttcttgaatttttccatcatgatttttaaaataaattgaaggacttttgtaatcttactccaacagattcttagaatttgtaaattctgtaaagctctttccactaacttacttgtaattccttaaacacagtgaaaatgttcacactttaagaccctagcactttctatttttctcacctggcataagtttctactcaaacagtattccatacaaggcctattctgcttaatatctctaaactttagtttcttaagtattacctttacataccccacacacacacacacacacacacacacacacacacacacacagaccattgtttattgtctgttttcctcattagaatgtcacattgatgaaagcaagaacttggttttgtttatcatggaatctccagcacataaaattgtgcctgccacatggaagacactcaatgaatgaatgagtgagcaaatgattaaaatacttagagtcacaacaaagatttggttttgtttatcatttatgtcttccaatttttttcccctttgggctttggtagcaattcaagcttctaccttttggtgaatgtagaatgtggtaattaatccacaaaggattcattaacattgtgtgaacaagcacgtcctactgcctgctgttctaaggctatgtattagggttgttgaaagatttctggtaaggaacattttgttgatggtatgaggagtatgatagcatatgtcattaaaggagttattagtatgaagtttgtggttcatttttcatctttaggatgaagtttgtagttcttgtatcttcaaatcttcaactatccctgcatcttcatatttccacttgagcaaattcaaatcacctagatctcagctttttttaacttgtaaacttagatagttgtgctatgtcacccataagctctgataagcctaatatgataatatgattacatcatgcagctatctatgtgctctgaatggctttcccaagagatgcaatgaagttgatagagcctgaaagttatattcttgcccattgaggcctttactatatcagagtaatgttattattattatttaaactgtttgctgacatatgtgacatggaaaataatgaatccgctagaagaatcaagtttgattcaaatgtatttgcggcatttccctttctgtggttgttcacctgagagttagttaagtgttgtagtcttgcccctagtagaagtaattacatttctatctatctttacagtggcttctttgtttattagccaggcataaggatgaataatcatagtgtcagagactaacttgatattctctgaaagtaacttggtattgacaacagcataaactataattcttctgctgcacatgatgtgatagacaaaacaggccatattattttttacttaatagtttctatcgcttctagaaattctaacttgtacttgggaaaattagatattctaataagatgtaactatgtaacaatgagtgagtatgtacagctcaaatcttgtgaagtgcaagtcaggatagcccagacgaagagagatgtaccaacaaaggacttacttatttaaatgtttctcattgggctgtgttaggcaagacaataaatattcttaggggcaaatatgaaatcactggaaatggataaatgttggtacctaaagatggacaactttcagcagacaatgagattcggatgttgagagaaatggtgtgactatatctcagcaagaaaagggaactatccctgacttcacagaagtaggccaaggcaagtgctacccacatgtttcaggtacctttctaatctttctttgctcaaccatcatcattggtatttgaattttattcttaccatccattctttgaaacaaggctgatagtttgagtttctgtcatggcatatcattcccctcaaatagccaaaacaatcttgagaaagaacagagttgggggcatcacactccctgatttcaaacttcgttcatgcgttgcttaatgatggaggtacattctgagaaacgtgttgtgaggcaattttgtcattattaaacatcatagagtgtgcttactacacaaatctagattgtgtagcctactacaaatctagattgtgtagcctactacactatggtatagcctattgcttctaatctatataccttttcagcatgttactctactggatacactgtatacaataaaatgcagacaattagaacacaatgatacttgtgtatctaaacatatctaaacaaagaaaaggtaaaaatatcatacaaaaaaattaaaaatggtacacctgtataggggcacttaccatgaatagagtttgcaggattggaagttgctcaaggtaagtcagagagtgaggagtgaatgtgaaggcccaaggtgttaccatacactaatgcagacttcatagatataactataaattgttttttaaaaattgttacttaaatagtgaattaaccttagcttactgtaacttttttactttataaactccacaattttttaaacttttgacacttataacaacacttagcttaaaatgcaaacacattgcacagccatacatcattattttatttcttcatatgcttattctatatgcttttttctatttttacttttattttttactctttataatttatttaaaactaagacacaaacacacacattagcctaggtctacacagggtcaggatcatcagtagcactgtcttttttctccacatcttgtcccacggacagatcctcaggggtaataatacacatggagctgtcattttctagatgacagtgccttctcctagaatacctcttgaaagacctgtctaaggctgttttactgctaaaagagtacactttctttttaagcagaaagagtacactccaaaatgatgataaaaagtatggtgtagtaaatacttaaaccactaacatagttgtttattatcataataaaatattgtgtagtgtacataattgtatgtgccatacttttatatgagtggtgcagcagttggtttgtttacaccagtatcaccaaaaacacatgagtaacatgttgtattaagatgtgacaatggctacaatgtcactaggtgatataaatttttcggcttcattataattttatgggaccaagattgtatatgttacacatgactgtatatgcaaagctacagtaatcataacagtatggtactggcataaaaacagacagatagataatgaaacagaacagaaagtccagcagtaaacccataaatatatagtcaactaacctgtgacagggtcaccaaaaatacaaaatgggggaaagaatagtctcttcaacaagtggtgttgagaaaattgaatatccacttgcaaaataatgaaattgggcccttgtcttataccttatacaaaaattagcttgaaatggattaaagacttaaatgtaggatatgaatccatacaggtcctagaagaaaacaggaaaaaaatctccttgacattcatcttggcaatgatttttttgaatatgacaacaaaagcataggcaacaaaaggaaaaataaacaagtgagtctattatcatgatattgataggaggagagagtggggattttggtggattcattttaattatttattttctctcatggaggaaaaaatctggctcctgggactgagtgaacaccagaagaggaaaatgacagagcagtgacagtgtgcttagctattaaattttaaaatgtgaatttattttgtattccaacctactggcataagcacattatctgtgtttataagaaaaattctgttggttgaatgagaggattagacatattataattgtataaacttcaataagcatctagcactgaaaactctatatctatgtcataaactgagagtaagcagttatatcacaggaatctatgaccccaaaataaaattaatgtttttattatttattgatcaaatattatttctgggtatgaaaacaaatacaatctcatagttaaaactttgtttgcagtgtggtgtttcctcaaggatctagaatgaaataccatttgacccagccatcccattactgggtatatacccaaaggattataaatcatcctactataaagacacttgcacaggtgtgtttactgcagcactatttgcaatagcaaagacttggaaccaacccaaatgcccatcaatgatagactggataaagaaaatgttgcaaatatataccatggaatactatgcagccataaaaaggaatgaattcttgtcctttgcagggacatggatgaagctggaagccataattctcagcaaactaacacagaaacagaaaatcaaacaccacatgttctcactcataagtggaagttgaacaatgagaacacatggacacagggaagggaacattgcacacccgggcctgttggggtgggggacaaggggagggagagcattaggacaaatacataatgtatgcagggcttaaaatctggatgacaggttgataggtgcagcaaaccaccatggcacatgtataactatgtaacaaacctgcacgttctgcatatgtatcccagaacttaaaaattttaaaaatttgtttagaaaaatattaaatcaattatttgccttttcaattatttatttataaacctttattttaggttcagggtacatgcggcaaacatttacatgggtaaacttgtgtcatggaggccaacaatcacatgaaaaaaaaaactcaacatcagtaatcattagagaattgcaaatcaaaaccacaatgagacaccatctcacgtcagtcagaatggctattttttttttttttgagacggggtctctctttgttgcccaggctggagtgcagtggctcgatctcggctcactgcaagctccacctcccgggttcacgccattttcctgcctcagcctcccgagtagctgggactacaggtgcctgccaccacatccggctaattttttgcatttttttttttttagtagagacggggtttcacagtgttagccaggatggtctcgatcttctgaccttgtgatccacccacctcggcctcccaaagtgctgggattacaggcgtgagccactgcgcccggcccagaatggctatttttaaaaagtaaaaataatgagataaaaaatttcaccaaacaaaatgactattagataatatgtttttaattcatttgtgaaggctgagtgctggatagtttttattctgaaaaatcacgaatcacacaaatattaaattaatccatattctgtttgaaacactatgctgggtggaggtggaaagattaataagacaatcaaagtcgttgccctagagagattatattctagaaaaaaaaagaaatactaaactagcagataaatctggttttacaagatgcaatgggagtaagtaatagattacaaaaggctattcttaggaactgatggagaaaaggaattgttttacttacatattttatttccatctccccccaccactccccagtaatttcggagtttttctcctgcagctcatgtagaaatgaagaacaaactcattttagccaaatcaaggtacaaggtgtccatttccatggtaacatttgataggatctcatcttttaaaatgaatacgtgattattaccattaaacatggttgagttgaaatgctttagggatgtgctaaggaaaagcatccccaagttggcagatgtatactctttgaatgtaaaacaatgtgctgatgaaatactgactgtgagaaaatgaaatggctcaggatagtaaataatttttcagaaattatagaagatacaaagcctatattaacttgaacagaaaataagtatttccaaagttttaaaaaatgttttccaaatacttctaataaattagtaacctaggaagaaagaaaatacccaacaattgaaaagcatttgaggcttaatcttcaatgaagatcataaaagatatgctgtaaaaaacggttaaaacttggaagaaatatattataaaaaagggaaatggaaaaataggaaaagtgagaagaccagcactggaagttagagcgctgttgttttcatggacgtgcatagcaattgtagagaaaaagtgaatttaaaaagaaaggaaagaaagtgcaaacaacctcataacagattatttcacacacacagaaaaaaaactccattaaataagagacagagttttgtgttgagtgtcaagattttagtctttctacacaatatttggtgtatactttcaatgattatgttcaaacataccttctcttcctttttgggaggaaaactcttaatagtgtatgggaaggaaagttatacccaaagttatgtttactacattatggtgaaatgaaatcctacactgtagtttcctccataacaatttaaccacaaaaataaggatttaagtaacgtatataaatgtgcaacatttttcatgtgtcagaattcattttattcttattttcctttaattttaaaatatagtgtatgatataatccactggaaaaatactgaattattgatctatcaaagacctgttattaaactatagataataggagtaggcactgttctctgaatcaattagaattctcagattcttgacagttggtcatgaaatatacaaacacaagtatctgaaggtgaatgataaaacctatttaaatcagcatctggaactatcaataagtagttcagttcaataacatttaactgaacatcccagtctctacatcttcatgagaaactaataaactgtcaaaagtgcagttacaattaggactaatcttcaaatacatctgagtgtcatctgcataagaatgggagtctaatccatgtctgcactaaaagaaagcatataaatgtagactaataatgaaatgcacccgaagtagggaactcgaaaacagaaaaaagatgctgtcgaaaggaaaagaattaaaatcagcaagaagcagactgcacagaatcagataaatttgataaaaatgcagcaaatgcaattcctatgaaagacgagaaatataatgtacagatttttcaaggtaaaaaaaagtaagcaaattcatttttttctagttctttgttgtttaaaatttatcttagccacgaaagtcatgtttatctacagcgctgcctccctttgctccttgtttctctgaatcatcccattagtattaaggatgaaaagatacatggtattaagtcaccaataaaaataagtcatgtgaattacttatttattatgcttttcataaaaataaaaacaaatccaacctagcctatttttcccagtaagaaaataagacatattaagaggtgagatagaatgatataaattattatgcacaatttatatagaaagcctagcattctcaaggtcatccaggagggaaggagtgtggaagagagatgagaagtaagaacagaaagaattaagaagatgatctgactaagaagatgatgtgtagtgaagaagccagacaaaaacctcagacaacaaattctacaaaagattcagtttcaagttatttaccacctttgatgtggactgccctcatcctttcccaaattatccaggaaattaactgagccagttctgatctgcaaatttacaaactgtttttttgtttgtttagatgaagttggaacaatgtctacttgaatttatgttgaatggacataatccaaaaaaatcataaagcaggaatttgcagctagaactaaccattaaacattaagtctccacctaatggcacaagaaattaactgaaattttggaagattttagacctccccaaaatttaaaattggatgttagattaactgatctacacctgaaaaggcaggaaaccctggttaataatttgtaatttcataatgcacttccaaaagttacttccatagcttttcacatgttatttccttcatcagaaatattgtcttttatttcttaatcttttagctaaaatccattcttccaaatccttacttctattagtgcacatatattatattttaattatctgcttacctctgagctcctttatgtcagcaactacattttgcatcttctaatgacaagaagtcagcttaaggtataatatctaccaaatgctcaacaaatgtttttaaatttttaataaataattaagtaaaattaaatataccatttcttctagattttctagtttatttgtgtagaggattttatagtattctctgatggtagtttgtatttctgtgggatcagtggtgataccccctttatcattttttattctgtctatttgattcttctctcttttcttctttattattctggctagcagactattttgttaatcttttcataaaaccagctcctggattcactgattttttttgaagggtttttcatatctctatctccttcagttctgctgtgatcttagttatttcttgtcgtctgctagtttgaatttgtttgctcttgcttctctagttcttttaattgtgatgttagggtgtcgattttagatctttcctgctttgtcctgtgggcatttagtgctataaatttccctttaaacattgctttagctgtgtctcagagattctggtatgttgtgtctttgttttcattggtttcaaagaacttatttatttctgccttaattttgttatttacccagtagtcatttaggagcaggttgttcagtttccatgtagttgtgcagttttgagtgagtttcttaatcccgacttctaatttgattgcactgtggtatgagagactgtttgttatgatttccgttcttttacatttgatgaggagtgttttacttccaattatgtggtcaattttaaaataagtgtgatgtgctgagaagaatgtattttctgtttatttggggtggagaattctgtagatgtctattaggtccgcttggttcagagctgagttcaagtcctgagtatccttgttaattttctgtctcattaatctaatattggcagtggagtgttaaagtcttccactattattgtgtgggcgtctaagtttttgtagggtctctaagaacttgttttatgaatctgagttctcctgtattgggtgcatatatatttaggatagtcagctcttcctgttacattgatccctttaccattatgtaatgtccttctttgtcttttttgatctttgttggtttaaagtctgttttatcagaggctaggattgcaacccctgcttttttatttatttattcatttttgctttttatttgcttggtaaatattcctccatccctttatgttgagcctatgtatatctttgcacttgagatgagtctcctgaatacagcacaccaatgggtcttgactctttatccaatctgccagtctgtgtcttttaattggggcactcagccagtttacatttaaggttaatattgttatgtgttaatttgaacctgccattatgatgctagctggttattttgttcattagttgatgcagtttcttcatagtgtcgatggacttcacagtttggtatgtttttgcagtggctggtactggtttttcctttccacatttagtccttccttcaggagctcttgtaaatcaggcctcatggtgacaaaatctctcagaatttccttgtctataaatgattttatttctccttcacttatgatgcttagtttggctggatatgaaattctaggttgaaaattcttttctttaagaatgtcaaatattggcccccactttcttctggcttgtagggtttctgcagagagttccaccgttagtctaatgggcttccctttgtgggtaacccaacctttcttgctgcctacacttaacattttttctttcatttcaatcttggtgaatctgacgattatatttcttggggttgctcttctcgaggagtatctttgtggtggtctttgtatttcctgtatttgaatgttgtcctgtcttgctaggttggggaagtcctcctggataataccctgaagagtgttttccaacttggttccattctccctgtcactttcatgtacagcaatcaaacataggtgtggtcctttcacatagtcccatatttattggaggctttgttcattccttttcattctttttttctctaatcttgtcttcatgctttatttcattaagttgatcttcaatctctgatatcctttcttccaatggatcaatttggctgatacttgtgtatgcttcatgaatttctcatgctgtgtttttcagcttcatcaggtcatttatgtttttctctaaactggttattctagttagcaattcctccagccttttttcaaggttcttagcttccctgtattgggttagaatatgctcctttagcttggaggagtttgttattgcccaccttctgaagcctatttctgtcaatttgtcaaactcattctctatccagttttgttcccttgctggagaacaatgatcctttggaaaataagaggcattctggtttttaaattttcaacctttttgcattggtttttccttatctttgtggatttatctaccaacggtctttgatgtcggtgaccttctgatgggttcctgggcacatacaccctcttaaaataaaccaagaagaagttgaatccctgaatagaccaataacaagttctgaaactgaggtagtaattaatagtataccaaccataaaaagaccaggaccagacagattcatagccaaactctatcagaggtacaaagaggaactggtaccattctttctaaaactattccaaacaagagaaaaagagagactcctccctaactcattttatgaggccagcatcatcctgataccaaaacctggcagagacacaacaaaaaaaaagaacatttcaggccaatatccctgatgaagatcgatgtgaaaattctcaataaaatactggcaaaccaaatccagcagcgttatcaaaaagcttatccaccatgatcaagtcgtctttatccttgggatgcaaggctggttcaatatatgcaaatcaataaccataatccatcacataaagagaactaatgacaaaaaccacatgattatctcaatagatgcataaaaggccttcgataaaattcaacagcgcttcatgctaaaaactctcaataaactaggtatgctggaagcattccctttgaaaaccagcacaagacaaggatgccctctctcactactcgtattcaacatagtattggaagttctggccagggaaatcaggcaagagaaacaaataaagagtattcaaatgggaagggagaaagtcaaattgtctctgtttgcagatgacatgattgtatatttacaaaaccccattgtctcagcccaaaaactctttaagctgataagcaacttcagaaaaatctcaggatacaaaatcaatatggaaaaatcacaattgttcctatataccaacaatagacaaacagagagccaaatcataagtgaactcccattcacaattgctacaaagaaaataaaatacctagggatacaacttacaagggatgtgaaggatctcttcaaggagaactacaaaccactgctcaaggaaataagagaagacataaacaaatggaaaaacattccatgctcatggataggaagaatcaatatcgtgaaaatggcaatactgcccaaagtaatttatagattcaatgctgtccccatcaagctaccattgactttcttcacagaattaaaaaaaactactttaaatttctttttttttttaatttgagaaagtttcactcttgttgcccaagctggagtgcaatggtgtgatatcggctcactgcaacctctgccactcaggttcaagtgattctctagactcagacttcttgagtagctggaataacaggtgtgtgccaccacacctggctaattttttgtatttttagtagaaaaggggtttcaccatgttagccaagctggtctcgaactcctgacctcaggtgatctgctcgcctcagcctcccaaagtgctgggattacaggcatgagccaccatgtctgaccttaaatttcatatggaaccaaaaaagagtccatatagccaagacaatcctcagcaaaaagaacaaagctggaggcaccacactacctgacttcaaactataactacaaggtgacagtaaccaaaacagcatggtactggtaccaaaacagatatattgaccaatggaacagaacagagtcctcagaaataacaccacacatctacaaccatctgatctctgacaaaccagacaaaaataagcaatagggaaaggattccttatttaataaatggtgttggggaaactggctagccatatgcagaaaagagaaactggacccattccttacaccttatacaaaaattaactcaaggtgggttatagacttaaacctaaaacctaaaaccataaaaaccctagatgaaaacctaggcaatactatttaggacataggtatggacaaatacttcatgagtaaacaccaaaagcaatttcaacaaaagccaaaactgacaaatgggatctaattaaactaaagagcttctgcacagcaaaagaaactatcatcagagtgaacaggcaacctatagaatgggagaaaatttttgcaatgtatccatctgacaaagggctaatatacagaatctacaaggaacttaaacaaatttacaagaaaaaacaaacaacctcatcaaaaattgggtgaaggatatgaacagacacttctcaaaagaagacatgtatgcagccaacaaacatattgaaaaaagctcatcatcacttgtcattaggaaaatgcaaatcaaaaccacaatgatataccatctcatgtcagttagaatggcaatcataaaaagtcaggaaacaacagatgctggagaggatgtggagaaataggaacacttttacactgttggtgggagtgtaaattagttcaaccattgtggaagacagtgtggtgattcctcaaggatctagaaccagaaataccatttgatccagcaatctcattactgggtatatacccaagggattataaatcattctactataaagacatgtgcacatgtatgtttattgcagcactgtttacaacagcaaagacttggaaccaatccaaatgtccatcaatgatagactagataaagaaaatgtggcacatatacaccatggaatactatgcagccagaaaaagaatgagttcatgtcctttgctgggtgttgcaggaagtcagggatcccgaatggagggacctgctgaaggcatggcagaagaacagaaattgtgaagatttcatggacatttattagttccccaaattaatactcttataatttcctatgcctgtctttaatctcttaatcccgttatcttcgtaagctgaggatgtatgtcacctcaggaccctgtgatgattgcgttaactgcacaaattgttcataaagcatgtgtttgaacaatatgaaatctgggcaccttgaaagaagaacaggataacagtgatgttcagggaacaggggagataacgattaggtctgactgcctgggatctgggcaggacagagacatatttcccttattgcccaaaatgggtaagagaaatgtcgctgaattctttccccagtaaggaatattaataattaacagccctgggaaaagaatacattcccaggaggaagcctctaaaatggccgctctaggagtatctgccttatgcagttgcagataagagatgaaacatgccctagtctcctgcagtgcccccaggcttgctaggattaggaaattccagcctagtaaatcctagtcagatgggttctctgcccttgaaccgtgtttcctgctaagatgtttatcaatgactatgtgtgcccagtgggacatggaccctcattagcaattctggtttcacccagaacttgtgatatcactctgaccttctgctttgtgatattttattgcctttgaagcatgtgatctctgtgacccacaccctattagtacactccctcttttttgaactccataataaaaacttgctggttttgtggcctggggggcatcacggaacctgccgacatgtgatgcctcccccagacacccagctttaaaatttctcgcttttatactctttctctttatttctcagaccagctgacacttagggaaaatagaaaagaatctacattgaagtatcaggtgctggttcccctgagagctgggacatcaatgaagctggaaaccatcactctcagcaaactaacacaggaacagaaaaccaaacaccatacgttctcacttataagtgagagttgaacaatgagaatacatggatacaggaaggggaacatcacacacctgggcctgttggggggtggagggttaggggaggcataacattaggagaaatatctaatgttgatggcagtttgatggttgcagcaaaccaccaaggcatgtgtattcctatgtaacaaacctgcacattctgcacacgtatcccagaacttaaagtataataaaaaaattaaatataccaaaatataattttaaaaaggcttaagttaacaatttaatgcttaaattaaatgcaataaaaaggcaacttatcagaaaagtacctcagagtaatttggttatcacttgtaattctagacaatctttctttctagaaaaaatcaaatgaatattgatgatctgttacaattatttttggagatagttattcaacactaaacattgacttagaatgtttcaatgcaaaaagaataaggtgggatcctacgcttaaggagcttgcagtcttaaatggatacaaacaggcccttgtaataatagcctataagtactaagataaaagtaatcaggagttatggaaccataaaagaatagacattttcgctaccctgattttagagaaggcatcctggtggtgatgtcagaactgaatctcgaaaagtcaggatgcataatcttagaatagaaattcaaaatggacttctaggcagggggaaagacacactaaacagcacattgaatacagaaaaactctggaattcccagaacatctaaggtcgttgggatttggggcaattcttttgatggtgctggggatgtaaataaatgcctattcaagggggtcatatatgataggctactacagttgttggatttttgtttttttgtcaagctaaggggggatactttgtggatatccaaaaggcacttgacttacctatgtctagctttaaggagatcgatccagctgccatatacagatggatttaagagagtaatatggtaagcctatatgcaagactacaggaagtccagtcttataacttttctcatatactataaaatccttaaaaatgtagctgttttcactttctacatatttatttgacaaatacaattgtatatatttattatgtacaacatggtttgaaatatccatttagtttaaatgcagagacatttattcatttatgtatatattcagtcactcattcaacctacactatgtattaaagaactatgatgcactcaactctatgagaataatcacacagttgtgaaccaggccctccttcatgcacctcacgttacagggagagagacaaacaggaaacaacccaaacaagttgattatataatcatgaaacaactgctacaaaataaaagtatggggtgtcctgagggtgtatatttggggacttacaacattttgaggagtcatattagaaagtactgttttttatttttaaacgaattaaaggctcattaatacaagataatggaaggcatggtaaagacaaagcatgttaaaaatctggactaaacagcattttttaaagacattaaattgcatttctttcaaatgtatctaacaaccaaagtgttaacattttcttacaatcctataaatatgtttctatgaattgttaagaattattgtgaacaggttgtagcccttggtatgaaaatgatgctgctaagcaatttttaaagtaacttgaaacaggttctttttaggtagatttactgttttctgcactccaatctttttattttactgaagggcttaacaaatccttggtgatatgaaggcagcataatagccaaccgtttcccaaaataatgaggtttcattagaaactttttcctgcttaacaacaagtagaatattcccctaaagtggcattcaagacctttacaaagggaaataaaggaaagagaaaaaggaacaaattcttcccgattaggagactactgctgggaattgggtcagtgaatcctaggatatgagaaacacttatttacaggagagtctatttctctatgcaaaataataatatttttaaaaaatattattgattaattccaggaacaaacataatattgtacagaatgtcaactgtcaaggtccctgatccctaattgagtttattttactcattcctttttctgggagactggtaggtagaatggtataattatatcaatctaagaaaaaattctgaaaatcaaaaagaaatcagaaatagggaagccttagcataaaactatcattcagagctatacagatgtgaaaggacaagaaaatctcaggaccccagagtctttatgtcaaaaggaaaaattaagcttggaaactgagtctcaagcaaaaatctgcctttccttttgttactaaccagcaacaagatacaagaccacatgtctccccaggtagcttccttcaccctgacaatgtaaattaacagcttctctttgcaggtaagagacaaagataagactagaaatcatcccttgcccacccttgagaaaaatgcagatttactgagcatgacaatgcataaatgactgtttccctacaagcttcctttgcacatggattctgtaaaagctcattaaagcctcataggaatgtgtccccttatttcactacctactctactttctttgctttcctcttttcccctccttcccactcttttccctttatttattgaagatctcaagatcccctttggaaagcgtgtgaaccacagatcctactgtggcttgtgtctcattttcttgggcacatcctcaatcttgacaaaataaacctctaaattaattgagacttgtctcagacactcttcggtttacattgaacaaatacatttgtcctaaattatgtagacactggatggcaaaagaaaatgaatccatcctttatctgccacactgaaacaagttgaatgacacttaagaaacttttgatgcccataaacaggttaaagacttttcataacaggaactccaagaaataatttctttagcctaataagttgacaggcaaattagctgaatcagatctctcaaaattctaaataagaaaaaatacacaaaagctcatatttaagattgagaagtgaaatataaatgtcaaaatcagatgctgcattctgaaaagcacacagtgggcccacctggtaaatgtgaagggagtggtgaataaaagggaggggttgtgtggccatctggcaagcagatgtccaggataaaggagcacacttttgcttaaaatgttcacacatatctgaaccccaggccaagttttgcccgatcttccaatttttcaaagagaaactgagaatttggatgtttacatgaaatcttcgattttcaaatattgacaaatgatttaaaatatatcaacctataatagccaaataaatatgagctacttctggaatataaatcgttggtttgtaatgtctgattcatatattctttttgatgtgaaattaaaataagtaggttattatttcaatggagtaagagagctagaaaacataattgcaaactgatacttgagggacatgatggcagtgaaccatttcagtgcttctaatttacaaataggtagtgtttttctaacaaatagtttaaaaaataaaaatcacttaccaacttattaattttattctcttcctcaataccactttttagaatttttttgtaataattttagagtcacagagaagtaaaaattgtacagagagttcccatattctcttaacccagttcccttgaatgttaacatctcttacaaaatcatggtacatttgtcaaaactaagaaattacccttagtatactgctgtaccagtctttattggattttcgtcagttttatacatgttttttaaataatgcccttttctcttccaggatattgtaattatttcatatgtctgtttagtctccttcaatgcaaattaatattttgccaattgtcactttttttgtatgtgagattagtataaaaaatcagtaccttaataaaaccaatgtggaacaaggttgagcacgagtttctgagctggcaatgtttggggccagacactaaacaggctgaagtctctaaggtaatagtatgccacagagcccttggttaaatctgtctgcatcaccagtaagtatctttgtagttaaaattctcacagattccttttcaagactgtagttaacatcttaaaagtatgccacagggtgttttaacctggacacagtaaaacagtgctttagaagtcaagaaacagaaactgcactgagctattcaagatgccaagttatctccttactctatcttttcaaacaatgtacagaccttattctcagagcaaaatacaattgcagtatgtgagagtatcactctcagttttacaagtagtcaactaacccattagtatcaacccatgtgagtgataaaaaatagtgaacttcctacttttgcttcttctatgactcttagcagactaaaaatactagatagccttgtttgtgtttatgcagatttctcaattatcagattcatgtagggtttttcggcctccacactactgacattttggattagataattgttttgttatagagggatgtcttgtgcattgcagaatgcttagcaacattcctgtcttctacccaccagatgccagtggcacatcctttcccccacaattgagggggagttgtgacaatcaaacttgttcccagacattgccaaatgtctcccagctgtcagaatccagcccctttcccattaagagccactaatttagggggacatctttttttttttccacctaatctctttaatttttgcttatctcctttgtttctttttacttggtactttaccaaaaagtttgggtaaaagagaaattatgggaatcaagtataaacttcagcttccattgcagtgggaactgatcatattaaagctataatagatgattgtttttacactcaagaaagaaataaaaatgttgttagcataaattaaataccttttttttccaggaccttcttatcatttatctaattcctacaagtatttgaggattttattagttatgcctctggaaagctgtccctgagagacccaatcccagtccactctaagggtccctcccctgtgttctcattttgtttatctctaaaagctatcttattatgtacaaatatcttacttctactgccttttcttccttggtatactgtgagcctcttgaggacaattaccacatcttattcctgactggtccttgatttatcctgtaagcaatcagtaagtgtttactgagtgattgacagtcataggaaatgtcctgattaagataccaaactgggagatctgagatgccaagtagcagaatgacagtactgactctgtggaggtgaaacagaggagccttctaagaaagattgagctgcaatagtcatagagttggctaaatatatgtacacaaatagccagtatatatatatatatacatatatatatttacgatgaactatatgctactatagttgatgaactaatgccaatcacaaaataaaatatcatgaaatatttaaggtaatgctgtaagacttgccactgaaaaagttgtcaagctcttgaaatatatgtaattcctccatactaaaactactcctgacttcatgttcttttgtggatatgagattcaaaccctctctgaggccagagtctaagctttaaaaaacactgtgtaataaaagtttgctgtataaccacaattaatgacaatgatgctgggtttttgcttgtttgtttgtttactgctttattctcaatagcttgtgtagtcttcatatctatttagttgtacaaattatgtcaagaaagagattggcattctcaatgttcctttatggtcatgtgattggaggaacaaatttcttacttgtaagcacatctaacaatgaagagttcactatctgttcatcatcctaggaagacagagtttcactatgtctgggctgtcgagttaccccaggaaataaaggtcagtgatgaatcttttctgctaagaggtcactactatatgactatcttaaggcactgaaatacatgttcctaaatatttttagagaaatcacctctttttacatttattaaatagtaaatattctatattacccaatccgaaagatgtgacttccatatattcaaaatatcaggattctgtggttttacttgtttgtttttttctgatgttgatttaggataaacattaagagtaattttaaataaatctttaatataaatatcatagaaatttatctctgaaactctgaaaccaaattgcttagtaaaaaaattgtttgacattgtgtctgtacatgtgtaactcatatgtattcatttaatgacatatcaaatataaatgttaagtcatttttcttttttgccttttgaaatgtttcttctgtctttttctttttttttctttttctgaaaagaaaatgagcaaatttttaaagtctaaagaaggctagatcagttgtttgctcaaaatatgttcctgttatcttgtgtcgtagaattctttactttcaagcaattcctatcctgagaaatgtgctgaagtgttcaatgctatagtgtgaattagctgtgctatccctacagatgatggcaaacacaaatattcatagtgagggtgtactacatactagatattatttttagagctttgcctattttatagtatttaataatttagagcaaaacaacaaaacatagcacctgtgagataaatatagttgtcctattatattcttggagaactggtgccagaactccccttggataccaaaatctgaggatgctcaagttccttataaaatgtggtagtatttacatacaaatggtgcacactcccctgtataccttaaatcatctctagaatacttatataatgactgatacaatgtaaatgctatataaataattgttatactctcttggtttttaaatatgtattatttttattattacatattttttttcctgaaaatttttgatccatggttggttgaacttgcggatttggagggctgactgtatggtttaagtggaccttgagtgcatggtccaaatcttggctctactttcaagttgaccaaaatgagtcactgaatctctctgtacctcagtctcctcactggtaaaatgaggtaaaatagcacttcataggtttgttgagatcaaattaatttatacagttaaagctcacctatcatatagtaagcactgtataagtgtttgttgttacaattatttgtttttttttttttttgaatagtataaaagaatgtaactgggattagagaagttaaataactcacccatgctcatttgaacccaggacagctacaaaacaaagtccaagctcttatcttgtatgctataaatattcattcaatttttaacaattctggtttacttttgaggtaatctaatagagtattaaagaaaaaatattacaattagtcattgcagctctttttatctgcaacacgaatatatattaatgtaagtactattatgtaactacttatatacatttgtagtatgtgatttttttcatgtttaaacagataaaactatttcttattaacatgtcatttttaccaatatttagacacctttcttaattccctggtcctttaagagcaaagttttacaaatatgtaatgcataagttttttcacattttctgtgtattattttatagtatggatagtgcataccactttaaagatcatgtagcctgaaagaataaatggttgattacttaaactatttgatactagtctttatgcaaaaaaaaaaaacttgaatgatccaagaacttaggattgtcgtaaatttttcacagcatttagactatcacccaaaagatggtactaataaaataacatttatttagtccataaatcaactcagttagtattctacttggtaattaaatcctattagtcagtgaaaaatgtttacataatgccttcctgggtgggaagctgtccaacattattacttcctgcaataaaccacagcaaattgtttcaggaaatatttcccctacgtacatatataaccatagaacagaaacaacaacaaaaataacaaatataaatcttgggagaaattgtctttgatgtctattcctgagaaacatatcagtgatttcaccattccctggagattagcacaaacaatgtccttgaggtttagggaaataatctgaattccctttgggattatggccatacacagaaacaagtggaaatgaaacagagatgtttgctatccttgtgtttcctgtaggtcattctctagggacataaatttctgaatgttcctcaagcacggataatcgaatcattggactccaagcaaaaggttaagtggagattgataggatctggctaacgtaggcttaaagccaatggagtgctaggaggccccacaaaattacctgtcttagactacgttactcagaaactatgcatgaatcaaagacttatgtgtgaaggattttgctggtaatatgatctcaaggagcagcaatggggaacaggtgaggcgttgaaacaagcccggaatgtaggaaagccaatacatgcatgtgccatccaatgtgctaccactctgagtaattttagtttgattctacagaaacctccaatgaaacttgtaaaattcctctcagaaaaacagaggaaactgcagaagaaagaaagatgcatttatttgttcgttcatatcgctttgtaggttaagaattgactcataaaatatgagcacttgtgtaatttctgttagcgcctgtgtaaaggccactcacgttcacagatttttctttcccaggtgtcagagagtccatagggcaggaagcaagatgcagaagtctacagaggcatgatgaggtgcacctgcatgaaacttaactggtcaccacagcgttgactggaataagagatgaggccaagaggacttatggagtgtacaagagactttggacacactgattccctcattcaaatgctaatattaagacaaccaattaacaaacattgattccactggatatttttagaaagttaaatcatttagaaaatggtttgttttaaaactgaaagcaaatctctggtttgcaatattgtattctctaatgggaaaaaggaaagttaagcatgccctgggtttctctccaaaactttccccttgctgcccctacgtttttcacatttccttctaattcttataattgaaatgccaggaaaatcccctgctctatttctgtcccaaataatagatttagagagcaatgagatatcatcattaccctgatgatattcagctgtgccattcattgcctctggactcagatggcactcagcctccatgatcctttcagcagccaagtctggaggagagatgagctggcattcttccatatcattaaagacagagagacctggctaatatgcttgagaaacatcaagggacttgaaaaaaggaagtttgggctttatcaaatgaggtgattcacacagaccagcctagcattagtttatttctagatctcaagctgcccaagtatttccaggcagcacctatggaaatgtgtgtcttttgtcttcttgcaattaacttgaaacttacaagctatattcaatgatttcatgtctgcttgggaaaacttcaaattgaattaagagcaggcaaatttgaacttgggcggcggttatgttggtcctgtgaaacagaaaagttgggattcttcaaaagaaaaaaatgtatttttaacatattacagatgtaaactcattatacactttttaaagtaactttaaactagaataaatcaaatgaactaaaatcttactgactctaccctcccttcctacctccagacttgtaagacaatatatttaaagacaggttgtcaggagagaaatcctgataattggccttgagtgttccccatgtaagattcctatcttctgacatgccctgacaaacagccagatcatcactgctgaggaaacagagaagaaagttgccttcagaatgtgtttttatgtgtaatatatgtgaaatgaatatagttttaagaaaacacagaaaaaaagcacttgttaattattaaatgcacaatttttacagtgtcacagtagtatactgtattcagttttggcactaatggtttattttcccattaaaattcaacatcagggagaaataaaacatcagtgacattcttcccatcaaaatgcatcaagtgacaatagcattttaccatgtggttaaattgccactatctaagatagatgacagttctttcaatgattgccagcacttcttttagagggaatgataatgtctttgctataagtatctggcataaagagaaagaaaaaagtcttgatatgaggacagccattttagaaacatgaggtaacattactttttttcttaacctataatagatacaatttcatcctgatgccagaaacaatgccaagtaaaattctttttcattaaatgagtttacattgtaggaaaaatatgtcataagcatatgatacttcaggataagcccatgctactgcaggaggctcccgaattcaagatggtactcaatttccttaactacctgggaattctacaggtcagcttttaaaactccatgccctctttcaaacttctgtcatttttcactaaaaaagcataggctaaattcattttcactattcactattatgcgactttcactaatatgcgactttcatagatgctcactaaatattttctgaaagacaaaacctcagccatataacttgtttctcaatcttcagtcttatttaataggcatggcttttttgtgggaaaaatgtggaatgaaggaggtgagaaagttatagtataaatggagcagtcagttaatgttttgttcttcagaatttctgagagctaaggattgctacattgtcttattacttattcatataattaagaatagacatttatatttacaagattgcagttagctctcagatctctatgaaatacatacatctatacatattaatatttatatgtagtcttttaatagtcacattccatcagagagcaggatagtatgattattctcatttttacatcaagagaatttgttccaaagccacacgacagacctcctgggacttgtaacatccaatccaatagcttttcctttagtctcactactcgatgtgtgatctgcagcagttgtcgcatcacctggaagcctgatagaaatgcgaagtctaggttcttactgagtttcactgagccagaaccgcctttgaattccccaagtgataactctgcacattcaatcttgagcagcactgcactctgccatagagcctccttcacaacgagctgcccagcaatcaatcaattcatcaagattattgataggaaatatttctcacccacagtttatacctagtacttttagctttatcatccaacatgagaaatactttaactgggcagatgttttttggagacagctctagcagagtggctgttcttcaaatgctatgaagcttgaagggagagggttctgattttccaggtatcaggttctatctaggcctagttcattcatttagcatggttctgccctctttcctcatgaaacaggaactaaaaaggactaagttaattcagtttaaccaggcaaaatgtcaggttgtatgacattttcagacttgctactaagtcaaaaatttgatgtacatgtaacaactgtataaaatgggtttatttctgttttatacattaggaaactgaggcttatatataatttgtctatagtcatatacatagattgtagaataggaaattaaatctccatatatctgaccccagtctgttctcttaaccaagaggctactctaactccctaaattaaggtgagcctgtgtgcacgtgtgtgtgtatgtgtgtgtgtgtaaatgtgttatcttcagggcagaaaatgtgggaatataaaattatgtatactacaaaagtcttatgatctttatccatctgggattgtagatgtttattaaatatgaatgaatactatatgtattaacttctatctcctctgttaattattattattagaaatccatgtatttgtttatattttccattaattttgtacatgtattactaagtattctctcccttattgccattcccaggaatatattattttttgttggtgtagttgagcaaatgtgatcacaggccaagaatgttttcaaatatttgcttatataattatcacaattaacacatataaaaaattgttccttttttttcaaagattgtatattcaataactctatagaaagatgaattaaaagccttgagttttaattccaactttgctatactttatgggaccttaatatgaaactgaacattaatgaatctcattgccatttttggaaaataggggtaattatgccttgttgaaaaataatttattatggtatcaaaccaacaaatgagtcctacatatatgaagttttactgcccttcaataaaaggaagaatacaggtagttttttaaaagaagtagatactgaaatttgatttatatattatgggaaagtgctttatggaaacatcaacacctactgccagcacttttgtacttactgttctcactgcttgcttggaatacagcttcctcagatatgtgcatattttctgtcttcaattcacaacactacttaaatggcatctcagagaggacttccctggccatcacatccacaacagcaggctgttttttattccctcagtttttcttcacagtacttaacctgcaatttttctctattcctagttcagtatttgtttattttgtgttgcctaccttagaatgcgagctctataaaaataagaactttggctgctttgttaaccattcaatctccagagcccagaatcgtaactggcaaagagcagatttagagcaattgtttgttgaataaatgaatagataaattaagtcaatatatagctataggcaaagaatgaataataatggcactattagtactgctgttgctgctgctgctactactactactataacaacaacaactactactactactacaaaactactactactactacaactactactactactactactatcagcttaataattgggtttttactatgtaccaggcactgtatgcattatcttaacaaactctcacaacaacctgtggcagtagatataattacctacatttcccaaataaggaaattaaagttttagttagattcaatgtacagcaaagattgagaatcaatgactagattaagtcattgattacctggtaacattggaattacctggtaaaccttttaaagtattggtacacaggttccaatctcagagttctgatttaagtgcaattcccaacaataatgcaattaaattaaaacatctagggatgggaacaggatatcagtatttttaaaaactcattgttctaaagtacagccaccattgagaaccactcactggcttagataaagtaactaacttcctccaggtcacttggtcaggaagtggtggagcagagatttaatccctgtttctctgacttcttcccaatccttcctccatattttgcatattctctgaggcagactctctggtatttgagtgccttaccaactgcaatattgctaactgtgactttgagataatacggttttatttctaatagtgtgattttaaattttgtgttcttcttacattcagtttagtttccttacatgcaagaacctgatggtaattattgctttctgttcctgtgtactgtacaagtacaagtacaagtgggtttacaaagtaatatacagaaagaacagtatactcttccaatggatatgaaaggtcaaggcctgaaaacaattttgtaactatcataataatttttaaaggagcagaaatgggctacaaaggcactgtgttgtaacttgataaaataaataagagagactcccagggtaaaatacattggatttaaagccaagtctaaatcctaaaaaccaaacaaacaaacaaacaagaaacacaacaaagggtttctgtaatatcaaacttgggtttgttttgaaaatagatgatttcagaaatttttacttaccacttcaagttccaagagatcatcatacctccaaatgtaaaaaatgcttttcaggattatagcctcaactgtgagagattcatttgtatcagcatatagacccagatggcattgaaatggtgcattacaaagtggtaaatgatgcaagctctgaagtgaagaagagtggaatgtgaaacccatcttgtcacgtttagttgtgtgtcacagggtgagcactctaaattccttgagactgtggcaattaataattgccacaacagattagtataaaaataaaagataatatagacaaaaatattagtataatatctgatttatagtactcaatatttcattgctggagatttgagactaaattccttgagacttatatgtttaagtctcatctcaatagaaaatgaaattaataattgacacaacagagtactgtgaaaataagagataatatagacagaaatattagtataatatctgatatatataattcaatattttgttgctatttttagtaatcaaatacgcaaccttctaaaattaagacggatttagatgcatggaatgaatttatgtagcataagtccatacaggtatgtctattcatgttacttgctactactaatgtattaattgcttggaaaataaccagtaatttgaggagtttataatttagctggaaaattaaaagacataaagagaattgaaaaaaaaacacacacacaagatatcacattgatagtatttatcatagataagcaatcactaacactggaatggataataaatgccagtggagtttggaagaggaagtaatcactttttgctagaatggaaaagaaaggctcatggatgagagtttgacttagaaggctataaggctaagtaatgtctacacattcctcttatttgtcccttcatttattcagtaactttttattgaatgcttactgcctttcactccctctttttgagacagtctggtgatataacagtcaacaaaactcatgccatgtctgaccacgcagagtttatatactaatgagagatatcagcaaacaaatggtatataagctatatatatattataaaagcataattattttaaaaaataatgtgttgcagaaattttttaaagggcaaaacgaataattagaataggtagatatttcagcaatgacggtaagtggagcctgaatagataaattaatgaattataggaacctgatatgtaaatatttctgggaaaattgttccagaaagaggaaagcccaaagcaaaattctgagaaaaaatataagctgatttattctaggaaaaacaagaaaaatgatcacatgtgcagaatattctgagtaaggctgaaaaataattttaaaatacacataaaggaaagaaaatgaataggtggatgtaagatggctgccaaagtggacttggttatacctggcaattgaatgggattggtgctgagcgaggggaatcaaagacaaatccaagagactgaacagaaaagatttttcccgaaatatttcaagaaaaggagcaactttgaggaaaaataaagtgttaatgttaaacaacttaaattgaagatgatggtgagacatcctagagacaacaagcagctggagatactaatacttagaagagcggtcaaggttagatgggttttaggagtcaatagtttgcaagtgataaagtcctgaaaaaggagataatgcaaaacagatgctaagagagtaagaaaaagcagaagaagaaaaagtaggttttgtttgtttgtttgttttttccaaatctagtctttttattgtttcctttctcaataatgaaatcatctttcagtgagttatctgtactggttttaaacatgtccacatattctttgacactccttccattgatttcaggctaactttatcaatttgttcccagtgaatgtgatgtggtgaagtgatgctgaataatttccaaggtgaagtcataaaaggctccagagcttttacttggagtttgcctttgaatctagccactgtcttataaagaagtctaacacctacatagaaagtccacatgtgggtgttctggccacaactctaacatatcccagcatcagccagcatcaactccaggcctgagaataagagaaacttgagacgattccagctcccagctttggagctgcccgatagatatgaagtgataaaaagatgagcaatttctgcccagccttgaccaaatcacagatatctgagaaaaataaatattgttgatgcttagactaccaagttttgagatgatttgttacatagccatagataattggaacatggtgtaagcaagaaattcagaagtaatttatgataccaaattttcttttacccagtaccaccttatttaatccatcaccaaatcttatagattcttttcctactatagagtctctgaaattcatttagttttctccatttccaccaccactacaacaatacaagttatcacaatttcttgtctggacaatgtttggtttcattctttatattccatccatgtattttgtttccatttatatttattccattacactttccacttatatttggttccattcctcatactacatccagttatattttgaaaatgcaaatctgaatatatatatccatagcctctataaaaaacaatgacttctcattgctcttagaataaaaacaagcttccataccttggcctataaaaacctgcctcatctgtctcttcttgcctctacaggctattccaaagaaattatttaatctttaccctctacctcctctggctttctaatttcttcacccctgttcctccagctgcagattttgcacatactactttctctgtctgaaagtttttctctcctttctttgcataccttttagtcatctttgaactgtcactttagtcattgtttgatcagataaatcttcccatttcaaacaaatcccccatgtaatatttttatagagccaaacgctgctgctccttaggacttcattatttttataaaactgcacttacgtatgcatgcatgtgtgtgcttgtcttttcacccttctcattcagtaggttcaatgagaacagagaccatgtccattatttgtcaatgttttattcccagaacatactctagtgccagacacagaatgcactcaatatatatttgtggaataaattaattaagaacatataaagacattttattcatcattataggaggaaatcattactctaagagtgaaggaagtgaagggagaagggaaatagtctagatatctacctgtatgattctatttgttcctgccctattgattacattcccttactgattaatcttgagcctcagctgataaagaactcagaaaactgggcaatatagtaaataatctcccagattaattttaacctaagtatcaacaggttaaaatgttactctttaggaaaagtggtatttctatcgagaactccctaaaatactatttctctctctctctctctctctctctctctctgtgtgtgtgtgtgtgtgtgtgtgtgtgtgtgtgtgtaggggaagtcgtggtaagaagagataaaagagtgaaaaaaataggcataaagcgggaggaaaaagtgaaagacaaaatactctctaactttaaatacaatataaaaggactactaagtaaatgcagtaggaaatattatttttgttataatctaaccttcaggttttattattattgttgttattagaaggctaacagactggtctcctttttaatgatttattcacaaataacaaaatggaggtttcaagttaaaagaaaagtatgtcccgctgtctttatatttgccaaccagattatttgttatacgtatagaaatacttccataagtataaattattatttccttactgctgtgcccaaatgacattacactaatattttaagcaagcttccaatgttaaatagcttcataaatttacaatgtctaataaaaaccaacaggagaaaagtattaaggatactagtcacatcctttctagtgcttgaagatagtgatattggtggactgatttcaaagaatgtccttcttatgcctgaataattcagtttctctaccagtaatataattatgcttagcttgctgattagattgtatttctgttgcttttgcattcataaaatttatcacataatatgcattatggttttcatttgtattcacggttctcaagcccaatttttatgttacttgggcataaaagacttttgttagatattagtactctagtaaattattttgctttttagtaaatggacgctatatttaacttcatttacttcttattttgtataatttgaatgatagagtttaaaagtaatgcaataacaataaaatgtataaacttaatagtagtgcttattttcacatagtaaacaaatttgacattgggtttcaatattaaaataaaataaaattcaaaacataacaaatatatatatgcatgtatatacatatatgtttgtgcatgcacaccaacatgtattttcatacaaaattacagaaaaattttatttttaaaatcacagtatgttttatctttttatcacacataaaattataagatgatcattataagaagatatgctgcatttttttctttgtcacaaatccccaaatctttgttggacaacaccaagggaaactgcagaagacataaaattgaaactttggttttactaatttatactgctcttattgtgtaacctgcaaagtttacattactaactcttcaaataattcatcttggtaaagtgaatagaacttgctcttgaaaatgagtgacacaaatgcataagatcaatgagcttaatttcaatttcttatacaaataagccacaactcggacatgtacaccatgaaatgtttaaaatattatagaattgccaaagttttaaatccttaattttaatgcattgtgtgccttaagtctattcctacttcagtactttcatataacctctaataacctgaacactaatcttacaattgtcccagactatgcagaaactaatagaatttttgattcttcatttactagttagtggggcagaaaaaaggcattcatggctctacccttatagaaatctaagtatccagaactaaactgtgaaattatcatattggtctatatcttttgaaaaaataataatcagattggcctaaaatatgtgcatataggcacattttcacattgatattttcaaaagttattttcattctaagcattttagtttttaatattctaaagcattcactaaagacttcttactatatattttctatatatatatatatagaaatatactatatatattttgggttaggtatctataccaacctaacccaaaattttgcttgtctattttatatatatatatatatatatatatatatatatgtatatacatatatgtgtacgcaaatacatacacacacacacacacacacacacacacacgtatatagccatcataacaggtatgctacaggtatgctcattctccttcaggtagggacatttctcaacaatctggcagtcaatctcaagtgcacaatgtacgaacaaccagtgtcatatatatatatatgtatatatatggagagagagagagagagtcagagagagagagacttatatatatcttctgattagttttgtcgcttaacaggattattgtatgacattatttttatttgttagaataaagtaccttcaatttggaaagttgtaatgtttactaaagtaaagtatactgatttcttatttgtaattccttttctctctattttctctgacttgctacaagtggacacattttttccaatcattctattagtaacactttctctgtgctcatgggcaggaaataggtaaattgccttctagagccatcagggcagtcctgacccatggaatcatagcaggctgctgaggaggaatttagtgcccttgggattcagtaggctatttgcaagctcttgggagacaattctccattggtctcttgtgtgtatatatttccacatgcaaagccatttgttctggactagtttttcaagaatgtttgtatagaaaacatccttagtagagaaaatgacagaggcatttaaattttggaagatgagatgtgtctctctctagagtctggagcaataggacaggcataatatagtgcctgccctttataaaatatttgagtcctctaagctcagtcctctcttgtaattcatagtatgtgcaactgataccttgttctcttcatgtgatactgtggaagttgggggtcaaggaagtggcactgaggctaatactgtggctatctttagtgctgggagtaaactgtgacccaggcaccttttgactaccactggcatccataaaactgtggcagtctaaattgttaacttgcaagtatggtaaaatatcagacactttatagtccataacaaatttgtttatgaagatgggatgctgacagagaaaaagctctttaaaagaagaagaatgagggtctcacaggccaactaatgggattttagaaatgtctctggaaatcagtggcaactacatggaccaaatttaatggtcaaccaggcaataaatggtcctccactttattgctgttaatgaggagatattaggtagaggcttctggctgagtattataaggtagaatcagagatagccatcctaacaggtacattaattctccttaagatagggatacttctcaacagtctggcagtcagtctcaggtgcacactgtagtaataaccagtattaacatttttactggagagaggtggcagaagtttctacttggtttcagacaagttatggtgaaggttatgtatactaagaatataagaaatatatttcataaagaaaaataatggccactatggtaagaagccaggcaaattgtgagaattttgacttttgcttcagatatgaggggcagtgagattaatacttgataaggaaacatgacaattgcaggaccatcttatgactcaaactcttttgcagtgtgttatggcaatcataggtccatttaaatacaacattaaaagatcttacaattttgtcagtgggtccaggctgctacagtggtgctttggccctttttggaagatttcactgaacaatctcccatgagaaactagaaatgaaacattttctaatagttaggcttttactaccccagactgagtttacaattctgacaaagttgacctactactggaggatgagaaactgactgaagtacctagaaaaattcttgaaatccgccattgtactgctcaaaactgaaagtaaatacacatggctctgtccctccataaacggagaataaaaccattctctccttccatatttcctgattccttccttctcccacttaaatgatctcatctactttaaagacaaggatgatcagggatgggactgaagtctttctgatccccagtggagaccaaagaccattctcagctgtctttgctggaaatatcctgggaaatttagtagacaggatagttcaaacttttatgactctattagatacaggcacctcagttaccattctacccaatcttgtgggacactggattctcaaatcaaattgatggggttcgggtaaagttcaaaatggggaagaggagttaatgaggccttgtaggaagagcctttcagcaaattccatgtaacattgttgaagattctacttttcaataataattagtagtcatatattacatgcttgtattgtgaatgcccatataatgtcaaagaaattctcccaagtgagaagatcatccagtagaaaagtactattaccttttcaaccccatgaccttgatgacttttttgagctataagtgtctgtgactaatggttttacccactgggcttctggcaaaaggagacagcctttatctaggtgtcccaaacttgtcagtggcaagactaccaagcacactgtttttcaaaagcagctatgtttaacacagctcttgttaaatcccagtgtctgacccatagttattgtgactccctagcttgatatgatcaaagggtaggtcaacttggatttattgattaataaggggaggagggttcaaggccgtgcttgtcaaatggaaatggcattttcaaaatgcatccagcccagtcccaagggcatctcagctttacgttttaaaaaatggcagcttttcctttgaggagaaaatttatcttctactctgctatctggtgcagtggcccctcagttcatagagatacttctaaatatatgaacctggtttgatgaaggtacccaatggtctgctgtggctgttcaagctcagcgttagtcatgttaaaactaacatgaacctggtcactatacgcactgggcagaattcattcttatatctctggtcaatacccctcttgatgagccttatggatttactgactcttggattgttgtcaataatctagcagtttagtctgccacgtgaaaactacggatttaatacagtccaaaagtgattgacctattgtcacaaaaagcattcaaaaatgggttgatagtcaaagcattctatgaacctctatgttctctaccatgcataagcattgagagttgttgagagttggaatgaactcaagaatttctaaatctacttcacccacttcttctgacccacaaagctttgtaaggtagtttggtcattgaatgagactatctccagaagggaatcattgcttctcagctactttccaggtaatgatgaaatggttgaggcatatatcagcctattttgcaaatttaagatgtctttgaccgtttctgagcattatgtgtctttctttccctaacggcaaccacagtcattcttgatacaacatctgggtggcagtcttggcaaaaaaaaaaaaaaaaaaaaaaaagaaaagaaaacatggcctaggagattcaaatttaattcttctttagtgatctaatatttttgttattgttgttggactcaaatattgctagattctaaagataattatcatttggttgagattcctgagaccctttatagcagctaacatgggctaaagtaaaggacataataagtcattgtaagttttacaaaaattcccttgttccctaaaacatttgaataaaatgttccgaaaagagtataagatgactggagacaaggtggagttattattattagaatgggacacactaatttcatggtggcgaagggggatcaacaaccctggcatgaggggatagaggttaccataagacctcagggagtatggggaagggagaaatgttaataatttttgttttttcagaattacccctggagccttttttttaagaagaaaaaactctggtgtgggattcctaaacttttacaaacactgtaaatttaacttattgataggtctctcatcacctgctggatgtctctgactgatttgaacacaatcgtccttattcttactaataagcttacgggaaacagtaggaaatgactcaaacttctacatttccaaagtaaaacacttgttcacacctctagatattttttctacctttattccgaaagctgtcactctgtcattccacgaggtaaacaaatgccaactttctagttggatgtacaaataagacagagtcccttcccaaacaaagaccagattcaatcattaaaactgaattgggaaactcacagttttctagccatttgggaggcactttgaaggcactgtaaacttgagtgccctggctgatgtaggtccttcttaagaataggggtccataattttaaacatttaaacaatgctttttcccccccagagacatgatgtttagctgggaactgtccttatgtggaaaatagatattaactaggctgtcttcccaaaatatggtgacattcaccttagatgtatcaataaaagacattcaagatctattgtacagcgcggtgactatggttaatgatgatatattgtattcttggaaaatactaagacagtgaatgttaaaagttcttatcacaaaataatgttagataatacattttataaatagctagatttaaccattccacagtgtatacttactttaaaacatcatcttgtacatgacaaatacatacaattttgtctgttgatttaaaacaaataaatacatttgaaaaaaggtttaagataacaatacctataggtcataaagcctttagatgactaaggagatcttgccaatatgaggctaccatgcttacttaggagagctactgggagggaagctgattcattatttatgaggaccttgaaggtggttatcctatgataataagagcaattggattagaaaagatgttataaagttagtctctgatttattagctgaagtgatcaatgatgccacctcggttctggaaggcactgatgccacctcagttctgaccttaaggtcagcctcaacttactggccagggttgttttagatgatagaattgccctagattttcatcttgtgagccaaggcaatagttaatgcatcctaaagtatctacattaaagatttgggacaagtgcaaagaacaatataaaaaccaaaggaaaaagccacctgcctctctaaagtagacactgatgttgatgtaatttgttctgcaagttgagtctggatgcctggtgattggcctcattctgcagttaggattcctgttgataatgatcttaattaaatgttgtatgataaaaatggaatggatttggttccagcctatgacattcagattaatcaaagtatctgattaatgggaattctcataagaaaatacatcagaaagtttagattgatgagaaatagcaaaataaagatatatggtagacagtgcccttagcttatgatgttttgggaaaggctacagtgtgaataacattttagtttcaattacctctatcatagttcttaacatagtcggccttatgttcattttgtttaattggtcacaaatcaatttattagacaaacagatttttattaaacatatactatgtgtatatatatatatatacacacacacacacacacatatatatcaaaagtcaatatgttatggatgttaggggtgggtattgttaggaggcaatcctccatgtgtttcttgtggttgtgcacatctttcaagcaaagacattgactgcttttgttctggaatatctttttaaggttgttcttacatcaaacagcactggaattcagggacagttgttctttccaaagcaaaacacaaatttattttacaattttggaagatggagatagtgtctccctccagagcaaagatgtgggcaatgcttaccatcaattataaaagatttcaactctttatggccaaggtttctttcctataatgcaacttactatatatgagaatccgatacttggtcctatccctttgggaactggggctcagcaaagtggcaccaatgcttatattctggctactacttttgttgtgagtagtaaagtatgcttcgtctctgacctacgagtctttggacttctgctagcatctgtgaaaatgtggcaagctgtatggactgaatgtttgcattcctcctaaattcatatgttgatgtcaaatacccaatgtgatagcatgaatggcgcgagtctttgggaggtaattagatcatatgggtgagttcacatgaatgagattcatgcttttaaaaggccagagagctagctcttcctctttttactatgtgaatatataaaaagaagtcagctgtctgcaacttagaaaagggccctcaatgcaatccaaccatgctggcattctgatctcaaacttccagcctccagaactgtgagaaagaaacatttcttctttaagacaccgaatctatggctatttagtatagaattccaactaagacactgtgagtcttagttgcaagtctggtaaaatctcagaccctcacagttctagatacgtacctctaacaatcctatgaagtattcatgggagttcacaaggctgcaacagaatgactactgtttacatcattagaacccccatcaggcagtgcatcaaaaacttcaccccaaaaaacaacccatataacttttcatgttttcatgaaattaaacctctataaaagctgagaaccctcaacttcttcaaaaaagcaagcaagcaaccaaccaaccaaaaaaacgtctctaataattggaaaaggagacaactgccctttgtatttcttacctatttttttctagccactgtcaacaactagggataagcatcacttaaggtttgggccagtgcaataaggtaggaaaattacacggcagcaacacagtttaagattaaatattagatcttccttttctcataaatctttttttcacctcacctaaggattcctcactagctatcatctcccaaggtttcagcctctttccatattgctcaatattccaataactttaaaaagttttccactgctcctcatcccctaaattcaaattctttcactgatcaacctttttgtttgtctttaatcttccatattacaaccatagggtttgcacattcagatgtaaaactgcctttttcaaagctagttaatgtgtgaatgaattgtaacctcaaaccatctagggtacgctgctgaattataacgaagtatgtcaatgtgtatcataatgtttgactataaagaaaataaaagatgaaactgtgaatacttacctaccaaatagttattttttaaatttgtggagaaactactggttttaaaaaggaaggaagaacttttcaaaggaatgactcagaaaagacaaatcagaaaagggaaaagttaattcaggaaaattctttagacaaaatccataagtactgctgagttagggtttaggtggcacagaaaagaatagtccctatctaagaaggccaaacatcttatgtatgctgggactgacagtcttatttccaagtaattttataagagccataaacttcacgtgaacttttgaaaagctgaactgaaattcatcatattcgtagtttgtatatactgcactcttcagtgttttgtgctctttaattcagtacggtatagtgaaaataacatagagctggaaatcacacacattttgggttgaatcccagttccagcacatataaaagctgtgttctcttgggcaatttacttgacgtgttttctcatctataaaattatagcattaattacttgtagtcagtacaattactactacagaaaagaaattaaagaaaaatttaatatatattacaaataaacagtaaaggagactgaactcaggtcctcttaagtctgggcttcttttcactaaaggggcatgttgggaggaaatattaaccatggtcatatctacctatttagaacagtgtttatgattggaactaagaagaaataaagttataaaaaaagttcagagtcaatttttagaggctccaaaatgccaggttaacaatttttgagttgaatgatatagcaatgaattatctgcagaatagaaaaagtaatgttttaaagtaagcatattctatgatactagtgatatgtaaatcaaatgtgagaaggaatgaactggagatgagaatagttacatgattattgaaacaacacagcccacaccagcatcattcaaaattttcagctagatgagatttttttggtagctatgttacatactacatttctacttttaatgataaacaaaaaacatgataatattagagattctgccaagttctgtagttaaagtaatacagcaaatcatctatttgtctgactaccattgaataccttttctaccaaatttattcattattaatattcaaatagaactttaggaaatactagcttaacgtatttcatattcctaaatcttttaggctttagacagcttggcaatgttattagaagggtatatcctgtatttaatattcaatctgggtcatatgtgtatacatacatgtctttaaaatcatagaccctcagtaaagtctctatattacaacttcagtttccttaaatgtctttctttaaataagttctttatgactctagtcatttagcacttgaaagtaagagtggcttatatctttataactttgtagctgcaattcaatatctgttctataatttgtttgaaactgctctcttaaaattctaaatacactctctggcaatgttcactattgtctttcttagttattgtaattctaaaatgagctgatcacattcctcccaggttttaacttcatcagacaattttgccttaatgaggaaaaaaataggttcacaatagccagtattgttattacttcctgtgacagaaaatagtaaacagggtaaactttttgaaaagtcaaatgtggtctttggtattcatagcccagaataaatgctaatatgtattattaataaatatttttatggtcatgaaaatgaagaaaattggagtcatttaataaagatttcacaaaagtttttctcagcatggtctttatgatgttttattgttctttttaaaatactcttaaacaggcaggaaaaataacctgtgtcctccttgcataatttagaaataaactttagctagaagacaacaaagtaaatacaaataatggtaagtgagaagattttcagaagtcatttctatagtcttaatggaaagccatttttgctttatgttttttatatctaaaggttttcttgtctttttttttccctcagaatttagtagaaatatctaggagatgtgagacatattaatggttaaagtaacaatattagaacatccaaagtgtttattttcagaataaatatatacttgtaaatcctactaaatatgaatatttatcattcaaacactgaaataaaagtttacccaaaatcaagcacataaacataaacttatattaactccaaattggttcagagcatcgttttttcagatgagaaacacaagaagtcatccaagatgtctcctttttccttgccccaaactaaaaaaatatgtactagtaaaataacacttaaaaatctgtcataaatattggccttaacaatgtaacagaagtgtaaaattttaaacacatattttttttaaaaaatcaaataatcgaaataagccactaaagcaaatattgcataagttacattatcagtagataataacatacaaaaggaaagggatgtataaaagcaacgaatatgttgaaatgttgatacttttgacaaactttaaaaaaaattcatgcttcataaaggcatatttggttatttaattttcttctcaaaattatttcgatgctgcaaacctacatttgtcgtgtcttatttccttggaataaataagctaaagatggctgaaaagggacagtgggagtgcaaatgaagtgcagttcatttagttctgacctcatttcatttcttcccaagaaacacttatctcagaagtaaatcggtgccatttccagctcgtaatacatgataagtatgaaaatgagttcatctttgaaatttaacatgcaaatttatattactttcagtatctggattaagtccggttagaagaggaaatcatgagctgctgcttcaactcagtgacctcactgcatcaaacttccactttgccactctgtagaacaaggatatgatatgtgtaattaaatgtcccaatcagcctgccagtgagtacgttacggttcatgaataagggagagactccctaagaaaacagagtgtcattttaagttgttttcgggatcctcagtgcagttaaattgaccaatttatcacagagagaaatatattaactgaattatcctccagagactttgatttaattaacctaggatgggagttaggcatggatttttcttttaaaagctctccaggtgattttcacgtgcagccagggatggggatcactgagctaaatgaaaccctcaggataagatcctgtttctcagtggctgcttggtgacttccctgacctccctattcataaaaatttcagtttcatccaatttcatcacagaactgctgggtttcttccttcctcagataactgtacctactttacagaaaaaaataggggtagagggttctgccatttgagaatgatgccttcttccatttccccctacaaaaacattataccttcatcggctccttcctcagggtctttcacctcaagggagagtatgtgtcaatttttatccaagggcaatgctatcccctctattctgaatctcagattcttaacctcctaggactgtaatgttacaattggctcagatctcacctgtattttcaacttctctcaagcattgtatctttgtcctcattacttcagtctctcacatcttaaaaacaatctttcctcattgcatgtccttttccgtctacaaacctagctagctcttgcctttgcttcagaggcaagcttccacttttcacataaagcctcagttttttcacctcattatttctcaattattagccatgtggcttatacatcactaattccagtgaaaacgattttacccaggtcactggtggcctcttggttgttgaatttaatttattttcctgaccattttgcagcatttcacaatgttgatcacatctgatttataaaatatctccttgctgtggtatcatgacaccattctctctggttatgaatctttgcttctagctgctcctattttagtctttcacaggctcaacttcatcctcctattcctcatattgttgttccctcaattcacttctgtttcaactcttctctacattttcttatcattcacttaatctaaagtcatattactttttacctaaattactgaactagtcttcaaactggatacaattcttagtcttgtctctctcaaaccatatgacatcttccttcttttatattttatttcattcatttactttaaaatatctccagcttattaagatacaattgacaaataaaaaatgtatatatgatattttgatatttgtctacttgtgaaaaattaaatcaagctaattaatatacccatcacctcacatacttttgtgtggcgaaaacatttaaaatttactctcttagtaaatgccaagcatgcagtatattattactagttatagtcatcaggctcaactttttagattccacatgtaagtgagatcatacaatgtttgtctttgtgcctggcttatctcacttagcagactctcctccgggttcatctatgttgtcacatataataacatttccttcttttttaaggctgaattgtattccattgtgtgtgtgtgtgtacatatatatgtgtgtgtgtgtgtgtgtgtgtgtgtatttatgtgtaatgtatatatttagttaattgttatgtatgtattatgttatatataattatgtattatattatgtatacattataatatatttagttaattgttatgtatataaaatataattatgttatatattatatatgttatgtaatataacatatatacattatatataaaataaatataagatatatccattatgtataacattatgagaagaatattaaataaccaaatatatctttatgaggcatgaattttttcaagtttgtcaaaggtatcaacatttcaacatatttattgcttttataccttcctttcctgtcatatgttatcatctactgataatctaatatgcaatatttgctttagtggcttatttcaattatttgatttttttaagatcaaggagttttatatatatatatataacataacatatatccattatatataaaacaatggatgattcttcatttggtcatccattaatggatgacacttaggttgattacatatcttggctactgtgaataattcagcaatgaatatgggaatgtagatatgtcttggacatactgctttcatttttttttggataaatatctagtagcgggattgctggatcatatggtaattctatttttatttttttcaggaatctgcatactatttttcataatggctgtactaatttacattcttactaacagtatatacagattctcttttctccatatcctcaccaatacttaactcttatatttttgatgataggcaacctaacagatgtgaggtgataccgtttcaattaatggtactgggaaaactgcatatccacatgtagaagaagaaaattggacctttatttcacatctcatacaggaatgaatttcaaatggattaaatagttaaataaagacctgaaagtataaaactatttaaaaaacatagagaaaactaatgtctctctgacattagtgtggcagcgatttcctgtatatgaccccaaaagcataggcaacaaaagcaaaaacagacaaatggcattgcatcaaactaaagagcttctgcacggcaaaggaagcaatcaacagggtgaagagacaacatatgaagtgagagaaattatttgtaaaccatatacctgataaaggccttatgtccaaaatatatgaggaattaaaacatcttaatggcaagaaaacaactcaattaagaatggacaaatgattgagtagacatttctcaaaagaagacatacaaatggccaacaggtatatggaaaaaaaatgttcatactccattttctaaaacataatggtccctaatattttaagcctttgcccacggggctccctcaatctggtgtaatctgcacatccaccattgttctcatcattagccttgtttactgcatcttcagggttcaactcaggtacttttttctgtggacgccttccttaacaatccctagtaccctagagcagtggtccccaaccttttaggcaccagggactggtttggtggaagataattattccatggactcgggggaggagtggtatggtttcaggatgattcaagcacattatatttatcattagattctcataaggagcatgcaaactagatccctcacatgcacagttcacaatagggttcacgctcctatgacaatctaatgctgctgctcatctgacaggaggtggagctcaagtggtaatgcccacttgcccgctgttcacctcctgctgtgtgagcctggttccttacagtccacagaccacaacaggtctgtgctgggaggcttagaggagcactccttttttgtatagctcttagcatagaatttacaataaactattgtaattatatactaacttttaaaactcttggcgcccacccttgagagtaaattcattgcaggtagagatttttcccatcctcaataagtttatgctcctccacatttcactcacccctctccctctgtttttctttttttttctcctctctctctctccttctttctctctccctctacggttcctttcatcaccctgtggctttatacttagttgtctctatctttaatgtcttacatttttcaatctctatgtctgtctttctttctgtcctttttgaatccctgcttatccttttctataaaaatttttgtactcttctaggcagagtggttccttaatcgtctttgaacggaatgcaccatattcatttttctgcagtagctcttattgtgatatatagtaatgcatactttttcgttgctgtttttcccactggagtagcccattgatctctttgaggagaaaaattcatcttttccctccccttacctaataattaccacaaaatatcaatgttattaaataaacaaaagaatgatttccaaaataagggaataatatataataataataacctcagagataaaatgaccaagtggtattttcatgtccaatgaaatttatttcccaaagggtaatactatcatttctgtcttctgtctttcctttgttttgaattgtctttatgacaaatattgactgtgcaaccatgcctctgttgctttagggatgttctctggttgttttattttgaatgtactgtgttttcaatgagataatacatttcttaacggcataatttgttcagttctgctctgtgcttcttacattgtgtctagcatagtggtaaacaaaacatccattcattcaaatattagtgagtatctgccatgtgccaggcattgctatttgtttgggatgttgacactatttacctagctccacaaaaattactgtaagacaaagtaagcagaagaacatacttcatgccttaatatgaggaaaggtctgccaaaatgtcataaattctgaagattcatatcaagcagaagaccagtgacttttacaacttcaaataaattcaatttaaaggataaaagtttatctctttctcatcaataatgtctgtatatattctgcctatgccttttgtttcctctttggttcccaggtttcatcatttttccctttcctattgtttctttcactttgcgtggtacaattatacattttgagtgcatatacatagcaacagacattctaaaggttacagtgtgatcacttttatctataaaccctccttcccagagctagcccagctattattttgaaacaaagtgagattttactgtggagaagctaaataagggaatcctaactgtagtatatttaagttttccaactttttatgtgatcagaattagtggaaaggctattaagtcatcacagatcttcaagatgctttttgctagtagcacatattttcagcaaatataggaaataagtttttctacatcacaggggaattttaagagatttcataagtttactatgaacacaaaaagttattctattttaataatttttcaacatttccttttatataggtagcttctcctccaaaattgcaatcactgtgctgattttattagcttttcatttgttcatccttgcattaagacattacatttcagatttttttcagtgcttggttttttagtttagcgaaagcgttcattactaatatggttattgcagtctttttttccttggttagttgttgtttgggcatgatgtagctcattttatccccattaaatttcaaatttttaggcttttaaaattatattagctaaaagttaaagagttgttttcttttgtatttttctctcccaaaatttagaattgttactaatacattttaagaattaaaatatttatttcccatttgaaaactctcaaaaatatcttagtgtatagcattttcaacaatgacattataatcacctttatttttctaaagatacattgtttaaactcaacatattacaagggtgcacttcataataaaaatgcatgaagacaaataatcttttacctatatacaaaggtagattttaatggtaaataaagcataagagatctgcagaatctaaattactttgaagcagttttacaatcaataaccatcattctggcactgaacaaatttgaaacctgtcttttttaaatatccaaaacataatgcaataaaaataatatttcattagcaagagtttattaaaatttttaaaaattattattgcttgtgtgtttcaggaactgaggcaaattctcagcattcaaaggtaaagaagaatattgaactaaaaatatccttaacaagtttcaatacagaagcagtcaatatacttcagaatatttagaatttgcaactgaaaggagaccatacaatcccttatcaacttacaaataatccctcatcaacttacaaataagtaaactgatgttcagaagatattaagcaaatgagcaaggttatactcctagaaaatgatgagttggaaagaaaatgttctctttgatatctgtggagattttcctgctatgtaccaaaactgaatcaagaatttgttcattatatgcatatttttgtaataatctgagagctaggcaaaatgtatagaatgtatttctaaacaattgttggaagggcacccttgaaatgcaaaatttctaattgttcagggagttttgaatttaagtgatctatcttctactaagttgtctataaatgcatcactattaatctccatcaaataacatgtaagtgatatcattaaaacctgttaattgttagagcttagtaaggcttgtttcctaatcaaaatggtttaataaagcttcacactatggcttttagaaaaaaaaaccactaagaaatatgaatgtgtgataaacttccatatctacaccatctgcctatctccttcaccatatgtcactctattaattgctaatatcatccttattatgcatcatttcatctgtaagaatgttccacaaaactaagaaggcatcaacaactacagaaaaacacctgctatatgcatttctggctgataaatttcagcaggttctgatatgttcttgggcaaaattttctaattacctttgcataacaggaagcctactagagcaactttctgtagttgcaatgatcttattactaccttctcaaactgttggttacaattaattaaatcttcctataatatttcttaaactattatagcagctactgtatgtataaaaatatgggtgcagtgggtcactgagctaaacactgagaagaggaataatatataagagggaatttgtaacatatgtaaaataattttgaaaaagttaagaccctgagcttttaataaacatgagttagtgagggtcgcagctcttacgtttgaccagtagttgtctatcatataacctgtacacccatttttccattgtttataaagaaaggaattgaacctcatttagattgttttattctatcaacagtaatggatgggtagaccatattgataactgtcctctttggcaacagctggaacagatccattcaaaattcgaacactttagaggcattgattattttgttctttttgaggtggcttttgttgaagaagcaagtctactgtccatgaaatgattagggagcattgccaaacaaaataaaattaaatgctatattgtgtggcaaagacagtaattgtaaagtaattttgaagatgaggaaataagggaatattgaaataggaaagaatttttgtaggaggtgaaaactgaacaagacctggagaggttggcttggtcattcaggaacaggctagacatatatgaatatctaggtggcaattctgtttattattgagacattgggataaacttttggtacaagttaaaaaaaaagttgcttaaaggcaaatcatgggtgattttggaaatcaaaagagttaacaatcggcaacatcagcaactgctgcagcaacaccacacccaccaccaacacattgtctccatccataaagcgagactttaatgggattaatctgtcagtaacaggtgggataaattgtactctaaatgaaaataaaagtgatagttgccgtattggaattgtagaatagtgacaatgggaatggaagtttaggagtgcttctagacatatttcaaaccaggagatacataagataacctctccaattttatctcactctacatcctttcatataactgaccaaactgattccccagatgtgtcaattcacattgtgattgcccatgatacattctctacatttgaaatgactttcacatccatcttcctctgcctatatccacaataatttccaagttctgcccacatattattttctccaactcaacggccatttccaaacatggaaataatcttcctcatctgaattttgcagaggcttgcactaacttgtaaacaagtctattatatattatctagttttgtgtttacgccttataaatcaatacaaaataataaaaataattttatactctatatcacatatggtacataatctagaatacctactcatgttcataagtgttgaatgaataaaaataaattgatcagtacaacaataaatgaataataacaatttcatgctttttgaataaagaaattaaaaggtgatgtcatgatttttatggttgtttttagtattttcccatttcattgtcttcttttctcatcctcccttaattacccatttcattaatcccatgagtggtttttgcccttgtaacttaacggactttgattacttggtaccatcctaataaacagattaaaatttgccatttttttcttcagtctattattattaactattttaaatgtttccgcattatcaaaattatcaatgctcaaccacatactgtttctttaagtatcaggaaggtctaaaatgaacattctacacatcttcaacacataaggctactttttgcaaaagctccagcttttggatatctactgcatatccaacaagggaataattgttttcaccactgtaaactggcaaatactttgtatacataacccatctatggaataagaattgtctctgtttgtgtaaaaaatattaatattaatttataaactgctcttttaattcataatttgctgtctgtgtgaacttttaatccctttaaaaatcaccatttcttgattgctcaaccatgcaatacacagacagaagctatgttaataatctctcaaaggtgcagtgcactgatactgcaatttatgctgttgtctggaaaaagcatatttattctgtccaagaacccatgagacatgagaactactctttgtccagactcacagtagtcattttaaaacttcaattactatttcagcatgttccctccattactgtttccactaccaccgccagtaatttctagcaacaaaatggactttgtaaaccatacacatacgtgccttgcatgcaatgagcaaatgcagctatgtctaatatctgcaaaataaaatgtaaatttaaatgaaataatatcaacatatgaatcttgaacatgtgctttttttatacttcctatataataattgttgaatatgaatacatatgttatatatataacataatgtatcttgcaatctaaaaagtccaatcatacattaatattcaacaaatagttcttgaaattcaagtcagtagagagctgctctttgtgccatggggtttataaaaaaataacaatgtaatataacaccttatttttgcctttgaacaatttactatcataagtatgattcatctttttaatcaaaatgagagtcttgaatgaacaaagatgctatgtagtctcaatcttactttatgtagatcttaaattccatgatctggctataacttctggtgtgagattttgttcctacattaacattaatctccttttctctgtcatctattttcacatccatttttgctaacaaaaatgcacatatctaatttatgtgacattgaagtaggatatttgaaacatatcattttgaagccatgatgttcactatattgctctttatggctataatttcatcttgagtgaaggacacaagaaatcagccttgtgtaatcagtaaaatagaacattttactgttctatttactgccatgacattcatgaaagtaacccttacaaaatgtattattcattattcactttataagaaaatatgagatactgtatgcttctttctaagctataaaaaagtgtgcctttctcgtatcataggaatacttgaattttatagacaatgttttttgggtgtaaactggtcaagtttctttatatgtttggcagctatactatttaaagagaagaagagctagagagaactcgagtacagagacacagaaaaatgcagaaacaccattattaaaaataataaccaccagaacagcaaacaagccatcagaaatgccagtacgacatgatgaggtattcattttcaaacacagttttataaagtttagaaagaaggaggcttatttaatttatgtggaaatagttcatctgaggaaaggtgatgcatgtgctagctaggataaaggaggggggaaagattagttttcatgattaacagttaaattgacacaacagtttaatgaattaaaaaagttgatgtttgttcctacaagtggtcacaagcagttaaagaaaagaaaaaggtaagcaagtggaatagatggcaaagaaacagtcagaaggtgaagaaggagtataataatatagatataacatcatttaattatattcatatttttaaacatttatctcaatgagataatagttctttctatactctgtcacaagtcagtgacagatatttaaatttgaggtgtagattttaattctactgggaggaattatttgaaatcagactgacctcaatgatatggttcttgcaaaccttgatgtttatgtctaatgatattggcatatctgttagtttttttagtatttaaagatgatgatatttacactatgggtagtcaaattgacttataatcaggtgttttgcactgtgaattacttattaaaactcaactacaaagtcagatgattttaatacatttgaactcccatgttaaaaataaaaaggtaccccagttggttgtgttagtgcctttctttattttctaagtagctgtacaaaatgtcacttgcctttcataatattttcttctatatttaaaattgtcctcaatgagttttgtccagtcaatattttgccatatatatatatatatacacacacacacacacacacacgcacatatacacatactggtatttatatatatatatgtacacacatacgcgcgcgcgcacacacacacacacacacacacacacacacacacacatatatatacctccagtaattccagataagatatatatacatatgtatatcttacatatatatacacacatgcagataatataagatatatatttatatcttatttggaattattgataatgtgacatataaagccagagaactaactggtttgttctagattaaattaactaactgtagaacctgtgctctaccttgactgctaccaagtattgtagacacggacacataagcaattcaaatggcaaactatgcaagtggagaagaaattacggctttaaaatatctgtatcattgcctatacagacagggtaattgtgattttcaaaaaatgccgacaatgtttccagagtcttgtattacatactttattcttcagtctatgttgtatgattattaattggaaattccttgggaacctaatagattgattcacattttgcagattttctataaatatcaataaatatatgagcacaatctttccttaaagattatattacaattcaaagacttaattgcaacttaattacaatgaaataaaggttaaactattaaaatgtgttcagagggcattattataaaacattacctttacacacaggcctgtgatcactccaagcagcaaaaacttcagctatccgttgacaggtgatgctctttgcgccctgtaggacataatcttcatcacaagagaactgcacagttgatccaaggctaaagttaaataaaagagaaaaaatatgataagaaagatgcaacataataactaggcttcacttctgctggcaatatccaataggtcaaatatgtactatagtgacaaaaagtattttggaaaacaaaatgtgaaagtatgacttgtagaaatgtaaagctatcatcaaatttaatcatcttgttaatagatgtagaacgaaggtcaaataattcactaagtttaccatgctaagtagatggtaaatgtgaatcaaaatgtggctattctgacttgaattccagtacagtgcttgtgttcatatcatattacggtgtttttctggcatgtatttacatgtgtatgtttgcagatgtgtctctacatgtgtatgcatttacacatgcatttgtgtctataaacatgcatttaatgtatttagagatgcaaaattgtactgattgattttcataaggtgtttttttctaaaaatattttaaatttttgtgggtatatagtgggtgtatatatttatggggtacctaagatgttttcatgaagtcatgcaatacgaaataatcagggagaatgaggtatttatccccctcatgaatttatcctttgtgttacaaaaaataccattacattcttttggttattttgaactatatgattaagttattattgactatagctatcttgttatgctatcaaatagtaggtctttttcattctttctatttctttttttacccattaaccatacccctctccctcctagccgcccccacatcccccactaaccttcccagcctctggtaaccattattctaatctctatatccatgtttaattgttttgatttttagatccctcaggtaagtgagaacatgtgatatttgtctttctgtgcctggctcaattcgcataacaatctccagttccacccacgttgttgcaaatgacagggctccatacattttatggctaaatagtcccttaacatggcataaaaagtcctacatgtcatctctcactcattgtgacacctgatcaacatctctagaagttaatccgtataaccaaagagagattatatttacagtcttcttagacctcgtcatgactccaagttttatttagactactcttagagcttgagcaaccttaaaagtttacataacggtcaattatctgccttttccttctttctcatctcaataaacgaaaactccattcttcaagttgctaaggccaaaaaccttacagttattcttaactcatctttctgtcttgcatttcacaagcactccatcaggaaaatcctgtcagcaacacattagaaatccagaatctaacatttttcagccctacagtgttaataggaatctgagccacaatttctcattcatatgattgcaatagtccttcttgctatgttgttagtttttcctctttctgttcttgcctccctgcaatctgttcttaaatagtatccagagcaaacttttcaaaggttagttcaaattatatcacttttgtactttcaaatttcccatccctgtttcactcagaataaaggatcacctgtttcactcatactaaagagattgcccttaaaattgccgatgtgatttggtctctgctaatttgcaggattaatttcctatgctttctccttccatgtctgttctttagatttatcgacttccttgctctggcttgaagatattaagcatgtgcctccctcagggtctttacacttgctgttatatcaatctggaaaaccatttcttcagaagtcctgtatctcccattctcaattgttctggtttctcctcgcatgatattttatccataaggccctcccttactgctctgtgtaaaacagctacgcctattccattatcttcttccatgttatttcctatatactatctaatacactgtttatttgtctccctgcttccactaagaaaacctcaagtctcttatctattttgtttcccaacatgtcaaacatttccaaaagtattgtaagtttatgtatagattttaaacagtgattaaagctatcttttgcagatttattggttgctatcatataagactgtctaatgcactcagatatgtccttatccctataactggaaaaatattctctgtcaggatactctctcaaggttaattaaatttttataatccatggcacccactatttcccattgcctgctgcatttgctgtgttcaagaaagagcaagaaaaatactaatgtgattggagcacagaaaataaagagaggggtatgtgaaattaagtcaaggaagcaattaggggttgtggttagattggttacaactttctaggccatgataaggattttgaccctcattctgagagaattgggcagttgttacaggggtttaagacaagtgaatactatgctttaaaatgaactcattggtttctgagtgaaggatacaatttaagcggccaaagatagaagcaaagagtttagttaacaagctgtcacggaaatccgagttttcatggagatgttatgatggcaacaagtattagaaaagtagtagctacaagctaatgatggtaaaaactttaggggatggagaaagaaggcccagtatagggcctggcccataggattcatttaattactattttctcactaacataataaattaatgatctatcatggttaccatatttgtcacagatgattatgatattctagttctaaccaggctcttcttgctaaaagtaataaatgacatcttgtttaagtgataggagtttgagcatgtttcttttgattatagaaaattaattcacttagcgtggagacaggaaattgataataataataattataattattataaaataataaataactgttttgctactatactaaagattaccagtaatggtctctgaagcttctatacttatttttcccctacagattagccatctcaacatgttcttctccccttaatacactgggaaaagtagtttagagtagtggtgaacagtttaagctacagaatcacaggtatctcctttcaaatactaactttgccctaaacttcagctttctcgtctgttgtgataaagtaatgaaatattatttataaactacacagtgtctatcacatatcaagcactcagttatttccctcagttagattaaaatgaagtcctcatagtctaggggttcttgtcttttaaagtcattttgagtatctctgtattcctccatttgtcccaactttaaaatttcatgtcataattatatttaagttctggtgggggaaatttatttttgtccatttataaagtttatattctcacatcccatatctccctaacatgaaccttatgttccaaataccattaacagtaatttactttttctcatacctttggtctttctacaatgtctactctgccaggaattctcattttcctcatttagcttaatcattattaagatttgattttaattttaggttacacatgaagctcttattaatttatccattaagaattaaatattttcctctgggaggccaaggagggaggattacgaggtcaggagatcgagaccatcctggctaacacggtgagaccccgtctctactaaaaataaaaataaaaaaattaacccagcgtgttggcgggcacctgtagtcccagctactggggaggctgaggcaggagaatggagtgaacccgggaagtggaacttgcagtgagctgagatcgcgctactgcactcgacagagggagacgccatctcaaaaaaaaaaaattaaatattttcatctctttgtgcattgctttcccatacctcagtagaacaattgctacaatgatttaggggcttaagttaagatggagcagtaagagagagaaatagtgtaaagataaagaaggtaggaagaaaggagccttctcacctagatgagaggaccattttctaccttactattttatcttaagttagcttataagatgccatctaaatgcatcatatatgacattttggccacatggcccatggatgtcctctgatttagattttctaggtctgctcctgtttatgctgcaggaggagagggaatgggatattttaaaatgcagatttagaatccaaactgccaagatggcaaatatttctaattactcatttgtattgtataagccattaatttcttccccactaatgaagaaaagcatctatattgggcatttgcaaacatctccatccaggatcacagctacacttcaacatattctagaccaaaaatataaaagtgcaaaacaacacagagaggacagaagtcaatgaaataagtagcctttccagtaaaatccaggctcaatcatcaggaaatggatatcttaaacaaatgcactgtgctttcactgtattaactgttttaatatttgagtcaaacttaagaaaaacttacactcattaaatatgtgtgtgtgtgtgtgtgagcgtgtgtgtgtttgtgtgtgtgtatgcattcctaggaaagtattcagttaccatgaaatgacaaggaggacaagctgtatccactgaaattcatctgtcaccacagaagagatgtctgccctacccagccaaataaaactttccactttaataagttattcattctgatacaacatttcaaaacaaatggctgagcacatttttaatttgaaagtaccaagtcataaggcaaatgatatataatgatattgtttgaaaaactagagttgaccttctcatgattatgctggtcaatgtttaagtgctgtcatctttttaaaaatgatacttattttgcaaaaacaccctataatatcaaagctgtcagtaagagaagatatgaggtttttcaaaatacacaaattttacctgtgttggcccaagatagtgaatctataattttatttacaatcaaatagacaggatatgaacaaatacagaaatatggaaggacagataatagtgcttgggtcatagaagaggatctaaaaaaaaagcagaggaggaatgaatcttgacagcattacatcaagagtaaatttgtctgcacttttgttgttattattttttggtctatttaaaaaggtctagacaatttcctgacagatgcagaaatttaaccctaagtagcagatgcatatttttcaaaattatcactgtacaaatagaaattgtccaggcatgacagatgatctaaaaattaaagtatctgcaaaccatttctgtagcaaaaaaatcaaaacactaaacgtcaagaaaataactattaccaaaatgaccacaataatgctgatttaatatctttaaaagtctaattattctctaaatgtctttaaactagcaatttcaaaaatgagtaattgcacattagaatatctaaggttattttacaatatgagattttctgttttaaaattgtacaagtacgtattgcagaaattttgaaaattaagattagcaaaaaaaaagtgaaaaccacttaagctctacactgttaaaggtacttttgagtctaattccaaaattctagttcttctcaaatttgaattatttctttcttatttccttcttgtaaaattggagcaagtgaagctccttatagaggggtcattcctccaactagtttgggattcaatccaccccgccttgtcattacttgtactattaattattccttctttctcttgaatattcaactctcattttaagctggtagtaaaagtgatggtattaatctgtttatttgtaagtcataaaaattaaatgttaataaactctatccaaagggatgataaattactttactttcaaaatattttgtttctgactctaagttacattgataagctttgttagatattacaaagtatttcatctcataccaaaacttttcttcaaaacataatgaataccatgtttttttatacctattgcctatttccttgaccttataaaattaatgtcattcttttgcagaaataatgtcatccaaaccaagactatgtccgatacaaagagaattcaattcagcattcacacactttcatatttctttacactgttggttataatcagtctggatattgttactgggtatcttgctttgtggaatgcttaaggtcactcactacctcattcaatatttatgccaactactgccctatttaataaccccaagcttggtcatttgtgtacaatttcaagtatactagaaagataataatgctacctgtctttgcccctccaatactcagcttcagataaattctatcactaggagtacatccttcttcttgtagatttacttcctctacttatatacttctatgaaacataaaacagtatactcaaaaatagtgtaattccaaaagaagcaatattctggaaaaaggaaaaatcccaaaagaaatacattgttcagagagaaacgcaaaagccctaggcaagtgcattagttaatatagattttcatatgacaacagctagttaaatagctaaccaagctaaaagcaaatgtcacagaaaaagttataatttcaaaccttcaagagaaagcatactgattattatcatagagtccttttcgttaacctccaaaattaactgtggtgaactcctcagaatcctcaaaaatccttgctataatacccaataagatttcaagattgtgatgttccccttcctgtgtccatgtgatctcactgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcctttgggtatatacccactaatggcatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttctcatgtgttttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgcgaaaattttctcccatggggtggggggaggggggagggatagcattgggagatatacctaatgctagatgacgagttagtgggtgcagcacaccagcatggcacatgtatgcgtatgtaactaacctgcacaatgtgcacatgtaccctaaaacttaaagcataataaaaaaaaaattaaaaaaaaaagatttcaagattttaaatttagtacaactattaaaaatgtgagagctgaagattttatttttattttgataattctttttatggagactaagagataaatacttgtcactatatgatgtttttattctgctttgctttatctcttatatataacactcaataggtcagattttgtgtcttaattaaacaatttttaatagatcttcaattctacataagcacaatatttttatataacaagtgaagtatggtacagatccataactgtgttataaagtaagaaaaggcacatagtaggataatgatatactttgatagataaaaggcaataaaataaagtgcttttgaaggttactagtagaatgcgttagaaagtaacatgaaaatgttcagaaaaattacaatatacatacacttaagtggcaaaatataatctaattaaaagcttaaataattttttttctgtgacagaaatgtttttaagacatgagttaaaatcatttgaatataataaagctttcaaatagtattaaatgaagatctatgtttgggatcatttttgttggtatgatcataggaaagaaagtggttaagattataaagtagaacttggttatacaatcccttcaaataaaaaagtaaaataaaattagtgtgagagctaataaatgaaataatttaatgctatattgtttaggttggtaagcttcctaatgatttccacaacatgctattttgaagttcacatgtaggcatattcatacaatacgcctctttaagccataaggcaaggttaacatctcattcttgtgacattaactttaactgttcccattgctatatcactccctgtgttctcatccctatactactatcagacagcaataaactaaataatgtaatgaagataaacctatttgtatctaatttttccaggcttatattatattaaactttgatctcttaatagtggcaacacattaattgtattttaaaaagccccagaagactgtggctctatatttaagaacagctgtcagagagaaataaaccagttgaagtagaggtttaaatagttaaagtcaaatccacctcagagtagggaaacactatagaggcatagatgaactgagctttgtgatgcacaatgttataaattatccaaaatgatcaagtttatttttaatcctaatataaattattaaaagaatattaaaaatttatatttgaatagagcattctagtttacaaagtactttcctctataaaatcccatttgatctactcttgacgtttttaccagttaatgtcatagaaatttgcaagagtaacccacaaggcactttgtgaatgatatttaaagtgcaaagaccgatgtgcatagcaactacctcattgtctgtgaactgttcaatcttttatacactggaaggaccagttagattaaacactgactacctatgtttaatatttaccccttgaatcctatatggaggtgctgacaaggaataataaattattgcatatgtcagtaatgtaaatttagaatattaagttgctattgccatattaagcctataatataaaatcaacttttccacattcaatttatcagtattatagtccactgagaaaaattttgagtagaataaattaggttacctttagatgagttacagctgtcatattccatgaatcaattagctttttattaaaataaatctgccaaagcaaacataccttaaatacttcatcattttttttatgttgctatgcctctttcatgaataaaatgtgaacttagaaggtggggtactttgtttttaaatcattttcatttaacataatgactatgctataaagcacttcctctaatcataaagattaaactatcctgatttaaacaactttggaattaatgtctcttcttgcattagaaatgcctttccaacactctcttcaataaatggtgctgggaaaactggatatccattacagaggaatgaaactagacctttatttctcaccatataaaaaatcaactcaaaatggattaaagacttaaatgtaaaatccgaaactataaaactactaaaaaaaaaaaaacttagggaaaatgttctagggaacttgtctaggaaaagattgtatggttaaaacttcaaaatcacaggaaacaaaaagaaaaatagacaaatgggactacagtaaaccagaaagctttcacacagcaaaggaaaaatcaacaaagtaaaaagacaacctgttgaatagaagaaaatatttacaaattactcctctgacaagggagtaatattctgaatttaaaaggaaatcaaacaactcaatagcaataatataaataatcccataaaagtggacaaagggtctgaactgacatttcttaaaggaagacatacaaatggcaaacacgtatatgaaaaatgttcaacatcactaatcatcagagaaatgcaaatcaaaaccacaatcagatatcatcttaccacagttagaagggctattaccataaagacctaaagtaacaaatgctggtgaggatgcggaggaaaggtaactcttacacactgttggtggagatgtaaattagtacagtcattatggggggcagtatgaagagttctcaaaaaactaaaagtagaactaccataagaaccagcaatcccaccactgggtattcatccaaaggaaaggaaatcagtcctttgggatatctgcattcccatgtttattgcaacactattcacaatagctgagatatgaaatcaatctaagtgtctatcagcagatgaatggacaaatgtagtgtgtatacacaatggaatactattcaatcacaaaatgaatgaaatcctatcatatgcagcaacatggacggaacttcagatcacattattaagtaaaataaaccaggcgcagaaagacaaaatatcacaaatttttatgcatatgtgcaagctaaaaatgttcatctcatagacatagaaagtagaaagatagtatttttagtagagatggggtttcaccatgttagccagggtggtctcagtctcctgacctcatgatccgcctgccttggcctcccaaagtgctgggattgcaggctacttgggaggctgaggcagaagaatggcatgaacccagaaggcggagctcgcagtgaggcgagattgtgccactgcactccagcctgggagacagagcgagaaaaaaaaaagaaaaaagaaaaatagttaccagaggctgggaagggtgtgcagtgtgtgtgtgcgtgggagggggtacaaagagaggttggttaatggatacctacagttagatagaaggaataatttcagtatttgatagcacagtagggtgactatagttaacaagatattgtatatttgcatttcaaaatagctataaaagaagattttaaatgtttctaagagaaagaaatggtaaatgttcaaggtgatggctatccaaaataccctgatttgatcattacacattctatgcatgtatcaaaatatcatgtgttccccataaacatgtacaaatattacacatcaataaaatatataaaagtatttctggtaaaaacaaaaacaaaaataagaaatagtgctctactaaatgttaggcaaatttagtatcagttttataaaatcaaatcgtggattggggagttgggagtaactgcaagatgacctctgagatttttttttccagctataaaattcaagaagtctctaagaatagatatggtgctaaaatacaaatagatagctgtataagatgttatcaagtggtgtataatgataaaaatatctctattattcagaattgggctatagattctcttaactctaaaagaaaattaagccccaagcgttctataatggtatgaaatagaatagttcaaattttttaccagtttgtaatatgagctggtttaaaatgttacaaattttacaccgaattgtaatatcagttctgcaaagtattacaatataccttaccatgattgttagaaaagacatggtcttatatttgctgtctttccaccatctcttcaccatctctccaccaagtcctaggccagctggagcccataatgcattaaacagtggaaatagcaatggagtgcatcacactctgatactctgaatcatagatcagagaagggttctatataacgatttctgaataagtcacagtgaatgtgtaaactgctaccttaaagttactatttatatttgaggagttaaaattagaatgacaagaactctcattattttacattaaaaataattcgacattttttttatggtcaaattagaacccagtaggttagacttagcaagttccaaaagcctgagctagtgagggggtaaagacagttttgccgtgggaatagaaagtttacaaactttctatttctaaggggaatctaaaaaataccactagcatctagttgaggagagcaggccccacaggttgcagacaggcatacagaagtacactaaaggtctgggaagatcagcaacaaccttttatgagtcactgggatatgagctaagactgtaaactcttgaagggaaaaattacatcatattcgtccttttatctagggtttagcccaatgtctgcagtgggtacacagtgggtattggctgagtacatgagtggaaggaagaacacactaggataaggcatactagtttaaatgcagtcatgatgcagagcctggaaagctttgtggatgttacacattgtaattacaaatatcatgttgttttcctggactctgacagtggttggagaagtagctagttcctgcaacaagtcttaataaaattcaaaataacagtaccagcatctatttttttatggcatattttgccctctattccttactggctaaaattacagttcccaaagtatgttgagctttttgggttgctgaatagaacacataggttgctacagtatactttaaatttttgaaggaaacacagatatccatcatgaattgtgcaaactactagcttgaagtaattcagtttcaatattatacaactattaatatattcctttcaatgacattgatgatgctggattttcagtggctgctctgatgaaaagcaaatatcataccattttgctgtggagcataaaatgagggtggtaacataaaatctgagtccaaggtttgagaaattgtgcagtgcacaatgctaagtttttagaacataaattcataagttgcttagccacagctactaaacagaagtgttaggtatttctttgggcctgggagcctggaaaaaaaaattactaagacactcgggacactgtgatgcaaaaatatttgggaacttcttgtgctaaaactttgcacgtcactctgtgaatctagatgtatagtgtgcaaatgttttcttccattctgtaggctgtcccttcattattgtttccttttctgtgcaaaagtttttatcttgtgtaaccctttttctgattttgtttttttgcctgtgcttttggggtcatatcaaaaaatcattgcccagaccaatgtcaggaagcttattttctaggttgtttatagtagttacatagctttgggccttatgttaaatacctaaatttattttgagttgatttttgatgtgagataagggtctagtttcattcttccacacatgaatatccaatttttctgacaccatttattgaagaaagtgtccttttcttacggcgtgttcttggcacatttgatgaaaatcaatcggctttaaatgcatgagtttttgctggcttctctattctgttccattggtctctccttgttttaatgccaatactatgctgttttggatactatagttttgtagtatattctgaagtcagactgtatgatagttccagatttgttcttttgctaaaaattgctttggctatttgaaatctattgtgctttcatgtgaattttaaggtttttattttattttatttttgtatttctgtagagaatgtcattggtattttgtttgagaatgcactgaatctgtagattgctatggttagtatagacacttttttcatgagcatgggatatctttctatttatttgtaacttatttagtttctttcatcaatattttatagttttcagtgtagaaatctctcaccttttttgttaaatttagatatgtttcaaaaacagaaaagatgctataatgactggattagagtgggaaataagaagaatgatccaaaatgagctcaattatgaaaaaaaaaacaggttgtatggggattttttttaagtatcaatttattctaactgcaagggggaagtcactgaagaattttaagcagaaaagtgacgtgatttgatatagtttttaaaatattgctctgttttgtggtgaatgtattacagatgacaacagcagtagaagagagatggtttaggatgtttgaatggtctaagtgagagatgatagtggcttgcattaggaaggtttcagttgaaatggagaatattggatatttttagaatatgccttggaataaaatctcaagtatgggtagaacttcttgatggattcaatatggagaggtgcaactaagagtagttactagttttacaaagacttttatgaaaaaaatgctaatatagtctgttgtcacagacttcctcgcttctgctatttccacatttagtttaacagtgactttatatttcccttctttcttctaccccaagtctcttgcctctgtcttattttttctatcttgcttaccctcaaaatattctcattacttggacatctcttctccttgtgtctcattccctaatttccttctcttattcccattttacttctgtacctatgatccatgtcattatattaaataattaaaatcatattgcttcttcactttgtccaagtcacagcatttacaacataataaggatattttctttcacaaaatttacatatacataataaagctgaaggtcactcctatggaaacttaagaatattaaacagactaataattcaaattttgcaaggaagggtctgactaatttgactttttgaatttgcatataggttttctttatctttaatcgtgacactagaaggaagccttagtattcctttttcctataactttttttcaaaaacacccttgtaattaaaaatgtgtggcataaaatgtattcaatgatctcacttttatagaactgaaattactcttggtatacccaaaatattctaacactactcaggcagaaatactcagtttatctagaaatactttaattcatcaaaattattcccaaaatatactcacactacccagccagaaataattggcttatctataaatatttgtattgatcaaaattatttcctaaatacgtcaatatatttctaaatatgtacatttaaactttacttcaataaaatattaccataatttaaactacctgtagcctcaattgtctttttatttttattattttttacattaacattgcaattacagcttgttttctccctccagcaatgaggagaccatgaaggtaaagtagacaatctatagagtgtagaaaatgtgataaggtgtgcacagggtattaggctttgttattcatgttatcttcttttaagtttgcctacccaacttgagtatttttataagccatatattttaaatgtcctatcagtttggataacatagctggaggagatttcaaaaatctagtcctattctttcttctatatatttatacaacttgaaatatattttttttgtaagagctagtttttatatggtaataatgtactgacagttttgagtcacaagaatcaaaagaacagttatgcttttattactctttgtttttggacctaggtaataatgttttttttttttttttgagacagagtctctctctgtcgcctaatttggagtgcagtggcacgatcttggctcactgcaacctctgcctcctgggctcaagcgattatcctgcctcagcctcccaagtggttgggattacaggtgcccaccaccactcctggctaacttttgtatttttagtagagacagggattcgccatgttggccagactggtcttgaactcctgacctcaggtgatccgccagcctcagcctcccacagtactaggattacaggcatgagttactgcccccggcaggtaatatgtcttttaaggtgccatcccaaagaggccagaaacacctcttcatacagagaacagtaggataaatagtaattgcaaagaccaatgcaattactacttatcttactgttactgtttctgtattgtctgtataacacaagaagaagatgacagtgcaagtttactcaaattcaatgcagcaagtgattcttaagcatctaaacattttttggagattgatgattaaaaaaagatagcatcagcattcaaaaatagaataaatactgagcagaaagataaaagaagcacacaagtaaattttattcaagtcaaatgagttgtgaaagttgatcgtatgaattggttcattcttgccatacccaactaaaacagtcgagaagccaggggggaaaagcactcagaatatataacattgctctagaaatgtaattctctgcaagtcaggctgctggaactgcctgttgtaatctgagaccagttttatctataagtgctgaaataagttgctgcaacataaggatgaattttgccaaccaccatcactcaccaatgggagcttgccagctccccagaactttattaatgcccatgaactttctcaaagaacaatatgtaacatttctcctttaatgaaacctgcaactttctctttattcttccaacataccaaagaccacctggtctgactgtatacctcgaattgtgattctttcttctcaaataaaatgttacatttagagatttgtctctacatttttattttgactttaacagagccaagagagcattgataaaagttataagaaaccaaggcagatgaaggaaattcatttgaaggataggtttcttataggtaaagattggcagaatcttattttaggaagcaagagtagcatgtgcaatattacacagctgattaagggtggaggcatttggaaggacaatttgtattaagcaactagtaagttagaggaaatggtagtttttacttttacattgattttttaaaatacacaccacacgactgaagtgaaatatttttcggtaagaggcaagtgtggcattctgtaatgaaatatgacaaaagtggaaagataatgccagaaagttaggtttccactacattgaggaagaatttaaatgctagaatgcaaatatataagcaagggggaaaaaggatcaaattgcaagccatactccctgggtacaaggcctgtctttattactgctaagtataggaacttctggtatgtgagtttactcattagtaaaatagaaatattgaaacctacagtgtgttaatacatttaaaaaataatggtgtgaaagtgcttttgagttaaaatatgatatatgtatgtacgtgataactgatattatatcacctcttaattcaataggtatgggaaaaaacaagtttttgatcaaggagtattattgcaatatttaaaagtgaggaatcctttcctgaaagccaagtgtaatacttcttgtaacagaataaatagaagataattgcttttgtgcagttgggaagttttaagtgagtaaagtaaaagagagggaactgaagattactaatgaatgagatagaagtggcatcagtgttggaatggatgttggaaaacaatgaagacttttaaatcttcattcattgggaaaacgacaggaaaatagcaaagacaaggcaaagacaggtaaccaagcatttattagcccctctttgttctgggtacttcactaggcaagttcatgagtctgagataatctagtccttcactgtggcatttcagtttggtgccaccctttccatttttatttaaaaggaaagacaactttgtgtagaataaataacttccccaagtcaagtaaaaagagcaatagaacttaaaagtaagttcatctgattccaaatcccacgcttttacagatgcaatgacatacttgttttgtaaaaaatactaattcaattgttataaaaagttgaaaataaatattcaactctcagaagaataaaaatgataaagacctgagggaaacatggaaagtcatgattacaaacccttgaaaggagatcagattcttgaagaaaaagtgagttttgaagtgtaactgtgaaaaatttttatttttaggaagtgagaaggtaaagtagattcaataaaagagtgaaaaatgggtagtcaatggctacactcaaggaaaccaagctatttctcagccattacattcaagagagcttataataattacaaatacttatagcagtatggtaaggaaagaactgccacagatgtaggccattctttaggaaagtttacttgtgaagtggggagagacagaacacctttggaagcttctatatactaacggtctctttgtaattaccaaaataagatttataactaatatactagcatatttagaaagttcatgtaagaagaatgagtgaaaatgactttatattcaaaagtatggttgatttacattatgataataaacttttcctgaatatacattatacagtagtgttttaatagtaccaaatgagtagcatgttccctgctgtttcactgctgagatataccagcattttaataatccagatacaaatccaaaatttggagtccaaattgttatttgctctcaagagaagcccaaatttatgttcacatctagtgtgacataagagatttcaatatctcttttaaaatcttcaaaattctccttttcctttatatcttcctattcagtcagaaaaggcatcaattaaggcctttcccacagaaagaaagtctatgaatataaggatcccacaagctgagctttcccaaaaagttggttataattttaagggcatttaactttttaatttatttttcagcatagaaaatgctgccaactttatatctctttggcagcatttctccctttaaaaacttgttatattctataggtatttcaaattagaaacaaagcttttaagatttcaaaacacacctgctgggactatcacctaggagagtagagcacaaatggtaaccaaaatataacaagtaagataccttacttctccaaggattttctcatagatttcctcagtgattataaaaatattgattacgtgcaaacaagactgtttctgtttcatcaactggtatctataagccatttactaatacgatgaatttgaggtcctgctacagtcatgtgattagaaaattaatggaaaatgctaaactgcagttttgctgttttaatcaattcaattaattacatttattgagctctctttgtcacacatacagaaacatgaatactcatatctgattacaaggatcttgcacttagaaaagtttctaagagacaagaaaaaaaaattgggtactataatgaaggaaaacatgagctaagaagttaagaaccagagagtaactgattggaaaagtaagaaaagctttataaaagaggattttgagtgagcacttgaagaatatgtaagataacacaggcaaaaacgctaagatataacattctaggaggaagaaacaacagaactaagtagtcccagaaaatcagatatatttgaagccaactatgtgggacaatttgttaccacacaaaatatgaatggaagattgggaatattttgaagcattttgaatgccaacactgagtactttttgtataagtaggcgacaggaaagctctgctggtgttgaagttagaaaaacacattattgtagatgttatggatggaaactgtggacgagaaggagaaaaatcggcagcttgtaaaactgacatcacaattttctaaaaatgtgtaaataaacgattaactaagataatatccatggaaatgcagatcagagaactattcttatctcttctacatctcttcataattgaaatatctcttttatccctaaagttttcattcaaagagattactgcaatgttaggaaaatcatgaaacagtaaatatctgaggttgtaacaaacatgctagagaaagattttagtaacatattatcattaaaataacatgtgtatatgtggatatatatcacttagttcaaatataatatgaaatcacgtgtatgtctttatttttaattttaatagaatttattttctagagaattttcaggtttataaaataatcacagagagtacagagggttcccaaacactacccctctctccccatcataatacagtttctcccattattaatattttttattagcatggtaaatttttttgcaatgaatgaatcaacattaaaatattttattaattaaagttcataattacattagggttcactctttgtgttctatgggttttgacaaacacatagtgtcattattcactattacaatatccgacagaatagattcactgcccttatatgtcccctgtgcaccctctcttcatccctcacttcatccccctgaactcctgacaaccagtgtttttttttactgtctctgtagttttgtcttttccagaatgtcttatagttgaaattttacctaggagtgtaattgttggtaaacccatgtttagtttaaaaaaaaaaaaaaaaactgtcaacggctggcatgagtgtaaattagttcagccactgtgaaaagcagttttgcaatttctcaaagaacttagaactaccattcaacccagtaataccattattgcgtatatacccaaaggaaaataaattgttctaccataaaggcacatgcacaggtatgttcactgcagaactactcacaatagcaaagacatggaatcaaccaaaatgatcattagtgatagactggataaagaaaatatggtacatatatactgcgaaatactatgcagccataaaaaaatgagttcatgtcctttgcagcaatatgtatgaagctggaggcgatggtcctaagcaaactaacacaggaatagaaaaccaaataccaagtgttctcacttacaagtaagaactaaacattgagtacacgtggacacaaagaagggaaaaacagtcactggggcctacttgaggttggagggtgagaggagggtgaggatcagaaaactacttattgggcattatgcatattacctgggtgacaaaaaataatctgtacaccttttaaatccctgtgacatacaatttacctatgtaacaacctgtatgtatagccctgaaactaaaagtttaaaaataataaattaaattaaaaaactgtcagaatgtcttccaaagtggctttattattttgcattcccaccagcagtacatgagcattcctgttgttttactttctcggcagcattttgtgttgtcagagctttagactttagctattttaatagctatgtaatcgtatctggtagttatattaatttgaagttccctaattacatatgataatgagctttatttatatgtctatttgctgtctcatatatcttctttggtgacaattctgttttgatgttttgcctattgtgtaattgagttgttttcttattgttaaattttaagcaatttttccatatttaatatacagaatgtatttttattagatatgtaatttgcaaatttttttccaatctgtggaatgttctttctttgtcttcacagtgctttttatagagcagatattttaattttaatgaagtatgacatcaatttttttatcgattatactttttggtgttttatgaaataactgaactttcacttggatggggcaccaggagaacatgccacgagttcttttgaattttcaggggcagagactggtaattctatccaaaaaccagtgtgactttcatagttggaggcagtaattcactgagtaatcacaatctaatgttcctttgagataaaaagggcccaagaaaagatataacttttaatttaagtcctgactaaaagtacattacttcataacaatttgatttatcttttgtcggtgatttttattcctttacaacctttccattttttattcttctgggtgatttccatatcttatatgagaataatttttgtattacatttttgaaatacatacaaagttctttttccccctttgaaacagatgagtctacaaatacttcaacttctgcttctgaaactgaccttgacctgaaactgatccactctccttttaaaagtcccccaatttatatcgctacttgaagatttctttgctcccaatccatgtttctaatctgtatgcctgaaagaattactagcaagttcccaaatgcactgagtttatcatacttttgcacaatcctttttatgtttgtagctaggaagctcagtaatgctaggtagaaattataaaaccaagcagattcattatcatcaatctcaaaagggcactcaaatttacttagcaaggcaacatttctacatcaagcttgctctcccactcttggtaaaaaactatttttcatttttctctcagtcttaaactttctctcccatccatcctcatctccttatacacacattttcatttgatggccttcctagatgcggcgttactaacgtaaaagtattaaacatgagctttctcatcttccaatcacaaaatatgtaggcctagcagcatctcttctccacttctctgtcttcctttctattagattgaaaataattccccactacctgtccttgggatcccatttattttctcctacaaaattatgtttctttacctctaccctctctttccaatgccaccaatagatttctctctatagaattatttgtaccaaccaataaacatgctttggtctcttgaatctctaaaaagaaactctctcttgatttcctaatgactacaaaaatgcctcattatttcagtagtttatataacttgaagtcaccaagctgtaaactatctgaactgtctttattcactcttcagcatatttaagttggttttcaacctctgtcattccactgaaatcactcttgtcaacaaccttcatgttgtcaaattcaaaacacagtcttctgtcctccgtgctcaatttttcaacagtccctgcttgccctttaaaggacttcttttgcttcagttacccttttaggtattgtcatagtcctctggtctctcatgagcaggatttggcagctccttgtattctatcagttcgtcaaatagatatttgagatgacatcacaagttctcttgtctttctacttattttaaatgatgttatctacacataattttttaaagaaaatgatgtttaacatttttataatatgtatatatgcctatggttccctgatatctctgaatttcaattatgttcaactaatcacttaacatatctgcctagaaatctctaaatcttctaaaatgtacaacttcaaaactgaactctcaattattctccagaaatctctggatgttcacactttattaaacattataattcactccatcctcatgttgttcaagccttgaaaattgagcctcatccttaattctttcctttttcttactctccacatcaaattttcatgggatattaaggcttttatcttcaaaagatatcttgaatctgtctcgttccctgccaacaccatagtccaaatctccactgtctttcactcagactactgaagaaacctaactaaaatttaagttttcttcaatcactgagctaaaatagaaagcatgatctactgaatatataaattggatcaggtcacttacaaatctttacaacttcccatcataggcaggtgagctaaatgagtaaagtagcctatgggtacacatggtgagccagggagatcctgcccagcctagagagacaaattgttaactggttctgagcagatgttaccctaaaagtgtgtaggtttaagttgccaaatataataagagaatacagaaatatgtgtgtgtgtgtgtgtgtgtgtgtgtgtgtgtgtgtataatattctgagttttaaatgttgtctccattaaaaaaaacaatgtatttaaaacaaaacatatcttcagtccatattaggctgaatggctgcctgcttactttctctgatgcaaatatttggtttctccttatttcctctacttcattctattattttctcctatttacgctctataattgagtttcactgaactctattttctggaacaggtaatcaagcactttcttttcaggctattccttccctgccggtgggacacatatacttcttccaatatccacgggagtaggaccttcttaaattatgtaggtacccaccttgagacatgtttattctctgtcatagaatcttattattttctttttgacttctgagtaattttctacatttgtgattacaactgaatggcttgaaatctactgcacttgaaggtaattttgctcattatattactatcacattatattatttttaggttgatttccaataaatcattaatctaatttgcaaatcattggaccaagtaaatattaatgtcatcagtaatattgtacatgttactttgtaatagcagtttgtattaatagagtacttaatttgtcaaaagctgtatggttactacgaggcataagttatctcatgtgatcttctcctcaaccgaataagatatacattattattctcaattttagaactgaggaaactaactcttgcagaagacaagataatttatttcagggatataatctgaatgaaatttgtttgactttaaagtgcaatatattataatatagtgattaaaacgtcaggttttggagtctgcaagtcaagagttcaaatcccagttccatcaaattattagccaggtaaataaacttcagttttctcatttaaaatgtagggataaaatagtaagtgcttataagattgtataagaaataaaaaatacttggaaaaaataattatttaattgcttatcactttgtggtctgtaagatataaccattagtcattaaggctgaaagatttagttgattttaataaaatcagtataacatgtcaaagtctgactagtccccaaatcttttgaatttctctttagtgtgttccttcaaatattattatctgtattaagtttcgagcgtggttaaagttatgtaaacattttagaaaattacaattgtgtttgtgtggaaattgtattattgtttttcactccaagtatagcaaaatgtaactttaagtcattctgaaagatccatgggggaaatttattataggtctatattctaagaactatttttttcttcatagagatattctttagagaatcacttgtgctttatataaataaaatgaataagtaaaaataaaaaatatgtggtatctgtaactataaacattagcataaataattgaaaaataaaatttaccatggacactgtaaaaataggtatttgtgagttttcgtgagattattatctaatattttgataggctttttgtaatcttttgtttgtaatagattctagaggactaagaaaaattcaagtttattaaaaagcattatttgatagttatgtaaattaatggctgccacagtatactatgtaaattctctaggttgtttaacttaattttaaattgataaaattaatactaatttgtgatggatataaaacttctactgaagttataattacacaatacaaataagatgtttatagaacatttgctggaaggttttacaggaattgcctcatttgaaactcaccattatatgtggtaaatgtgatttacatgttgcagaagaagaaactcaggcaaacaggatagagcaacttacccaagatcagacaactaataagtagcaaaactggaactcaaagttatgtctttaaaatctaaatcccatgatttttcacttactatatgatgagaaattaatcatttaaactaaaaaaaaagtgttctaataaagttaatgcattacttaactaatccctttaaaataattagatattattaataacaatacattgataaaatgcagtttgatgccactaagacttcatctttatattattagctactttaaagatttaaattaaaataaaccttgacaagataaataatgaagtcaatattttaaaatattacctaaaatctgatccgattctcttcccattttctggttctcctggatctgggcataaattggaagctgttttaatacctccctcatttactgcaacagcagggaaaaaagaaaaaagaaacaaaatatatgtgattagaaaatcgatgatattaattttaaaatatacataaaatgtattattgtattttgtcactataatcactgtcatttaagcatttgttaaactataattttataaaacaataaagaaagcaaaagcattttatgaactaatgagaaaataaatttgctgttcatattcaatgacttgtattagtcttgcctattaacacattaatatttatcacttttgtttttagtttccatcaaattggaaaatctctggaaacacattctcagggtatcagtgtccagagtttccattaatcactggcaacaaagaagtcaaccaccagttatgatagttttatttggatccttattatttttgaaggtgtaataaaaaatacgactttatgaaaaaagttcaaagttctaacacttcttatctggtatatgataaagcaatttgatctgccagcattaaaatacagcagtggtgcaaattactaggcatgcctttaaattattacataatggtgtaaaccaaaacaatggctttaccctcaagcaacttccatgaatatgatttatttagcttttgtgcacattttcagcagtttcttcaaagcagaaagtcaaagatgtattaattttttcagtgaatgtgaccacattggatatctaaatccccaagttagatttttattattcagtcagatagtactgaaatatctgagtgatattgtttaataaattcaatcttaaagtgaactggaggataaattctattattttactttttatcaatttacctgctttttttttagaaaaaatagtgcctaagtagagattccagagagaaaaaaaatctaaaccatccaatgcttgttgtcctccactgtgaactgaaaacacaggtagatctttcttgaaagaataaagatgactacttctacctctagatattctaatgcaataaatctatggtaggactctggcatcagttttttgggagtttttggtttttattttaaagagacagggtcttgctttgccatccatgctggtgtgcagcagcacaatcatagttcactgtagctttggaatcctggactcaagccatcctcttgccttggccatccaaggtgccaaagtgttgcggttgtaggtgtgagccattttaaaaataataatgactctcaaggtaattctaatataaagtcaaaattgagaaccactggactgctgaatatagtaatttaattcaaattgattcatcagataagaagatagctatcagacgactgcccaacagttatagttgtggtaaagttgtcgttttctaaattaaacatcggattttgcatgtttttacagcattctaaaaaaataattttcttagtattaccaaccatatccttcttgccaactgtattacagctcactaattcaaatcataggatatttatgtttttcttattctctaacttgctatacaatctctctttacctttctaggttttttggccactcttacttttgccgattctactacagcggacaaattgaaaggcattggctcacaactctctatatttgaatttccctcatgccttgacagaatgacctatatgctaatgacttctaattcttttgaagttcctttctcaatctttcaatggcctatttgattatctaccaaactttccattgtcatctaatctatctacttaaattcaacctaatcactttgatgcttttatgattccattttcatccacctacaatacatcttgaataccagaggaggactaaactttctaaaacacagttcttattactgctcaaatctccaattattctagattttctactgtatcaattttatttctcactagtcaccaacatgcatccatcacccaagtcccgttgtctgttcgctgttctgcaatttgctgaacatactgactccacacatttgtgttttctccatgtctccatgttttcctttccttcccctttagctatcaaaatcctatctaatattcaagacttagctcaagtcccacttcttccaaaagataatcactcattttttccatgttattctaatttatctttttaaatagcttggagtatttcatttggacaattttttatttaatttaaaattatcttaatacagtataaattaatagtttcacatacctttagttatctatagaaaaagattatatacttgataaaaatagagaaaaaacattattttaatatacctatttaatatattttcaacaaatatgtcctagttgtttgattgacaataccaccttatatttgttatcaaagaactgaacattttctgtgaaaaaatatcctctttccaatctttacaaggcttttggaaatattgtagtatatgtttattaaaatgtgactttttaaaatgtggcatgaaaatgaggaaaagaggtggcatgacttaagcctaactacttttttgtattatgacatataacacagattatagggtaatggacaagcagtttgtgaatacattattagaaaatagaaataagaaaaatcccattttttacatttcactgtcattttgtgttaaactaaaattttgttaaatattttatataaatttaaatgatagttaacacttacataatactataggtccagaactattctacatactttatgtgtattaccccatttagttctcacaaccatcttaggagtagctactattattttacacctcctacaggtgagaaaactgagtcatggagaggttaagaaatgtgtccaaagtcatactgctagttaatgggaatctatatttaaactcaggcagtctgatttgagaaattctactattaacccggagctctatagctgttcagaaagctcggcaaggcagaaactatgtcattaactacaattcaaaacacttttccaagcattttaccttaaaatgcagagcatgtgtataatttcaccactttcacctaattaatcccagttcttattattttgattgtcaagttatttctgtctgcttgaaagtgtcatttaaaccaccatttctggacatctgcaagaggaaaaactttccaatttaaaatgtaaggataatgagagagcttctgtgtggtacgtgtatttaatgttaactgtaaatatttaaaattttttaaattaagaaaaaaagtgcaatctatctttcatttcttttgatatttatgtatttcagaattgcccatagctaagtgatgccaagacaattaaatgaagttagtattcattcagtcatctgctttcatttcacagtgccattgatgcaattggacagatttatcacttttacttcttttaatttgcatagcaacttgcagcattttaagaatatgagtgctctctaaaagtttaattacatgaatagtgtaagtatgatttcttatggcttctgattttatatagcacataatataccctaaagataaaaataagtggactctgactaaaattcacctccacattacctcttccagctgcttacattgtcacttttctcagatttttaaaaattaatttaaatttttatttcaacttataatatcaagtgctttggatctttttctgaactcaaacaacactgatatcaacattgtattgttgttttttatactaaaacccttcacattctacaaagagttatctcttaactaatttagcttccctataaaatattgaatccttaagggttgaaaatatattttattcactcttttaccttcttagtctagcatagtgctgccatggaggaactgtggaataagtggataatatgaatgaataaaagtatggatttgaagaataagaaagaaaacacaatcatttatggcaggctcacagtttcctcataattccacaataatattctagaggagcctactaaagaattgagtggataatatgaatgaataaaagtatggatttgaagaaaaagaaagaaaacacaatcatttatggcaggctcacagtttcctcataattccacaaaaatattctagaggagcctactaaagaatttggaaagactactagttcattaattttaacattttaaaaatataaaacctgtttacttaattttttttaaatctatagtttcttttcttggtgaaatcaatttttgaaaaagaacacggggtagataggggcaattcagagttcaggtataaaagctgaaaaaaaaaaaatctgaatgagccttttaacagccaaactctgcccatgaacactactggagcttctttaatctcttgttaattcatttcttacttaaaatctaaaggtgccattatgagacctttaaatacacacatactttggcagtttgggaatttgatgtcctccatgcttatactgactttgggccgtgcccatcatagaattgatctttttttcaaagaacatgagctttattattttttcttatttgaaagacgaatgtcagataaaaactttctttttaattattttgtcctaggttgaataaataatattaaagagatcaatatctgaatgtgtatttgaaatagatatataataatgatacaaattaaaacaatataactctactgcaaacaaccatgaaagaatatgtttttgaaatgagttattaaatactttagaaacaaattatagtaaaatgaaatttaaaataatgttggcttgctattttatgacaggaaatttgcaaaaaatattttgactgaagtgagaattacttatcttcaaaaaaatgaaaaaccaagagtatttaaaaagatttttatagaaaatacaatgaataaatgcaaaatttattttaaaattatggagcaaattaacatttttgcctcatattagctttttgcctattttaaagcaaatatttcttaaacaagatatttttattagaattttttttcctagatatacacccatgtctaaattccctttttgttcaccttcacaacccatgtacaagaaaagtggaaataatatatatttccactaaggcaatataccaacagggatatagagttacatacatcttacaatgccttgataaatcctagatctcttagtacaaatagcctgaatttccctgaacatttggaagtttgaaccatgcaacatgtcaaataacatacgtgtagacaaattgagaagagggtaagccattctaatacgctgtaattctacttagaattcagaaataaatatattggctacacaaaatattagaaaaaaatgtagtaaacataacatttaattttgctaacatttaagttttatttcatgatgacctgaagaaatttgatatgtaagagtcatctcacctggtgattttttaaatttgtctttttttatcatagaaaatacatctttctctcaaaaatgtgttgaataatttctataaaagtcatattgtagcattgcttattttccttaaaaactaacagtatcaatcttgaaaatgattttagcccccaaaatacatgaagaaatattaattatacaaccaaaccctttgaaattagctgtttagtgcttttgaaacaggtaaccctaccagatcaatggtttcctagtgatatctcttctggttttggattaatattctcaagtctaactaataaaatgtaaaaatcacatttgaaaattatgacaccattaatatttgatataagactccaagtttgtttctcgataattgatataactgctcaatttttgtcaattactgtttatatgtacaagtcaataaacatatagataaagtcctttttgatatagctataataaatgatttttgttaaagaaataattataaacttatttcatgaggtcatttggaactgaagaaaaataaagttaaaaaatatactcttgttgaagaataaaagtaacaacatgtatgaaatttgaaataactacttatatattagcaatgttattttggaagtcaagtattgtgtcataaatggcttgcttcaaagtttctaatatgcaacagtattgttgacaatttcctaattttgactacaaaaatacatagctctactaaaaaaatttcgtgtttggttatggtaatttaaatgaatgctctaattcagtgattcttaatctgagattttgggatgaacttcagagccctgattttgtaagtgaaattgtgtacttcaggccatttttaaagattttcaagaagtgaatagcaataattaatcaatcattttataaaatatttgatttcataggtttatctaaattacctcaaattaagacttgttttttctgaaatgaaaattgctatcttaaaagtaatatttcttagaaaagcacttatgttgaaattaagatatagtcaatcaagaattcctacaagaaaccaccaattttagaaatgttactcattttcgcctcaccttctagaactaaacttgagtgtcctcaagacttaagatcaaaagaatatttttacatcttgaaatataaaataaactttatcaaaaataatctgaggctgggagtttgccacgttaatccattaaatcaatatacattaaaatataaaatattgaataatcatcatgcatgttacacagatattaatgcagttaatttggtaaatacacaaatattttggtaaaacacatacaaacaacacagacaccacaaacttcactcttgcactagagaaagtaacaaaaaagaagtacactcacagatagaaaacttgttgctgttgtctttccctggaaacaatttaaatcctctagatttaaaatctatggcctttttcactagttaagaaaacaaacaaaaacatgtatcaggaaatacaattttaaaatgaaattcaagttaacaaattttgttagcatggacttatgcaagataaagaaaccactttcttaagcctgatatagtacccagaagaattttttttaaagcaatataatcacttagtagtaaaatactaagcagtgtagaatgattttaaatattctacagggaaaatcctgcatatacatagttttttaagctgtgcttttttaaactgtccagatttttatataaaagtgaaatcttagcagtttatgataaaccacttgaaatcatcaacttttacggaataaattaaactagcaaagtaaaaatgctggagtattagaatagtgggaaggatttaataggtttgttctttaaaataaatttcctaaaaatttagtctatttgaaatgttagaacacatttaagaaaatgacttaattagaaaagtttaaaatttattttaatagctctgtcaatcatttccattcattatcattgcttttgacactacaattgctgttagtccatattgcacaaaatgtatgaaagtgaactacagctattttgagcccatctaaaatatcttactacaatttttagatatagtagttgtacatatttatggcgtacataggatattttgatataagcatacaatgtgtaatgatcaaatctgagtaattggcacattcatcactgcaaatatctattatgtctttgtgttgaaaatattccaaatcttctagctattttgaaatataagatactgttaaatatagttgccctattgtgctatcaaatgctagaacttatgtcttcttatccttctatcttactgtatgtaattttgtccccattgaccaatcactcctcatcacccttccctacttcaattattttcttttacaaaacatggtatatacaggaaataacttgctcagttacagtgtggaaatctttacatattactttttatcaggtttatagtgaaggatgacagccttaaatgttatgcaattaggttttcttcatgctataaatttaaaaaaaagcaaaaatgattttttgttagatggcttaaaattaccacttcactatttctgaacgtcattctaagcaattagttcaaattatggatatttattggtttatgaaacattttaaggtaatttttttcttgttaataacttcaaaagtaggatagtagagaaagggcctgatggtttatgtgaatataagatatgaactatctatacacacagcatatattttaaaaaaagaggaatattatcgttggagcaggatttataaggctgattcttagttattattagttgtgggattttggacaagaatctgcctttttacctgcttttttctcttaaataagcagctaagactagatggcttctctctttatagtttaagattctttaactgtgaatccttattcatggtgaaaaaatgactacatccctcccaagtgacgctttttgttgtgattctcttctaccctcatccccaccccgatggtaacctaaagtttaattcttctgaagtgttcaactgctctaagtttagttttgtcacatgtgaattttctgctgtctcaaaatactttttaacaaaatctgcattttgtattttctggcataattctagatttttccattggaaacatgaattataagtaggaatctacctctacttttctctgcattataagatttgactttataagtattaaaaataggtctgaagatttcatggtgattttaacacgtctggatttcaaaaagaataaagaaaactaaaggaaaagattatcagaccaaaggagaaaatgcaaaagaataaaatcctacggatcaaagagttcaatgttgtaaataataagttactaatattggggggcagtggcagtgtgtgtaaaaggggacagattagcatgcctacttacaagtatcttgatttaattatttggttgggtaaggttttcctgcttctaaaagcaccttagttttctcttttataagcatctatatgtcaatttatctttaataatgatacatctatactttttaaataaaaactataataattgtaatacagatgcagaagatgaaaggtcaggagaatatccatttttggacatgacaaagtgtgaattaacaacataaaatttaaattcacaaaaaatttaaaatatgttaaacagaagacaaatattttagctgtttatatttttaacggaaagaataatgtatatctcctaataaataaattaaaaaaataaatattgcaagtattaattacaagactattctaaatcatgtatcaggtatttaatattacaatatataccataaaatatagatttcacgatttataaaagatacagagcataaatcttgacttgtcatcaagtaatgagtgcttctaatgaccatatttaacttagaaaattaacctgattttttaacctgatgcatttcagtaataagcatgtaaaatttattgtagagttaatgttaaaataaattatggtattttatacaggttaaggaaaatgtttacacagtgtgtcatgtgtggcaattccctccactgtatggtaagctcctcaaaggcagaaaaaatattttgttcatgtcatatttttgtttgtttgtttgttttgagaatgagtatcgctcggtcgcccaggctggagtgcagtggcgcgatctcggctcactggaacctccgtcccccggattcaagcagttctcctgcctcagcccctcgagtagctgggattacaggcgtgtgacacacgcggctaattttcgtagttataatagagacggagtttagccgtgttggccaggctggtctcaaactcctgtcaggtgaactgcctgccttgtccttccaaagtgctgggaaacggtgtaaacccacagctcccgggcgtgtttgtgtgttttttgagacggagtctcgctcagtcgcccaggctggagagcagtggcgtgatctcggctcactgcaacctccgcctcccaggatcaagcgattctcctgctacagcctcccaagtagctggggttacaagcgcgcaccaccgcgcccagatattttttgtattttagtagagacagggtttcaccatgttggccaggctggtctcgatctcttgacctcaaatgatccacctgccccggcctccaaaagtgcatgtcgtatttgtatgagtgtatgaatgaatatatataatattgttaattctgagtcttttaactaaaggtattttgttgggagaattccctttattgatcgtgaactatgatgggaggaagtgattttaaaaaatgaacacccaagatgaagcactttcatttgtaaatctcaagatgaaatacagaaaaactatgtatgctctaataattttagaaagcattaaatgcaagattgataggcatatgcacaaagattcattttcttttctttcatatgctaaacaatttttaatcatttttaaaatttttcattacatgttcagtttgactgtttttttgtttagtgtaatagaaatattttataatacaagaaaggcctggcagggaagaatatcaggccagcaatcaaatccctctttatttagttgtaagccctggacactagcaaaagcactttgttttgtaacttgtattagagtagttttaagccacgtagtggattatcactgtggcgtcttccaggttgtccgttgtcttcaagatcaatataaattcaaaattgcatttaaaaacttacaaaaaaagatattgattgactcttacttaaacctcatctaattttcatgttaatcagctaaagtcattatttgaaatgatttaaattaaaatgcctactataaaaattaaccatatattcacgcatataaatcatagattgattttgtttccaatatcaacttttttgatgaaacaggcatttgtctttatgttttatgttacaaaaactttgtaagtgtaacttgagaacatctggtattggtgggataaaatagattgggaagtactatatttagtgttggtactggcctttaatgttaggaaatcgatcatattaaataggtgtagtagaaggaatttaagtacaagttggagatttggaaaaggtgaccttcaattggtccttttatcactaagcttctataacttaaagtaataaaacatttcctggcttgaagttcctctaaaaattgagtccttcattacataatctcaaaagttacatatctgaaatatattattctatttcattgctatgcatatatagtgaaaatatgtaatatgcagaacatttatctttgaaaaagaagaaacagacatgtttagtattagttagcagaacattgttttaattagaaataattaactttcatgtttgcatggggctctcttagaagacagtggcatttattaaatgttttcagaacagtctgaagcgctcctcattttccacttggattatattctaagacaataatgaaggtaaaatgaatggtatactctaactttgtatttattttattcttccaagtttgtggtatttattttaacaataaagtatcttggaagtgtcagtagctgtattataaacctataattcaatcatatcataattcttttaaaaaggaaaataagttcttatgaacaagtaactagtatcttgtttatgtttttgtttatttctgcttcattgtaacctttcttttcaaatgtacaataatgcctttctcgtcttcttttgtgctgtgtttgatatgatacctggatgtgcgtttcccactttttattttgaatttattaattataatcttatcttttactttatagtaaactaataaactatactactaatacaataatttccttttaatgttttggatattgaaaataactaacatgtctctaggcgtgtatttgattttgagaaagtggcacatatcactattgacaatagatttatttacatgagtactaagactaatcagtcactgactaggaggttaaagtaatattaaaacagagtgtgttatttttggcattttgcttagtggattaggagttagcagacctatgttctgagtctataagacatgggacatgtcgattaacttttctattcagttctaagagatgtaattcttaactatttaggagtagaatttgggtgaaaggaaataaagactaatgtcatcagaattatcagttctattccagagatttaaatgtgtaggggagttataaaattatttaactgtataaagatgacttttttttgtttgtttaaaagtaaatagtggctctatgttagaagtcagcaagtacaaaaatttaacttttttttttttctacatcctgtactggctgaacaaaacacttttcagaacatacttatcacagaggctgctaatgatgacttctttgatgtaatccttagacaaagaaaaatcaagaaactatactgctgctagattgaaaactaaacaatatttctgcagtatctcctttaacatctttcatataagatttactactgtattaataatacaatcttctgagaaaacaatacatcttataaatgtttctgtagcataatttttaaaaaagtgactagaggtatcctgcaacaattagataatgtttctgggttacacaggaagacgatataatagaaaactcagtgacataatgttaagtagctcatgaatctttgtgaaaaatatttcatttcaaaatatgtttaaaataaatgaagataaactttgtataaagaaaagcaatggccataatttgatgagaaatgtagtagtacaactaagtattttaaaaagcacacaaaaaataaaaattaaaaaaagttcttaaagtacagaaaaattcattggtagagataaacatactagggatacacgagagttaacatatttttgaattcataaatgatggaactgaactagttaaatttattaggaaatagtatatattcatttttataattatgtaaaatcgtaatgtactctccatttaaaaaatcattagagacaagtaatatggttcagaacagccaatacatttttttaaatcttaaactcctaattatgccacaatgctcatttgtacatagcacttactcttgcatgtttgatgtgtaaatatcaaatgtatgtgatgctcaatttttaggtgaaagaaaatatataatcacaattttactattgtgcttaaattacacaataaattttagaaatcaacatgtagcaagaatctttaaatgttagttatttgtactaatattatttaccatttataatattaaggtctagttagtctcagaagccattctgatttgtgatgcaatataccaaaaatttgttaactattttgtgttatgtctttttcactatgtagggatgatacacaaaatatattatctatgttctctgaatttctaacttaaattttacttttctatttaaagttagaaacctctccaaaactttgatcaaaatggaaaatttagtagaaatgtataaaaccatataaatacaatcatattgattatatgaataattatttaacgtatttcaagattctccactaacaagaccattttctattttacaaaagaagatcctgaagctacaatgtcttagtgttgaaatgaggttgacctagtttctaaatatttggaatcttatttttcaatcattttaggctaagaaataagtgtaaatttttcacttggaaaactgaacagagtggtgagtatggagaggagacactgtgttttaataaaactaatttgttaattttcataggcattaaggattggataaagttattgatttttatttaggagaccgtgaacagactgcaaaactatataaaaaatcatgtaactaatcattgcataaagactctaaaatttgtatatgggctttctttcttcctagaaatggagcaaattcaggaaaccatagcacttacgcagataacagcagatgcacctgcaatgcttggcgtaacaggtcttacagttatggtatgctgtaaaatgtcaggattatatgaaaaatgtgggatttttatattctctttagggattcttataattggcataataaaagtcaccatatgggaagggttaccattggtatagttcacagatacttttaacactttaaaactgtctgcccttaatttaattgtttttaatctttattttctgacagcttcaaattaactttttaaattgttttcggttgtacagttaatattaatatccactcaatttatgcactttcttgggactttttttttctgatatattatgttctctagaatacaagtgattttcttttcttttgttttgtttctaattggtattttcatttcaaaagttaattttatcatagataatttgattgtaaattgtaacatgaaaaatgataactaatattttcttactcatgataaaatattattacattaaatatttgtttcgcactcaacataagaaatcacttatgtatattataaggccttctaatatgagattaattaggaaagaagaaactttttgaaaaacagcagccaaagttaatgactttcttcagactgtggacagtggcatatagtcttccactatgaatttcattagtgcattgaataattttataaatttacaaaaaaaaaatacagaaagaaacagaagaaaattaattgctttaataaataacaacagtccatcatccctgtgatttcaggtcattatattttactaaaattcactagaaatattaatatcagtgcctagattctgtttaaaataaacatagatgggttctgatggttgtatttaatgcagtgttttactgctaatttcatggctattcaaaatgccaacacactcatcatacccatctatgttttatatttccctttccaggtccattctccctattctcctccttgttctctgcccagaaatttgatctgaatggctacatccttgctacacaaattgtgacattgcattagaagcactggcgtcacctgggagcttgttagaaaagcagaatatagagcactactgagaactattgaattagaatctgcagtttaacaagatccccaggtgattcttcctaacatttaagcttttgaagcagtagactctatcaacagactcccttaacctctgggggattccagcaggcggatgaagggagggaggaaagtaagaccagaatttttattccacaggattcctcaccattgcaattattggagtttgctggactcttaattaaagggcatttgtcttttaatgcaaggctacaataggactttgtccaacatctcactttcttccttatcccaacaacgtgggaatcgtaacagcccagctgctgctaccataggttacagcatggttccttatggtttctttacattcactcattcggaaataatcctttgtaagtaaaacttcctcaaattaggcaacattctattgttttgaaatgtactctgatgaacatacctctggtacatggaaattattagagatttaattgaaatctacatctcagatactgtattcaacatctcttaatttttttatgaccaccattatacttcaaaggataatatctaggtagaattattgttggctgttgctcatcatcctaccattggttgttcactcatttcttagaaaatgttttgaaaatctagacaacgcaactgtgctgttttctagcaattatgtctgtaagaaacacagagattcacaaagatagagtagataaacaaaatttaaatgcgttggctgtattgaaattgaaaagtaattcaatgaaaagtaaaactggcaagaaaaaatatggagttaatagaaatctgagatgagttgaatgttacactttacttttgtataacttatacatgagagcaatatgaatagtgttaaatcaaactgtatatattcgtatccaatattccatatcaatattgcattaaactatgtattttttcctaaggaaataagctacctaagacatttaaaactgtgctaatttttttaaataaatttgttcacatttatctttaccttacaggatttttatataaccagagtatattttcttcttgcaaatgatccagaaaggggcagtatcatttactggctgtgcatctaaagcattaggtactctatgtgtactatctcattgaaatcacaaaatatccatgcaaaattatcgcccctttcaaaaaatgtagaaatggagaagagctaaattaattgcccaaggttatctatatgttaataaaatatggtcattcatttgactctaaaacttcaatactatcatctataccatctgactatagataacataattccatatattcagtcagaactctctcaagtgcgtatcttagaaaaccataaatagatgcaattagtgtatcctatcctaatttattaattttgatataaaattttaagtaatcaataatatttgaccctaaatatgtttaccttcataaggcacaaaagctttattaactggatttaatattgaatgaagacatcaactatctgatgatagtgccaagtataaccccgtggcctgaagcctcataatactttattttaaaggtgtgaacagatgaaattaaaaggtgtagcaaaaccaactgctatgtgaaattcaaataatcatctagtccttttagtaaaatcatctttggctgcattcctttctaaagggaaagttcagaagagttgatgagacttttttttcccccttaatataagcctcctcaatgaaaaatttctaacatctctgggctctggataaaattaatctagaaatttctgtcactttagtttcatttgctattatgagaaaatacaattggaagaataatttaaataaagagagatcaagcatcaacagtaaaaagcaatagtccatgctttagaatacaaatgatgtaattgtgaagagaaaaatatcctacgcaatgcaccctaaacctaacaccacgctgttctgccacatatgaaggttctgctcttcctaaaattgtaaagattagttgtgtggtttcactctgcgcacagcagggtagccatatgctctagaaaactacatgcaaggaaagcagcttgttgcaaaagtgggtgaaaatgccctgaaataattctgaacaagataaaaatgtctctacataggaccatttcttcatattccaaaaggcagaggagtctgctttggcatcagctttgagcacaaatagaaagtctagccccatcaaaatattttaacaaagaaaaagatttaaaagtcacatacgccacattcactgtgacgatctcattcacaggtaaaagaagctctggtaaccatttggggaaatcagctacacacataatggtttcatctctgatctttaaagttaagctttctcttttgatcaattcagtacatattattatctttccttatttactcattctattaaaaatgagatatagtgtgttaatataaaaataagctaacaagatatctgattaacggttacaggtgaaaaaaacaaagtggctgaaaatctgaaaaaaatatataggtttccttaaagacctactcaaaggaaataagaacattgacatcagaaattcttaaaatctttacataggactaactcaaaagcatggcttgaagggtagcattggataaaaatgttaaaatggttacttgcagatttgccatttgtgaataaaataaattttcattgtttaatattgtcattcaagtcctcaggcattctgagtacttttatctaatacattttaaatgtgcataaacccgttaacaagtaaattctaacattttattttttctcttctttcttcttaaaaacaacttatttaacaaaacataaaagaattagaaatataaaaatgtatttactgtcatgaatgacattgctttgacaatttcaaaaatgtgatgaaataaggtaatggatagaaaataaggatgctattcaataaatatgtatttaaatgataaattggtacatttctgaacatgaattattaaatagctctataaacattaaacacaactttccattaaataacataattagggaaagtcaagagaacaatggaaaaagtaaacaaaaagtatggcaggatattgataaagcatacaatgatcaatatttgtatgtaactctccacccaaaatgttgacattcccctattttttgtattcactttaccaatgtcaaagttccgacatccaaaataaataaataaaatgaataaaattaagtaattctataagaattatacataaccagataattttttaaaagttataaattctgcagtctattattagttatgctttaaagatgctattaaaataaatacattagttagtctcataaataaagacctgggaattcaagcagacaaaggtaatttcaccatatatataaaataagaaaacaatgcttaaagattaactcctcagaatttttgatttggcatcaacttttgtatacttttcttttttctctttattttcttttcttcttctttttttcatttttaaaaatttttttttttactgttttacctccatctatcaacctttcagggatttgaaacatggtaagtaaagggaaactaaaccctgatgtatttttctctttgttatttgatacattgaaaaataacaaccattttaaagtatagaattttgagtaaaatttaaaatttagagctaaaatttgacttggtgttgattttcttattcatctattcctttattgatctttccagtaaaatcataatgaatgtcaatagctcagccattcttaaaggttgccaaaactaattagtgtcattaacattgattcagaaaatccatctgccttaaaatatcccttgcactcataaatttcccaccatttgagtcactcgtatggaataaagtttagtttttactatattatccaagatagcttgtcaacactgtgattatcctagtggagaacaaaatcctatgaggaatagacagtgttgggactgtgtgataaatgttgttctctctccatgatgatcatcttcatctaagttcttgctactcagtgtatgagcaaacctagagatctgttagaaatgcgaaatctcagatccaactccaattccatcaagtcatgatctgcatttgaacaagactactagatgattcatgtccacaatgaaatttgaaaagcgtactataagacctatactccaagaaactatcaactgttacttgcatttctgtatcttattatttgtctgcttgctcctattcacttgaaatttcttcttcaaattcatgctaaagtgactcctttaaaaattacatttgataatatatgttccctgctaatgtccaccaatggtttagataaaaataaagctcatttttgaggcctaaaagccaaatggtgtttttcctacctatgtttcccacctcatctaccttactctcctcctggtgcactgagtacaagaattagtaggttttatttttctcaagttaaactgaagctttttttaactagctgttttttttcctggtgtgctttctcctctgagaaatttcaaggcatagctccaagagcatctctgtctgctttctgttgtttaggtctcagtttaaattttaactccccagagtcctttccttaccatccaaactaaggcagcaatccatctatcatatagcctattttgattttctgcacagcccttattaccatcagacaattatttacttgtttattgtctttttcttcctcacttgaatataagttcaataaagcagggtctactaagttttgttcaatactgtatacccagcaactggaagacagcttggcactcagtggatatttgtgagagagaaaaaaaaattaaaagaaaagaagatggaacagaaaaaaactgaaaagaagtaaagagaaaaaagaaaaacaaagaaaaaatgaaaagaaagaataaagaaaaatgagtgaataaatacatagtagaatgtggtagtgaagagagtaagaatagcactgtcatctgttgttagaaataacactgcctaaaagaacagctaggactggacctccaaataaagaagttttcgaatttaaggcatagatgtgggcattgggcccagaaaaaaaaaagtaaatatggctgatttcacatttaatgagataagtagattgttaatctctaaattccttgatggtagcattggccacttctatgtttgtttttacactggctataaataatcattaaaataagtacatgtcagctcaacaccagtagggaatataaagtgatggtaaatacattaattaatatataatatttctctatagaatcatagacttttgggattaaaagggacagtggcaatcatattattaagatattatttgatgctttagtgatttctaaatacccacattgtccattacaacctatgcttgaatgtctttgagaattcactgcttctagtagcacacaatctatatttgaaaaaaaaaaactgaatgttaaatcagtcttctttataataaactgctttgcactgtcttatggttccctacactaaattctacaacctatgccagaggacagatttaatctctcttacacagaacaacatatcaagcatttcaagacagttttacctcatccttcctcacatgccatacccattctgtggtaattctttctcttataattgacctataatttttctctgtaatctaatctctacaactttttctttgggaataaacactatgcaatatacttttgaattcaccacttgctcagtgaaagataagatgtacaataaaaccctgataattgattacttgctgggcatacattagtatccataaaaatatatttacatgactactcataaactagctccctcattgtgatgatgcttattaagattttaaaaacaacatattttagatttagaaattcatactttataaaagtcttaatacaatatttgaaaacagtgttagttgcttgcaaacacttgaaaacatttaaaatatattttatgcataataatatagcctattagtgatgggcacataataagcacctaaaaattgttactttcacacaatgcagtttttgatgtaaaagagtgttacaccagttcttgaatcaaatttgtgacatagtaatcttctgacataaactggcaatttaatgtgaatattaaatctgtatgattgtttgctgttttcttatttttgttgagccttataaatattcagatgagcttacttgaaaacaatataaattatggtaacaataaaaaattcctgcttctttggattaaaattgctcacctaaaataaacgttttatgctgaattaaccattcttaccttaaacctaagaataataaataatgtacttatttaaaaactgttaaactagagtttcttttaagctctagtgttggaggagaaaagtctacatcatattcaatctcaattcagcataatttcatgtaactttattaaccaaagtaatatcctactgatatgatcattaccattaaatgtactgtggcataattgactatactaggtcaaaataaacagtagtaatgtctataaaaacctcataacatatatttatttaattccataagatgttgtagttatctaagttaaattcccatcgggaagtccaataaaaaataataattattatatgtgtatatgaaaacgttcccagaagaatatacccaaattttgtacttaaaaacagcaactatcaaaactgctctttaacagctgataggacttgtccacatattgaaaaaatttctattattctactaaagtctccaagaaaagtaatgctaaagcaaaatacagtggagtaaaacacatcttaattattatttaacataataaaatatgacaaataactccttgagaaaggatacccaattgtgcttataatctgttatttcaagtttaacatcacttaatgaaagaccacatatcagacactaaatgaatcttgaatgaatcaatactagtctaggactatcaatactagtctaagactgggtttttatacagtttctgccagtccataattttctccacaaaataatgatatttactagataatttgtaagttcccacctaattctaaaatagataattctagaaatccaggaaaatttacttattatttctaaaatcatgtcattacataggttcttctattttcaagtcaatgttaggtaaattcctaaggctgtaatattgagctttagggtttagggattattgaaaaagatattttaagttaaatattaacttaaatatggcatgaacccaggaggcggagcttgcagtgagccgagatcatgccactgcactccagcttgggtgacagagctagactccctctcaaaaaaaaaaaaaaaaaaaaagaaaagatatcaaaagagatcttatagctaaggcagtaaattattctgatgaatttacaaatgtcactagatatatatccgttatctaattttaaacatctggatattttgtaaataaaaagtcaattatttttaagcttacttacattaatgtatgtcttccttcaaacataaaacaacttatttatttttgttgcagactaatatttctattcagcctaaatacccactcaaaccattttgaatgggtcttagtgacataaatataatttactagtttcaaacattaattcagcttgctttcttttctttttttttttttttatatggagcctctctctgttgctcaggctggagtgcagtggtgcgatctcggctcactgcaagctctgcctcctgggttcacgctattctcctgcctcggcctcccgagtagctgggactacaggcgcccgccaccacgcccagctaattttttgtatttttattagagatggggtttcaccgtgtaagccaggatggtctcaatctactgacctcgttattcacccgtctcggcctcccaaagtgctgggatgacaggcgtgggccaccacgcctggcctcatctttcaataattagttcaaatattctctgagcagccctctttgactcatatttagaggttgtcagtccctctactgtaattcaataacatttcaaaaatactgctatgtaagtgtttctcataataaatttgtgattcttcttttttatttaaagttatgtagaccgctctatggcattgattgtattgttcattctcatgtacctgctatccagtacaatgtcatgcacatcacaagagctaaaacatattttgtgaataaaatgaaaataacaaccatcctatgacacaggtgttctcagctactgagaagttgtgactttgggaattgaacttattgctcaagatcataaagctaacaaggggcagagtatagtctcagcctagttctttgaccaaaactcaaagttgatagtaagcaattcttttttatctttccattgggagaaaatacctaagagtttatggcacttccaatcattactatgtttaatgcttataacaaccctgatgtaatattttgatactacaaaaactactttgcaaatataaaattttagctataattgttcatttgacctgaacaaactctcacacatagtagtttgcaaaggtggactaaaatgcagtcaaaaatattaagttctcattttgaggactattgtacactaatacagcaaagtgaggtgtggtgttaatatgcatttttaatagatctaaaccaacattgtttattttcttcctcttttgcttctttttatctcaacgtgcaaagaatcttcaaatggaggagactgcaaataattttctgctactgagaaaaagtagaaaataaaaattttaagataatttaaattgttgatgttttaactatagtacaataggaaaattaattggaatggtaccctataaagaattgaaaatatctttgagaaatattttaagtttttccagattattcattaattttacagttgttatttaaataaaagttatagtgagtttatttaatttatctatgtgttaattcacttaattaacacatagattagtctgtacacattaagtacaaaatactgtgtgtaatccatgtttctatgtgttcataataatattgatgtcaattattaatacatgccccagtttatgaaaacagataaactgggaaccattaatgatcaaaagacataaaactgaaagtttaactggaatgtgaataaaaaaattaaaaatattaaattattacatactgcaaaatagcatgaacttgcagacatcgaacggacctatgctatagtaatctcttatatttatgttttacactgtaattaacttcaacaaaataatattcagtagaatattttttcataggatatttttgactttatagtttgctaatggttaattataaaattattttgattttataatcattcaagggctaaaagcaaggcctttatatccagttccattttgtgaattttgaaccagtaatacaataaaagcaatatattattatggattaatgaaaatattgttgcctttatttaaaaaaaactggtattataactgtgacaaaatgtagttatctttaatactgaaatatgtagagatttcattatcttgaagaaggtaatttcaagcctttaaataatttaagtaaattttctagcaagtgaaattataaacacttattcattagtttgacaactattttttaaaaaatatctattggtcagaaactgtactaagtactgaaaatgcagcatgaataaaacccacccactccttatcctcagagagcttaaattttacaggaaaatttatagggctgatgattacaaatgcaagctgcaatggcaagttataagaggaatatctaaccttcctagaggtaacaatttaagctaaatcttggaaattagaattatgtggttaaaaggaacaaggattagcttctcagagtatccttagggagaaaagaatacagtgtttggctaattaaaataaattgtgttttgcaaaataatagagtgattgtgagagttacatgcgatgaatttggaaatatggaaaaaagtcagatcatgcagtttcccgtgggtcatcaccaagtctctgctttattcttaagagcattgattaatcactgaaagctttaaaagagtagtgttatacgactggatttttatttgtaaaagttcattttaactatattgtggataatagatcagaggaataagtttttttctgaaatatctaaaaaaattaagcaattggttttcggttgtttaccaactcattgaaaaagtaacttaaaagactcactctctgcatacacactgtaacttctttagtactttgatcagaattcattttacaaaatctatcttgtaccactagaatgggtttttctatgtcctcgactctattgcaatgtcctgcaggaaggggacatgcattatttatctttatttcctctagaacagaatctggtactgagtaagcattttaggcatgtgtctgagccaaaattattattttaaaaataatactagttagatgtcagccatttccagtttagaaatttggacctgctggtaatcaagtcttagaagatagtttcataactaagagcatagctatattttgagaacttcagaaaacactaagcaatagaatagtaggtttcccctactcttaacattgatgaatatttttgcccataatattaagagattgtgtctagagtgtaatagataagtagcaaaccaaaatcactgaactagtagtaagttattgaagaagaaacagaagaaccaatttgaattaaagtagaaagttgataaaagtataacaatttaagtcactgtcaataatgatgaatacattaaaaatgttttccatataatgttttacatctactttgaaaaataaatgaggaatacatttccaaggtacatggcaccactgaatgcatattaaattcaaaatcaccattttgtaaagaatatggggaaaggtaaaacaggtatcaatctctcaaacagcactgggagcttatgataataatggagaaagtttgagcactgattgggaatctacccgggaagtactcttgaagcttaattaaaatttacttgaagaaacttaaacattttatatggaaccaccttaaaagtatttaatttaatttaatggttgactattaaacttttctattttcagtctgcattattgttccaagttacataaaattttaatttataaccacaaagtttatcacaccacttgacggcaaactttggctaaagtagaaattgtattattagttggttttacaataaacttatgtcagaaattatcctccttctatatgatgggtaataaaataatttccagatagcctaccaatattagctcatgcaattttccaaagagaatgaaaaaatagtttttaacattttaatataattttacctatttaaattttctggtaataagacaaaaactgtttactttattgagtaaatcacaaattttaacacggtccctatattcttataaatggtaatatttataataggaaagtgaatatagaatcaaggtgatattgatttaatctttttgagaagactattataggttaaaaattcattttagaatgtgcctcattaaagagaatcaaagtaagtattttcagtacaaattcgaatggaaacaaacttctgagatatttttgtattatttttaattaatgtatgtaaagatgtcttgatttctatccttcttgtgctctaagtattgagcacaatacttatacagaccattacttaaatcatggtctgtataaaccatgcctaatcacactgcaaaaaccatagccagtttagagaaaatattttgatatcttggaaatgtagtagatattttatacttgaaatatgttcaattaattaatgttcttacagatacatatatcgatataaataaagaccttttattattttatactacattgaatttttttcctaaacttctctatgacacttgccaccaagaaacagaaaaatgtattttctagacttccttattttgtaaaaggtaggcttatattaactgagtagaaaattaccaatgtaagatgtggttttatgtcatttttctctaaaaataaattagacatttaaagaatacttaaattttggaggcatactatcaatgaatagctgttaccttttcaaaatgagaaatctttcaatgcaatcatatgggtcaggcaaagaataagctatgtaaaacgatcaccagatataatgtttctatgtttcccaatcaaactgtacatattctcaagtactaactaacatttgcataacataaaaatatcatgcaaacgctaaaaattactacatgggataaatcatctatgtgtaaatatatgcacttattaatcaaaactggctactttattttcctgttttgtgaacatcatcataactggtatggaataaataataagtatttggtacttgtttttactgtcctgtttaaaaatgatttctgttctacttttaccccctccccctccaacatttgcattgcactttgacttatttttaaatttcaatttctatgctttcaaattattccagttttggttgttactatccatatttttcagctactttgaactttttcttttgctttctatatcttggctctctttcagctcattctctaattagaatcattaccaaaatatagctttggctgtaactaaatgggcacaagtaaaataacatccaatacctctatgagtaacaactgcaagctctttagttctttctatctgttcagcatgtcttggtcttctcctggtactttgtgtatctgctggatgaggagagagcccgtccttggacgtgttggggtccagacctgaatttctgagactcgtaacttgcactcgctgttcctcggaaagtctatggatggtgacagctgtaacactggatacagtaacatctgcaggtgtgctagcaacagcaatagcaccagtggtagtcctgttatgctcctctaactcaccagtggaggtagtgtgggtcaatgtagaagaacctgtgggacacagtagcactagatgctaactttttctttttaaattttgtttattttttctgataaatttaatcaatcatattctcttctattaccttaaggataatcaacatgaagaggcaaaacacaaacacgcgagtaaattgtgaagcgcactagatctgtcggtttgtttctatcaaccatcctatggatagatatacacacaaaatataccacattttaactgtaatacattgaagagagcaggtaaaagggtaaaccctttatgtggccctgaatcaatcttttaaaaaaatctacagatgaattttagcaacgaatgcctggcaagtgtcaggttttgatggaatgggtaactatgtaaccacacttttctcaaaagtatgctttgaatagtctgccatatctcttcacagtttctgggaaaaatatcaaaattttctattttaagacaagcaagtgaagaaaagagaatttaaaatcaaagccaaaatgaaaacaaatgatgaaaaaaaaggggcactaaaataaccactatatgaaaatgtgtttcttaacctcatttgtgatgagctaagtaccttagaatttatcaagtttttaaaaattagttaatactttctactatttttaagtaatattttagtttaaccaattctgaactaattaaaattaagcaaattatgaaatttggaagtggttgaaacttaactattattatacagcacgtaactttaattcacacaacgctagttttaacaattggttgggaatttctaaatatctcataagcatttcagagtgtgtatatgtgcgcatgtgtgtgtgtataatattaccacatttttattctaattaaatattttttaataatttagaagtatgtattcaaagtgtcaaattagagtttgctttttcattttatttaatgttttttaaaggaggttgttcatggtagttcataatacttatataatgaaaaaagtaactttataatagaagcatgaaattgaatgggggtatatttaaaaggatcttgacagctaaaatccttaacagcaacaaccaaaaaaaatattgaaatttggagctgcagctactcattaggaatcatagtcagatcccggttggaaaacttctgaatattttctaaagcccctgagtggtatatgtttttatacacttttcttcgcaacatttcaaaattctgttagcaatgtttacttagatattttagataacaatgctagggatattttaaccattctgaaagagaaaaaaaagcaatgtcaatatggtttgagaatactctgccttttttattttcctcttgtgctgtagacaggtgattagtaggactaataattctgctttctgccttaaattcaaaaaggaagaaaggaagtcaaacctggagcccctcactcacaggcaaacagaaaagcccatttctgcccctgattcttccaggttgagtcgtcatatctgaatttgattctagaaattcagaagtattaaatgatttttgtattttgaaagagccaaaagtaaatgaggtatgacgattatcaaattattttaaatattttaatgtttttaagcatgaatcagatagcttctattgaatatttatccaagttgttttgtgaataacctatttcatagatcagaatctactaagttcacattggttatataaatcaggttgcaatatttagtcagctaatatttgataataattttttaaccacatggttaagcaatagctatgcttgcactactaaaatacagtaattgaactcatggtaaactgtacatttgtgatgtgcagtttcatacatacatcatgatgagctcatgtgctcattactatgaaacctgatccatattgtcctcctagagtttaattgagcctttttatttttgacaggaatatgaaatcagagtaaaaactaatgctttaatatttttataacctcatcataattttcagactttcaggtttaattttaataaaagaaactattaactataaacatatgttggtaattataagctaaatttatgagaaataatggaatttatactatgtcacatgtctgagcacgcctacctttaccaaagggatggattaaattatcatattccatcagagtcattatgatcaatctcaaataatccctcgaatttgagtcaataaatctgagataatccttatgaacaggcttagggggcttaggctgcttctctaatcactcaagacctgcagacccaatccaaacactcactttcttgaagacctcaggggagaaacacagttccagaccaaattttggagttagaactgatctttggtaatgtctagacccaggactttctagcagtcccaatcttaaaatatttagcataagagctatacttcccaccaacggtgatgaagattcagtactattcccttaacctaaatttgggacagtgtttaaggttgaaataaagcattaaaccccagaatttatttaataatcataatctaaccagatatgtattccaaccaggtattttactaaccagttcttatgttttacttatatattgtgttcatattctttccacaccatactgggaagcaagctccctgaaggctaaaatttttgtatattgatttcactgctgaatccctagctcctagaacattgcctagcacatagtagatgctccaggaacattcatcagaagaaataataaataaagaatgaattcaataggactaaaataatattagcaataataaaaagacacatttcacaaatggaatatgattataattgttaccatgcaaaagtcgcatttcaaacagtgacatgaatgaagagcaatttcaaagcagggggaacataaaattttggttttaactttcaaaaacatcactttgaaaaagtgtggaatctgaagattaagttgcataagtaataattacttcaaaatttttgttgttatttccaaaacaaaagtttaatctgttagtataaaatagatttacttagaatattcaacgttgtgtagaattaaaaggggatatatgtcatgcttacagaaagtataaatgcatctaaacttagatatgtttgatacatatagtggaactataaagaaataacactgatttcctttttaaggtaataaagtcatccattaccatacagttatgtcatatattgcatttaccattttattttaatattaatggtttgaaatactgatattggtaatattttaaattggcagtgtatgaaacacagatttttaaattgtcaagattcaccacttaacagtttaaaaatactcaaaatttttgaatacacaactattttattaagtaattgccaatgctggaaaaagtcttagaattatgtatagcaataattcaatattaaatatacacatagctatccaatgttaaaaggatactttactttcatttttgaaaaaaattaagtatgctacacaattaggtaagcattgtctgacagcacagttaaatgtatatattacaagacataaaactcaaaggaagaaaacgtacattcagaaaactttcttcatttgatatcaaatgatatatacaaggtgtagcttatcacaattagattatcctgtcattaagttacttgagaaaaatctaaaaataagacgttcacaatatgaacttatctgaaatataattttaataatgctatttaacaaaatattcctaaactaacaaaaatgaaataaaaatgatttacatatataaacatgcttcactaagtcataactatatgtcatctatgaaattatgataatggaaaatcacttgttacacatataagtttgaaattttatttaatagtaatagtacaatgttaaatttgaaattttattatgtgttttcaaaaattttttgaaagttattaattttaacaaaatatgtaccaaataatacctcatgatagaatttgaacttcattttgattaaattttttgtcctatagtttaaaaattttatgttgtttctttgtaattattctctaactcattaccaaaataaaaaacagaatatattgctagagatatgcatggatgacccaaaatatataagaacatgtaaaaataactacatattcaaagaagtttttaggtacttatgtttagcacattatgttacataaattagtttaatatattctgttccttcctttaattttagtgtttcatatgaaacatttgaatggaaatttaacaaaataataataattttgtgacattgtgatatgtaataaagtaaaatgccataaatgtttaacattaaaacatctaaaataaaaattatatatacacaaataacaccaacataaagtctaaatactacgactaattctattcaagccatcatttggagagtcattagcatatgtaatttaatgtttgttatttttttcttcttttctttaatatgacttctgtgaaacttataggaaaacacaccaataaatgaggacacttgcgaactaattgaatacgagggtatgaagtgaaacaaagctctgatttgttacatttttaaaaatttcgttttcattaagcgtatgctagttgcgaaaataattgaaatattttgcattataaaaggtattaatttcagtattttaaaatctggctaccatagtattcaacagttcaaactggtagatgggtgcaaactatgaatatgcaatttagaaaagagatggattaactgaaagtagcccttaaaactgtaggggaaatagaaatgttttacctttgattaactgttattaagtataaaaatatctttctgactaggagaattttaagtaaatcctggaaaagaactagtttataattttcaaaaaatgtatatctacattgatcttataaaatttgatttcaaattaaaatgctgtatttatgttgaaacttcataagattaaaatcttaaaatatattactcaataatacaatatagccttgattataagaggcatatctaagaaaaaaactgcagcaattaaattatgaaatgacaatgcaaaattggctatcacttgtgcccagatttctgagaggttaaagtaaaaagaagttcatcttagtgatgtaagaaaaaattcagtaattcatgtaacagattttctaagattaagaataaataaataggtaaatactaatttaaaaatataattgagtttaaatacatatcacctttctgaatttactgacatattgatatgtttatttttatgttatatattttgttaaagtttataagcgttaaataggaaaccagtattaaattttgcatttggatttgctgtcatttatcatgtacaagtggccttgatgaaataatatgcaaaatgaatgaataaataaataatatatttgcaattcaatctgaaactgatgatagtaagatttgtcagtaaatgtagtggtacatctactaaaatcactttgtgactaaattaataattgtaaaacaaatattaacaaattatacactattacacaatgtttatatgcaagataaggatctcaaattatgaattgctagaaattttaataaacacacatgccaagcaaccataaatacctttttatatgaaatatggaaatatcaaaacttttagaaagccttaaggagactacagttttggtgaaccatgacaaaacaatacgtacacataaatgtatgaatgttatattaaatattgcagttttaccctaagaaggagaatggatagacatctcatttcttagtacaaaaaatataataagagtgtgctagagaaaagctattttaaatggagagtttaagaatcttgaaaatagtatctctctctcaaaagatcgtttcttgcttcacccagttgattaagagaaatttgtagaattaaagttcaaagtagtatcactttaatttttcatgcgttttggaggtttctccgatgtgtagaggtgcatcataggtgtcatttttaaatttagatatgcaaatccacaaaaacacacaccacttgcagaaataaatttcacacaatacaaactgaattctttttaagtaactaagtataatagtcttataaggtcacaaaactgacaataaatgttgaagacctaggttttaaaagaagaatcatggcatcattgttacatttcacaataagagaaagaataggatgcccctctacatctttgtacaaccatcaaccagaatcctgaatctttagatctttttgttgagacacctgtcatctcttaactagagtaaaagcatttgtcattctgggcttcccctaaacaaacaaaatgaaacgtcacacacacttgtttcattcatttccacgtaaaatcttgtggaacagctggcagctctcatggaagaatattttattgcaagatgtcatgtcagaagcacctcattttcatacccttgttttctctgacaatccttgccttattaatatcatttgaaagcagagaacatgtcttacagaggccttatcccctatttctgactgaatatttgatatatatgtgaggagagaataaattagtaaaaatgtctaaatatattaccttctttctgaataatataaaagttttgtatttaattaatacttaatgatggcaaaatttatttttcaggatataaacataagtaaagaattggatctgttcagatacatccaaataatgcaaaacacacttataacatacttttgttttatatttcatgtgctagaatagaggtatgaaaaagaggaagaaacatccgacacacagaaattacttattcatttatgttttctcaaataagagtatcatttccccatctgcttcttctatctcccaatattctttccaaaaacccaaaacctgtattttataatgatagtatttgtttattttgaaagagaaaggagaaaagtaaagaaaatttgtgggtggggttcccttttataccaataattattgaaagaaaaaataagagcagtctttatcctaacctactcatcatatccctgggtcacagctaccttcactacctgaatgtatctctgtttatcctttgttttcttccacaatgactggcctttaagtttgggacctatggaagtgtcatcatttttcattaattgtagatgttctttaatgcctaaaatatacataagcctgcttttatgtatgtgatatgatttaatggaaccaagaaactacgcttatcccccacatctttctctctgtgtacctcaatggtgttaaaagatgttcttaagaattaagtattgcccaaaaaaattattctctcataaccagacaaataactttttgattgatagagggccatactagattaattgtttaactattccactttaattagtttattattaagttttcttcccttacaaaaatacttggggaaattttagagatacatgttttggggagaagtgtgaagtttgccataagaccatttagtgatttttattgaggcatttatcataagttgatatctgatccatatgattgttaaataactggaagaatagggttcattattaacaggtctggtgtaaagaaggtgtgggtggctaggaagggctgccattctggaagaaagactattatggtgttgactgtgaaagggttgctgagcaactggtgagaagctgcataaatacgctcaagtaaagtagcctaataagaaacacaggccaaaaacgtcttactttcctgcaacagacattttgtagagcatttggtattctgtagcagcaaattaattagtagaaggagttattttctcgaaaataaataccaattttggcttagaaaaaaatagcatgttggaggggaaaaaaaacttcagaaatgataagaatatagtctatcatcaaagctatcattgccctaaaagcaaatatattatatatgaatattatatatggggtattacatataattatatatttggatatttatatttgtccatatttagagataaatgtatttcttatgtgattattatgctaatttcctttacacaaatacctttcatttagagaatataagtaaaaaagaacaaacaaaaactgtcttttaataccatcaataaacaaaggtaagaacaccaagatatacatcatttatatttgacttcaagtgtgcttactttagttttactaaggcaacagatgatgttaaaatttagccataaaatgtaactatctgatcaataaaatctcacaaatcatatattttaatgttataatatctcgccaactgtctttgactctttctactctagaagtagaaagttggatcctcagggtgatacaaattagaaggttaattagagcttccttcactcaaatcttccctggaggagagacagataagtctgttgcttaattagaaagaaattccatcaaatttagaacagaatatatttggaaagacagaaataaaatgggtgaaatatgaaggaagagattcaacaaactacttcggctttacatatttgtacctattgaaaaaacaaaccctatcttgtattcattccaaaaaatgcaaatgttatacatgaatctttctaataccctactttttctacaccaatgagaatggagatttttcctctttctctatgtttcaatcacattctaaaccatcctaactgtaaaaggtattacattccatcttctctttacctcatccttgctatttcacaaacacaaattaaatgactattatactttagatacatgatagattatgatagatagatagatagatagatagatagatagatagatagataatcttcacccatgtctttcaagtaaacagtctaatagctatttaaaaaataaccagagcaatgtgatatgtttaatagaggatacagtataactaggaaaacacagctgtggaaccccttagatttgcttacacaaaccaggaagactttctagttgaagagacattggcattgatcttaaaggatgagcagattttccctgatacatgagggataaaataacattttagtcagaggtagcagattagaaaaaggtgcggtaggggaaaaggcaagacatattcagaaaacttcaaattatttggcatggcaggaatgaaaaaacgaaatagtaggcaccgagacttgaagagccaaaacacttcaacttaacttgaaaaaatgaagcatcactaaaggacataaagcatgagactgataacaagattggcattttagagagaatgttcttgctataatgtggacaaggtattaaagagctacatggactacaggaggggtcaccaacccccaggccacggactggtaccagtccttcgcctgttaggaactgggccacacagccgaagatgagtggtgagcaagcgagcaaagcttcatctgtatttacagctactccccattgatcacattacctactgagctctgccacctatcagatcagtggtggcattagattcttataggagcatgaactgctcaagcaagagatctaggttgcaaactccttatgagaatctaatgcctgatgatctgtcagtgtctaccatcacccccagatgggaccacctcattgcaagaaaacaaggtcagggatcccactgcttctccattatggtgagttgtataattatttgattatatattacaatacaataataatagaaacaaagtacaaagtaaatgtaatgtgcttggatcatccagaaaccatccccacccccgatctgtggaaaaactgtcttccacaaaatcagtctctggtgccaaaaatgttggggactactggactacaagcaagacaaacatttaactgcttcaaccacatgactctgagtattttgcaatagagttgctagatttagcaaataagaatatggaacactcagttaaatttaaatgtcacgtaatcaacaattgttttgttattttgtttgcttttagtataactatatcctgtataaaaatgtttcttttctatctgaaattaaaattcaactgggcattctgtatattatctggaaactctaccttgatattaatttagacttacaaactctgaaaattttctacataccaagtaaaaactagtaacaaatattaatcctttcaatgtaggtattatttgattgatcctgtgaaaacttttggaatgacagagaatgggcatgatgacatcacaaggacatctaggcaaaactcatgaaagcatcattttattaaatgagaaacggaaagaaggcaagttgaatatagtgttctaagttattttattccaaatatatttaagtcttcaaccattttagtattaaaaccatcgaatgctctagtcctatattcattataaaaatacatgttctatacttgaggaaaaaattcatattgagaattaaatccatagatttacatataaaaaagtcagctttctgaataatgattcaatccatagaaaattgaatggaagatatttccagtaagaacttattgctctttgaattatatacagacaccgtaagtggcaacaaaaactgaatatttacccaacctcacaatatcgagtaatactttttgacctgttagtctttttttattcaggtaatagaaaatataaaatggaaagtaaaaaattcaatgttctcaatagatagataattaggtagataaagatataaatatagatagtttctatgagtttccctcatcttcctctagcatatatgagactatatatctgtgtgtatatatgtatatatctataactatgtggagagatatcaggtacataaagaaatctctgaactctgaaaaggcatttaaagtaagagtgttctattttatcaagatcatatgcatattatttggtttgaatttttgatgacaatattaatgcaaaaaaatttaatcattagtgtagttttaaatatctaatagttttatatccacccagataattttgctgtattctaattacagatatgaagatgaatattcaatcattttcctgaagtatacttttaacctttataaaggtaatgaaaacttgcttcagtcatctgtgagaagatacctttgtatttctccacatttctgaagagatgattaagacactataaacgtatttgacattccaatatgtttactttaaataaatagataccaaaaatatttttaaaacatggcataaaaagcaatagacatttattgagcacttagtatttgccagacatagtgctaatttattcatttaatccttaaaggtaacctatgagctaataatgataaagcgcagagctgcttcaaaacatacactgagtcacatagctataactggcacagctaaaagatggaccaaaattgcacagtctcaaaatgatcttaacttctgtgaaatcagtgcctttatgcagcctccccaatacagtatagcatgtaaacacttgtatgtgagtcaatatgttatttacttatgttttattttcactatatttcttttccatcacctcctttctcaacagaggcctgattgcctccaggtcctcctgtaattccctcggcaggattttcatgcagagctcaaagggaaattttctctatattccctccctagtttttgtttcctgagagtctaggtcctttcatgaaagtacaccaaatgaaaagaggagggcaatgatggggaggtgttagagtttggggagaagcaatgaagatgatgtacacatcatctctaaggaaaatagaagggtctaggaatctgtattctcacatttggctaggatttcctcactcaggcttatcatggaaagaagagggtcatctgccttcatagaaaatatgggtttggacaatgatgactaaatggctttctccccatagtctagtcgctacaaaggcctattggattcttgcgcaaatcaagggaagagaaggtgccaaatgtttcttctaccctcaccccacaatgacctacataatgtttttcctgtcaaatatgataggggctttcaaatgtatttgaatttaagagaacaaagtaacacttcttgcctatccacatctgtggattaaatttcacacctgtttaatgtgtaaatgcattaaaaatgtacaacatatctcaatagcttatttttgcttgtttaaataatttagtttaagggtgaagtttgatacctctatgttctattttgtcttttaacaatttgagttcttctattataaaacagttcttagtaatctaatttcactcatctttgcaaagtatctgctgctcaatagttacaagactcacattatcatacttgtggcttcttactatgttgctaatgtgtatcatttttgccacctttgggcatgaacaaagattctgcaagtttctggttcctaacttttaccaacaaagtcttctccaatcttcagaaaatttcttgcaagtcgtcttttttcccagtcacacatcaatttaatttttcatggagagtggatgttttatgatgaggacatttacaccagagactcaggcatccattagtactcagccaactattccccactgtccctaataatcatagcctaacacttattgatcattatttaatgcatattccatgataagcaattcatatataataatcataacaaccgtaggcagcaggtaccatgaaaatttatacagctgcgggtaaataagttgatttaagtaattcattcacgtattcactcaacaagtatttattgtcttaggtcatttattcattcttccagaattttaggcaacaagaatttgtcgagtgcttagtttatgccagaggctggatgatccagaggtgaacagtacagacactgtgtttcctaagaaatattacattcaaatgggagacaaaaagaatgaacagataaataaaacagcaggtagtgaaacacaaagtgatttttgagctaaaaccataataaaatgaaagagttatttaagaaaaagacctgatatatggcacttttactcagactgtcagattacacagatttttttcttaatcttggtgacacaatacttcctatccagttatcacttgggcatttcactttatttctctatactatgttccacagtctcttgtgtcctatgtttctatgaaacaatacttatttttagccaagataatattttgcatcaatattttatttcattcaatgaatactacatactgagtttctaccttttgctagctattgttacatgatagaatgcaatggtgagcatgggagataacgtgaacaaagggataaacaattaacaaaaataacagaatatgtttgtactatgttgctgtgttatattaaatatggtcacatattctttgtgactcttgactaagaggtagagtaggtgtgaccctactaagagatggagtctatttcccacccacttgggtaaggatgtcctaatgacttgctgtgaccaacagagtgcagcaaaagggatgatgtgtgacttctggagcttcactttcaatattctttgtagcttccaccttggatctcttgggatgctttcctcaaactgccactgatatggtttcactgtgtccccacccaaatctcatcttgaattggaataatcctcatatgtcaagggcaatgccagatggagataattgaatcatgggggcagttttccccctactgttcttgttcttgtggtagtgaataagtctcatgagatcggatagttttataaatgggagatcccctacacaagctcttgcctcctgccatgtaagatgtgactttgttcctcattcaccttccgccatgattgtgaggcctccccagccacgtggaaatgtgagtcaattaaaatttttcctttatacgttactcagtcccgaatacgtctttattagcagcatgagaacagactaatacagccacgtaaggaagtatgtctggctaccagaagataaatggcacaaggagcaaaactgaagtgtcccaatttacaaaactgtgttacgccatattggaccttctatgatagtcaactatctagctgactgtaactacacatgcgagcaaaaaagcatcttgccaacaaagagaattgtgagaaataatgaagcgttctgttttaagcctctaatacatgacttgtctttcacaagccatgtttaactgaaacaatgggttaaatgcttgagttttacggaagtatttaatagaagcactaatctggtcttgggggtcaaattaataaacagaggctttgtgaaaaatgttatgtttaaactaaaaccagaacaatgaataggaaatgccaaggtgaaaagaaaataagtaaatagtccaaacagaggcctgtattgtaaacaccctgagacaagacagattttgttagtttctaggaattaaagaccacttagtatgggtaaaggataaattgcaagcaggaatatcacagaaacttagcttggaaatataagtagagagcatattatgagaatatagtacagcagattatgacacaagccatgagaacccatatggactttataataatgccagcagacacagtcctccaactccactcactgtagttaccactacatttctctcttcccttctgaaaaccaaatgtgtttcttaaaagaaaagataaattttctttctgtggatagaaaacatttttttaaaatcctgaaattaaaaagtaaaatttttgttgttcctaaatgtgattacctcgggtcatctctaaagaaaaatggaaaaacagaagaaattttaacccataataattatctgtctgtattcattcactccatttgtcatttttctattttccaatttcatacttatgaggacctacttaatcatttttcatttattttcaaaatgatatgtagaattgtttgctgaattaaatatatatatattgctgctgaatatatatatatagttgctgaattaaatatatatatatattcctgtaaaacatatttcataggaagatcaatgtaggtatttcataagaggataaaactcatgttgtagaatttcagtcactagctaggagattgggaaggatttggtgggacatcaggagttctcagatcccccatttatgctgtgtagtcaactacagtacatgtgcaaaaatggtcagccagtatgcattttattttggattatattgcaaaatatgctctctaaaaatgaatttttctttcagaaagatggtttatgctattaaatatcaccgaatctgtgcagttcttgctttcctgatagaaagaataaacagtttatgtacaggtgagtaaattctagaatttaattaaaatgaaattcaatatggtgtgccttggaatcaaaattacaataaaaagtaatataccagtcagtcagtcagtcaataaaataaactgaagtgtgttgtgtagaaaacaaaagatgagacacaaaaatattattatgtgatactaaatttctaagcataaatattttataatgcatttccttgagtcaacccagtgaagtgatgtttagtaattaaaagttatatgtaatgatgtgactacataggtactttcgtttttttgcaaagtatgattacttacaatcatttttcacaccacctcttagatgagctgtatatcacatgagaaagaacaatcagtgttaatttaattatagtgttaagtaaaggaagttgatattttagtgagcaggtgaggtcctgtaatgagtaaattttgattaagcatttttgcaataatcaaaatagtagatcctcattattcttccagaaaatatcagaaaagaatcactgggctagaaaatgtttaaggtctataaaattatgagaataaagaatttaattgaattatataatacatgtattttaatatgtcttcgttccttccttcttttttctttctttctttcttttttgcttgctctcttgctttctttctccctctccttcgtccctccctctatctttttttctttccttctacaattatattaagtgttggatgtattctaggaattcctctgggtgccaaaatgataacacgaaggaaagagataggaaagaaaaatgtcaaaacatacacggtgatttcaaaaatgttagtacatgaagacataaatagaaggccctgattgtgaatatccgggttgttgagggtagcctagttcgccttggtctatcatctcaaagaaggggatatctttgcttactcctgaaaaatgaggaaaaacaagtccctcatgggaagatttgagggcataactttccacgcagaatgaagagcagatgtaaaggatctaaggaagaaaacagcatggtatgtctaagtaggcagtgactgaataataagtattagggaattacaggtttgtaggctattgtaagaagtttgggttttatttacttaaatttattctaagtcagcaatggagaagggaagatctgatttaaatttaaaacaaatcacttcactgtcaatgggtagtgtttgtgtgcctgtgtgtgtgtgcttgtgtatgtgcctctgtgtgtgtgtgtgtgtttttgtgtagggagttgatgaaggtggtagtttgctgctataagaaaaaatatgtgacacagtggcatgtggggataaatgaggtagatttcctggccctttcccctaacaagatcatcccaaagatgaaaaagtttgaaaatcactattacagagcttctgcactggaatgcacatttgaaaaggctgaaaaagtaaatacatcagaccagaggttccacattaagagtcaagagcaggatccatgcagaatgagaaactgcctgggatgatacggaaagtataatgagtactgcgatttaaaaaaatatccaaatggctaattgaaaccaatgttccaaataaataacagaccaagtgctgggaatgctaaaagctgaggagcagagtccctgaaagaaacagatgctgtgagcagcagggaaaggccagtgtaattggcacaaatatgactgtgaataatgcttttctatgaccctttaagctggaaaagtatatcctagatatttagaaaattttcatctccaaagttttaaggaacaagaaggataccaaagctaaaatgggacataaaatgatagtatgatattcccacagaatggcatgcgttggattctttattgaattaagaaaacaggctaatatatttaatgagagacacgcatttcttgacaattcctttaataaatatttattgagtgcctattatgtgctatgcactattatgctgaagatataaagataaaaatcatataaggtcttcttttcaaggaaccatatttttagaggggtacagaaacaataaacccataaattaacaaagaaagaaaatatacaaaagtaaattgaggacaattttaaaaggagcataatagagagtgactggtacctggtcaatgaagacctctttgatacaagtatattttttaaggccctaaaacacaaaaaggggccaaccatatgaaggccaggggacctttttccagaaagaaggtcaatatttctgagacataggcagagagaggagaggtagagatgagtttggtgatacatgtaggagttattcacatagattcaaacagtcagctgtatcaattaacttttattatgaatgtgctagaaatctatagtgaagtttcaagcttgacagcttgtactacaaaacatcacttatcttacatgtaaagaatgggttgtagagaggcaatagtcagagattacaccaaggaagaagctcatgaagttattaaggatagagataatatttcttggtgataatggaaaatgggttgactcaatagaccaatcaatgctcataatttttaattatattttacttgatttcttctaaatatcagttaaagatgtgcaattgtgcttgttacacttatcaagaaaatttgtaaagcaaacagcctaagtgaagtaatgttctgtattttcatcagacctgtccaactcaatgaacatgtacacactactagcagaaagtgggctgttgtgaagaatagctacatacaaaagacaactaaaaactggaaaggaccacaccaatgtgcttcattattattactccaatgcaaagaataaacacaataagaaagaagatataaaatgcccttttgtcaatattttttcatgaaaaattatcatacaggaaattagatatgtaagttcccaatatgtctattatagcaaggtactgtgaaaggtgctttccaaaatactatgggatataattatcacaataatattacagattagatataattacttctatgttacactgataaaattgagattccaagggctacaaatttcatggatttgtctccaagtctaatgctttttgttctatactacagagacatcacacatcttcatattcaggccttttcacgttatagtacagaccagtgtagctcagtgttcatatgtgccatgtttacttataagttagaatacatataaaagtaactcagttcatttattctcacatgatggagaatgttgactcagccaattaaaaatgatagaatgatgtatcaccagtgttacaaaagtcttttattcttatatttgaaaagacaaaatggtaagagtttggaattacatgaaatgtaatcagtatataatattttatcaaaaaataataaatatttttcttatactttacagagtgtactcattctataaaacatattttctagatttagaattcccaaggcactattctcagtcggaagagaaacataatagttaataaggcatagattttactttaagagagctataggatgtatacaaaatagctacaattaagagaagaatgggaaaatagaaagatcatgtctgaattgctacataagaaaaaaatatgaagattgcatttgagtgacataggcaactgtgagaaggggcaattcagattggaaaacaaagttagtgcaatgattaaaagatatttaaaaaacagaaaatgacggcacatttagttttggtataataatgtgaggggaattagtaaaggagaatatatggagttgcttcaaagatattaaacagctcgaagcagatgtttgttgctttctggacacctagcaaccatagttctagtatcagaaatttatttgaagagttttaacgtttcgcaccagttagctcttatctcttatttctaattctaagtcttacttggaggtatgatgaatatttaatttaaaatttacattaggaaatcttaagtaacagaaaagtttaactatttaagtcctaaataattatggttccttaaataaatattttaaatattttagatatttatttaaggacgatggaagcaaaactagtcaaaagaaaaagggagtccttgtctctaattttcacatctctaatagttccaagactaaaattctattaagatgatttaacctgcaaaatgcaatataattgttcgttgaattttctcatatctggctgaatggggacattttcagttgtctttaccattcttagctagagtgacctattgaaaaatcatattctgtctctctgaaggattgtgcggtttaagttgcccttctatcttaggaggtttagaatcttaatttcatgaactctgtgatgagaaagaagatttttgaaaaatttacctatttattttttatatatttactgtgtataatatgatgttttgaaatatgtatgtatggtggaatggctaagttaagctaattaatatatgaattatgtcatatacttgtcattttatgtggtgagaacacttaaaaatctactttcttagcaatttttaggaatgtaatacatagattatctctagtcattatgttgtataatacatctcttgaacttatacctcccataaaactgaagttctgtacattttgaccaacatcttcccaacctccgaccctagcccctggtaaccaccattttactctcgacttctatgagttcaactattttagattccaaatataaataagataatgaagtatttgcctttttgcacctagattatttcatataaataaatttagcatctaatttaatgaagtctgttaagaaagggaattttgaatgtgactgcacagtgctttagtatttctgggagaaatgtacataagcacaggcagggaaataacaggcattatctcaaacttactgggaaacatatacatgtaaaattccaatttaaagtgcactcactgagaatagttaattaattaagtagtttctttgatatggctatcacttagatattttgaagagagttttgagacacctgtttcaagcatatctgcaaatatatccataattttagagtagacaaccatgaaggattgtgtatgtgtgtgcatcctatatcttagcaggtttttaaaaatgacagattgacttttggctagagatgaactttaattcaaagggttaaatttattattctagattataaaaatcaatatattagtatttctgaattctgaaaaataccaatcaagagaaaaatagtataataaataatagtgttagtttcttatggaagtcttacagcattttgtgttctcacccaggataacagaactgtaaaagagataaaatgctgtcttctcatagcctgattatgaatccctacttcggtgattattacttagagacttttcagggtactgattagtgtctatgaatgctgtacttattaatttgtaaaatggagaaaagtaaccacatcataagttgtaatgatgaaatgaaatgtacaggagaaaatatttggcaaagggcctgacatatactcaatgtttagtgataatggtgaaaacaaaaagttgatagagcttattcaaatatagagatggaaaataatgaaattattttctttttctaaaagtcacattccagcttttcagtaaacttttcacacagttaaaatattttattaactaaaaactcaatttctaaattatgtattcttgagcatctgtcttaccacattttaaagtaattactcatctcactcaatccaatttataatgtacattaattatttatgattccttaatggatacctgttttctcaatgcaactatctttatgaaatttagttgtataaaaatttatatatgaataacagctaatgatcaggaggcaggtcatttttgactagggaatttacagccatcagaataatgatacaactgtaaagaataaataaaggtgagaatttgatggtcaaggagatattatatctgacttttttcttagtttgtatcagttgacattttcacaggctaaaccctcttcaaaactaattaattgaagatttttaaaagtttgatagattgctttttatgctaaatctctcctattaatttggttctcacaataaggtaaactaccaataaaggagttagagtatatttttcaaatccatcttttattaatattgtaatagtccccccaaaattttaattaaaatatacgtatgtatgtacatgtatatgtgtgtatatatatatatatatacatatatatatagtgaattgtattatagcacagaatttgaaataagaagacttgcattcaaattttgcctctatatgtctcatttcattcaggatttccttcccaattttctcatctactgccttactttgagccctactcatgttggtaagcatcagattctttccctttatctttccttctattctacagaatgatttatacattacataattttattttttatgttggtgaaacatggaactctttccacattgaaatatagccttgaagatagctattattccttgagaataatttaaataaataatgattgttttaatgaatattattcagtgaacatttattttccttttccttctcattaccctggaagaattatccttttatcaaaaacaaacaagtaaaaaaccaaacataatctacctacttgcgctataaatcacatcccaggacacctctgggtctttgtttctatcttatcttctttgctcgcctgaaccattattttctcttattctatatggtcatttccatcactacagaaatatgttctctttcttcaaggttaaaagacaaaaaataaagtaaaatcatctcctgactctacatttcccttctgacttccttcacattcttctcttccctcttcactaaatttattgaaaaacactctctccacaaaccatttttactccctcactttacattcacacctcaagcaagtttgtccagggttttcctaaatttcatcactgcaataacccccatgttaccaaatcccatttaatatggtttggatttgtgtctccacccaaatctcatgtaaattttcaatccccagtattggaggtggggcctggtgggacgtgatggaatcatggaggcagatttcaccctttggtgctgttttggtgatagggttctcatgagatctggttgtttaaaagtgtatagcacctccccactctctttttctcctgctctggccatgtaagacactcctgcttccctttcaatgactgtaagtttcctgaggcctccccagccacactttctgtacagcctgcagaaccatgagccaattaaaacttttttctttataaattacccaatctcaggtatttctttacagcagtgtgagaacaaactagtacaccattctatctcttcaatttactgatttgacaaaatatttgagaattctccatatgcctggactcctctactcactcagcatatagcagtgtacaaaagagtcagatatccctgtctttatgaggcttttactgaaaggatgaatagcactatgaaaaaaaaataatgcaagggatggaattttttaacatcagaaaacagatgcaattttaaatagagtagttcggaagaccttactaagatttaagatttaatcaaatttatgaagagtatcagaaattgagccacacaatttaggaaattttctagacagaaggaacagcaaatgcaaaaaccctatgacagaaggaggtgtgacattttgaggaccagcaaggatgccactgtgtgacaagagaagtggggaggcaaggaatgaagtcagagacgtaagttagtaaaccatgtaagtaaatgcaacaagctttttactcagtgagatggaaccactgaagggttctgaactgaggaatgctactatgtgacttggattttttaaatatcacttggttgtttaattgctaatataatatgacaggccaagaatgagagcagatagaccttttaggaaaggtcaaaatgatccaagcaggagaaggtgatggcaggaaactgagtgtttaaaatgcaggtggagtgaagtagtctattgcgaatgttttgaaagcagagcaaggcaggacttgctgatatgagaaaaaatgaggagtcaaggatgattttaaacatttgtcctgaataaatgagaaaaaaaaaggtcatttgctgatatgagaaagactggaatgagcagaccatgagaaaatatccggagtgaagtgaggaagatgttaaatttgaaattcatattggaaatctaaatgaaggtgttttacaggtacttgcataaggtgaaactgaagtttctgaagacatgagctggagatatgatgttgggagtcatgggcatagaggatttaaagctatggaactgcaggggatgacccagaactttaggcagaagcctgaatagagatcagaaatctgaggagaaaatgacaaaggagactgaggaagaatcacggttaaagaaaaatgaaagagtattattccagaagccaaattcagaaagtgtttcaagaaactgacaaattctgatcataggttaaataatacatgaactgagaaattgtgacttccacaaatcataggggtgaaaatggttcagaaaagaatgagaagaggatttggatatgattaattgtaaaagaagataaattcttctatgaaattaatgtaaaggagaacagaaaggctttcagagcatgtcatatattgaccacttccatccttgaaacatgtttactggactttgacaaaatcactctcttctagagagaggtaaagtgttatcaccacaaaatgataaccatgtgatgtaatgcacatgtatatgttaattagcccgatttagtcattccacaatgcatttatacttgaagacataatgttgtacacagtaaatacatacaattgtatctgtcaatgaagaaaataaaactaaatttgaaaaaattactcttctagttttcaatctaccttatggacacttggttcttgagttctcagtgcttaatctttggttgtattttcctgattttacattaagtctttgggggaaatcattaaactccatccatttaaatgctatctttctgggctaaatgtcaactatgactccagcttagaacttctcataaacttcagacatagataatcagagataattttccttcttaacacacctactcaatcatcacttgcaaccacaaatatactcttgaacttaaacatcacagtccacagagaaggcattcttttttcccccatctaaattattttctcattagagatttttacccaaaggattcaaatcagaaatttcagaattgctcataatttcttcttttttggtcatagcaacattcaatcctgtcaatttcaacataaatttatagtaaatctgccttctcttcatttctgccttccatcttaatctaggcaatcgtcttttctcaccaggatagtgcaacacaacgctgtttcctacattcatttttgtcacactatagtatattttccagaaatgaaaaacaaaaaacaatttctcaaagcttaaacatattttccctctctcctgcttaaaattcttctgtgtcttccttatcacggcctgaggacaaggttctacaaccttatttcagataactctcacttaatcctgctatgttttagccacatgggcatttttaggttcttcaaacttgttaagctttttcctctgcagggcctttgtttattccgattagcctcttctcttcaatgttgctgtcctggcactgcctcaactctaatcttctcatgccaaacttattctcagcttttacaccacttcattatgataatatgttccctggctatctgcctaatctagatcctacatcccctgtattattctctattccagccccttccattttttcctttatagcaggttttcaaatgtaagattcctttctttggtctgtttaatgtgtactcacatacacacactatatgtatatacaggaagtcctcacttaacatcattaatagattcagggaaactaatggataacaacatcatttttttcctcatcaatgttttaataaaatgatgttattcgaggacctgctgtaagtcattttacttaaagccacggtatctaagaacctattggaagaacttgcccttctcttttaccatcctgtcccttagcaaagtacatagtacattgttagtaaacttttgttgaataaatatatggatggatgaatgactactctgggcaggtcacagtgggactgagggagtgatttctgagagaacttcattaagagtggtctcttaaggaacttcattaataagagagagacctacaaataactataagacaatatatcttagctggcttgtagaagttgtaacagctgtttgaatagaatttgataacatgaaagctgacttttggtttttagcacttttattgtgtgagacaatgtgcaaatttcctcgtctagaatttcatttaacacaatagccctttgcaagtttatgagactcccggagcagctaaaatgtaaaaacaagctttgaatttaggtgtcctttttccaaagtatgcactcataataagaaatcttataaaagattccagcactcagaaattttatttaaattattttatgttttatcctaatgcatttattatttttgatcacttgtgctaaactatggttttcaaaaaaatgtctttagtaaaaacaaaaataaataaatgctcattctcagaaaggagaaaatgtggaatcagaactgagtcttcctttaatgatgcaattagcttcaattaaaaataaactttgaaataatcacttggacttaaatgtctctatttgctcaagtatcatgctgaacatgccttcactgtcttgatgagaaaactggaggtaagaattttgagtcatataaagactcaacttgctagtttatcagttttgtctcaagggctgaagtaagacttaatgtgactaggttataactttatcacatgttatacaacctctttcttgtgttttttgacatttgttataaagagatacaaactttcctgtcaacatgttttactaaggatcatgtttttatcacctgatatctaacacaattgacctttgtgtttttatagatttcaagttttcaaaacagttaaataaatatatgagtttataaattacaatgtgagagatagtggacatttagagcataagtttatttttagtcatgatataattaactagtgttggccaggcacggtggttcacgtctgtaatcccagcactttgggagactgaggcaggtggatcacctgaggtcaggagttcaagacaggcctgatcaatatggtgaaaccccaacatttctactaaaaacaatacaaaattagctgggtgtggtggcacatgcctataattccagctacttgggaggctgaggcagaagaatcacttgaacccaggcagcggaggttgcagtgagccaagatcgcaccattgcacttcagcctgggcaaccagagcaaaattctgtctcaaaaaataaataaataaatagataaataaataaataaatagtgtttcagttactaatttttcttatttgttgtttgcttatttttccttcaatttttgttcttcaaaatattgatcatttatttctcaccctataaaaatctgagtaacctatgatattttagcaaatactttccatgttaggattttctctgtaatatttttgataagtgtgtttttgcttgtctcctaacttaaaataaggataatgtctattttatctgggaatgcaaataagctattagaataatagtaataatatcttagtaccaatattttatggtttaatagaaaccaaaataggccctgagtagatggaatacagaagggaggttttgagggaggcagaggaacaaattcaggaatctgatttttttagcgagatgcttttagaaaaggaaatgaagaaaaagcataactttggattaagtttaaaactaggatttgattccagggaataagattgcagaaacatgattctacgatgctatagaaaccagcattgctactatcttcaacttaaatcgcacaagagattatctgtttcatcaatatacaaatcaaatatatgtcatacaggtatagctttgtcaatgtatctctattacttctgtgaatacattggccttaccggattaaaaaaaacatttatttttctaacatatattgaaacaattccccccaaaaaagtaaacagtaaaaactactgtcagaaataaattgtaatgataaaatttatttagaaaggaatgctactttttggggaggctttcatgataaccatcttgattcaagagttcctcagccatagacctttttcgtaaagttttctatgaagttaaaaatgtagaactatgagtagttttaaaacaagttattctttagcaacaaaatattaaggactacaatcctcttgtaggaaaaaaaacaaatttgtcccatttagattcagattgattttggcccacagccctacttattatttaattaaatgggaatacactatgcagagctattaagttgtttagccaaagaatacaaaaaaatgtagcatgaaaatacattataaattatacaggaagaattctcacaggaagatacaagtattgcaaggtcatctacacacacaaaggtatattaaagcattcaacatccaaagaaaatatgtgagagaaaagaagagttattgaacaatgtagagcaggcttaaaatgttgtatcctttatttgcaaaataagattgtcataacaaaagattccctgaccttctttgactttaatcagtggttgtaggaagatgattccatttcagagcattgagcgcaagatttagggagtgtcttttttccaaggtaattttatagctgtggaatcaatagtctaacacaatgaaaaaagttaaaaattgaagtctgtgaaagaactacttttagcacttcttatgcagaattttatggaaagtagataaatgaatcaggtaacttttaaacttgctaattaaagtataaataaattatttatttatggttgaaatgtttagtaaattttattaagaatttatgtaatttaatgataaaattataatgcacttctaaaaataatggtatcacctaatttgtgcgctgcttgtatttctatggataaataattttatttaaattgtactatcattgtgtatgcattaaatgttatacatcattatatatataccaaatctcaagagacatatatgtatataaatgcatattccaaatgatatatatgtgtctgtatatatacacacatatatatagtgtgtgtgtcaagtgatatgtagagagagacagagaaacagggagagagagaggatgactaaaataaacccaaaccaaaaactactactgagtcatttggtaaacctagaaggaaggacaaatcattcgttttctcagtcatggttttaactaccacattacacaatcaaccaataacaatggctatataaccacggtttagatgacctaggatttttataaaaataaatacagaaatgaaaaatgtcatcttaggacagaaatattttacatgttgacatattcacaatatgtaaactatgtaatttaaattaaggccatatagaatcaaaagtatttgattctcatttagaattagagctgcaaaatagctctcctaaacattagttctcataattatatgtacgacttaaaaaaaatgtaacatcaaaatatactctcaaatgttttgtcatctgtaagtaatttttgagagtcactgacataccatttaaaagagaaaggaaatcactcaagatttaaaaaataactgaaaaggaatataatgacaatgtaatccatcctcctcattttcattatgagtaaattaagattcaaagatattcagcaatttttatataatgtaaataggattccaattcatacatttagattatcagcttaatgtcagtgcctctcttaatttctcttatttttaaaaaataataaacaaatttgaagtgtgtaggctttttatctctggttcatcctagcctgcagtaattctcaaccattcattaattttgtattatctattccttgttggttttgtatatatgatttgcctgataacaagatttatcacaaaaaatttttccaaactgcagcttactacatgagtcacacaaggacagctagccacttaaacaacagttgcctgtttcaaaactgtctcacaaggcaagctaaaaactgcaagggcctaaccataacttcaagactacaagttttatctagcaaccactgacacttgccaatgaactttcctgcaaaacaacttgcataacctcctctcttcccaataaatccctaataaattcctttctttgttctccagagatgacagaggctatttcagtttgtgcatacgtcctggattaaaatcctattactttgtttcttcccaaacaagtcctttactcttgaagatttgtctctatatgtatttatttcaagttgacagacttttggactcttcaggcacagcaagagtttaaaagaagaacagagttaaaagaagactggtggaaatatttcgtttcagagagcccttgtagattggtgaggacccttctaacagcctttctgaaaaagtagtggaagagtgataccttttagcaccagcctagtagggtgggctttaatgggattgccctgctataggatgtattttttgcagttggcacacaaaaaggactggtgtccatgtctgaaaaaattctaagcaaactcatacagaaataagccaccagtcaaggaaatctagagagtgagagaaaagagagcatctgtgttgggataagcctggtctttttgtgcttctcggggcaataatgtgtaacctgttttatcaaggaggatcatgggataccgataaaatgaggtcatttggggtctatccaaccaggccctctgagaggtagaactaccttagcagaaggagactgggatatggaggggcaagggactaattcgggcaagtgtccatttagatgcatccatctggaataaggaatcccagaagagaaaggcccagcttcaatcacttaaaaggccctggacatcccatgacaaaattagcttaaatgtcaggaccagagaacatgtagccatcttaggtcttaggcctgggtcagtccttttatatcttctccaccctacctcagctagatccaagaaagacctgaaacagtggcaagtaagaaatttggaaaaagaagtaaaatacaaagaggagagacaagaacagttaatcttgtccctcttctttccttatataggcttcctctggacgacaaggcccaggaagggagaccgtaaagaaaaatttgaccttgaatcatatttagtgttttgattactctctagggcttggaattttaattataaagttgaaactgtatttctagttgttacaggctgaattgctctccttaaaatttatgttgaatatctgactctcagtgcttcagaatgtgaccatacttagacaaatgactgtaaagaggtaataaagtttaacatgaggtctctagagggaagcctaatccaatataattagtgtgtttctaagaagaggaaatttggacatagagagcaagacactagaaatatatgtgtgcagaagaaagaccatgtgaagacacagcaataagacagccatcttcaagccaaagagaaaggtctcaaaagaaacaaaacctactgacaccttggtctcagacttctatcctcaagaactgtaagatatatatttctgttgtgtaagccacccaagtttgtggcactttagtaatttgcattaatttagtgtggtcatagaacctaaccgagttttaatcctagggaaggtttctgttgagggtgtttttcttccatcaagctgaaatgatttatttgaatttgtcagtatacctaactggaaaaactagaagatacctaaggttataactaaaatctcatatgcatttgtgatatttttctttttgcatacagttgctgcattttctaactcaaagaattaatatccttatggggaaaacgtaatataatggaatgtataaaattagacttatgctagatagtattagaggacactattaacccccttatgtaaaattatatataaagaaatgagaaatattcattccatttcttaaatatctcaatatcttctcagaacctttttggcggggaaaagacctgtgctacttgtctaacagtaagtatgcatttagaagtactaaaaagaaaaaaaaaagagaaattagctttcaaaggagtattttttaaattattaacagtcagaattttgttgaagtcccttattttatatactccttttaagttgcacagtggtggagggaaatcacaattttatgtgaattatggcttctaaagttctgaaataaggcagtccaggaaatacaataatcatagaaaataaatcataaagagtgaacaataacaaaagctgaggagcaatggagaaaaatgacactgtatcatgttctctcagtgtatttatgtgatttttgaactaatttcttattttcttataattggctagcactagcttagctgccataagacggctgctcaccttatctgttaaggatgaataatcaatatggtagcctccagccacttgtaggttttaatcatttgaaattagctagtataactgagaaactgaatttttaattttatttaattataattaatcttaattttaatttagaaacaggtagtgaaaaatacttttcattacacacaactttattgttttataggctacattttaactgttgcatcatataagatgtagctgtattgtagtgaagatttgggaacatgcatctttctagtactatatattgatactaaaatctttctagtactatatattgatataacattccatgtatttgtttgaatattttatgagaaagcaataattacagtgatactgaagtaaatcataattgctaacaacctatttattatattaattataagttttcttctagtctataaataaactattcccatagaaaaaaatcaatgttcaatatgagatgtgctataagtataatgccctataatttcaagacttaatatgaaaaataaaatgtaaaatatattagtaatattttatatagattatatgttgaaatgttaatatttttgccatattgcttacatataattaaaattatttttgcctatttcttaaacttttacatggctacaagaaaaattaaatatttatatatgtgtgttatatcctttttggctggtgctctgcaaaggagtctagaaccatgtggaggttaatcagaaggtgagggataccaaagctctccacgggaatgataaatggggatacttcatattactgtgaagccttgctaccatgcaaacaacttttatgttactgacattgggagtagtagattcagtacaagaattttggacctagaaagaactcacagtcctgagatattaagtaatctattcaggttcacagactgaagtcggtattcatatttactaacttctaatccagtgctctttccagaacaatacttgtatgaagaaaaattaattcctgggaatctctatttcactctgttttccaatcttagcttctatggccatttcctgctactaaaacatctgctttgaaaaaaagcccttgtcacgttgaaaaactagaaaaattgtgttcacttggaaatctgacagagtatatgaccacaaaatctggagtctcatgttagttatgaaaaatctaaacagtaattgctatattttctgtagggagggaggatattatccaatgaaataaggttatgttcttgttagtttgataatatgatgttttgatttgaactttttcaacaaacatgcactgagtattatgaaattattacctttcccaataagggtcttataattctttcacctcaagctgttttataactacagattccttcttgagtttttcaataacagccggtagtacctgaactaataaaaggttaaataaacctgtaatagcagatggtattattatttgtttcactagtatacatacagtagcaatgaatagactctgctgatatctcatatgattaatttgtaatatatttgtctgttaaatgtttgacataatttaatggggataatttttattataatatctattatatagatacttgtaattaagtggttgttttaaattaacaaaatgataaataagcacttatattaagactcagaaaaggtgtcttggagtacaaggtggaccgcccaccttgtgcacagcagaagtagatccctacaaaattttcagttacaaggaagtgaagcctctagtgaaactatctaatattcactagttgggtgcatcccatcacttttaagactcatgggctatcaagaaactttttatctagaagctttcttgaaaagggaaggaggaagtgatataagccctgaaagtttgaacatttatcctaagaaagctgacttttattctagaagagattggcaaattttaagtttattctcttatcagcaggaatgtgggaacaaacaaaatagttatgcaaaatgatctatcattttatcagtttaataattaccaagtactacatttgaacctagtttaaattttagaaaatattgtccatattataactagttattgacagattatctcctatttattgtagttggtacatttaaagatagtaattgaaataaaaatcattaagttgtatgtggatttttacaaattccatgagatcataacatgaggctattataatttgtctttgactttataagtactccaataaagaataaataaatatacaaacaaacccatatttacatgtattgaacactgtcttaaaattgcaaaggtaagcattaaagttttggggtttttaagtaagactatccatgatattttctttttaattataaaccagagtcactacagtatcaatgctatgaagattaatccaactccctagaaaaaaattgtataagggattctctaatcttcaaaatcctaaatcctgtgacgatttattaagtacactctttttttctttatactttcctgctgtactttgacccaaagcttattattttctgattttaagtaattatttttatcagaatctgaatttaatgtttctacaactactcttttctcatgaatgatgtcctctaataattctggcagtctcaacattaatacatattgttaactcctaatcagaaaaaaggattataaaacagctaaaaaagataaaggaaataatcaacatgactcctaaaattatactttatttctaaaaccttattttatatattaaaactgtaccccaattctaaacacagttatatggattaacttttaattcatgaattttaaaatgttaagaaagataaaatgttttactagaaattgttatattggactagagttaagcaaaaaagtgtcactagcattgtgtttccaatgtagaatagtttgttcagcttaccagggtatgtttcacagcaaaaattttatttcagggaaatttgaagtaaaacaatatttagccacttttctatcaaatacacatacaactaatgaacagaaatttgagacaggaggtatataaaaagattgccaaatctaaggattagaattattttgttaaaagtgtagtcaaactttcattttcaatattgcaataactaaaactccttctttacatttataaactttcccagtattattgacttagattttaaattaaattaatgaattttataaaataggaaaaatataatttaaaatcgttcttgattaatttaataaaaggccttaaatcttatactggcatgactgtaaaatattcatttgtatcacagaataaatgctatcagaaaatttttaataattgctttagacagaccaatgattatttagatagatcattttgattattaatgtttgattatttttgctgtttctgtagacattgtactaaaaagaagatgagtctcatagactgtcaggtccataaagcaagaagtaaaataattttctatgtttttgcttcacaacaaaaattgttttaaaaaagaatttccaagtgaaagtatttatttagcattgaaggaaacttgaagaaagatgataataatgtcaaaatcaaatacaaagaaaaaagtgcaagattagagattattctcaaatactacataccaatgaaactcaaaattctgttctcttaaaactcagtaaataaaagtagctctcttacttcataagcttaaaataatgcagttggcctatgtatgaaagcatgttttgagataataatttaaatatattatttataattttcccatagcatatactcagtaaaaattaaataaaacctactatactatgaaaatatatatatatttattgaatatttctggaattacactaacgaagttccatctacaatctttaccataaaagtaatctactcatctatgtctaatatggtttggctctgtgtccccactcaaatatcatcttgaattgtaatccccatgtgttgagggaaagacctgtaatcccgatatgttaagagagggaagtgattggattatgaaggcggtttcccccatgctgttctgttgatagtgagtgaattctcagaagagctgatggttttataaatggtaattttttcggcactcacacatgctctttcatgcctgccaccatgtaaaacatgcttgcttccccttctgtcatgagtgtaagtttcctgaggcctccccatccatgcagaactgtgagtcaatgaaacctcttttctttataaatcatccagtctctggtggtccttcatagcagtgtgggagcagactaatacaatgtccaacatccctttgataatacagttcatctaaattgtctgaaccaaaagttattggtcttctcttttcatgtcacactcctccaccctatccttagaatcataaatacaactcatattgagagttataacattagagtaggggttcatgactagaatggtgggatatatgattccctgtattttattaacaacggatatggtgaaggtacaacaagaaagaaaaacaaagatagaaaaaatatatcattgaacatattagtgaaagcaaagattagaataccatctctctttacagaaatttgctttgatcctgtgctctatttttaagcctggactatatttatgatttcagaaaatctgttatagaaaaaaaaattgtttctcagttttacttacaaactagcctattttaaaaatcagttccaagaaaaagtgtttttcccttgagaaacgtgggcatcctcatttgtgatagtgagaaatataaagcctagtgttttatctttttaactgtagctcctggattcaaattttatgtttcatcacaatatttaaactattcatttttcatagttagaatgtgtgctttctcatctgttccatatgttattatctctttccagtgaagactctttatttacttaatgtcttacttatactataagaaatctttagagaacaaatgagatcgggcgagttaagggtggtatggctatccattgaggtggtttgattataaatatcaaaactcaaatctgactagaggtaaaagggaaataattataaggtcatggtgggggcttccagagccaaagggaaatctacaaaagcagaaacctaaaaggacaggaaccagggcgtttggaggatctagatagctaatcttcaggaaactgaaggatccactggctccaaccatttttcttctgctctttaaccactgggctcaagagcctggggagcgagtccattgtttatgtagtggattgatattcagtatccattctgccctcattctagagccccttcagtcattgttaaggctagaaagctaaacactatattccatagtatagtttgcagacagtgttccagaaggtacttaaaaatattcagctagtcacatgtgtttgtgtgaggtcagaagggcagaagtgaggtggaggccacatttgtgttacttctgcaatttctggtgcagaacatagattgcaaggttgttgatttttctgcaacagctttagctgaaatcccagtagctagccacttatcagatactgagaggatggcatgggtcatccattttgttggtgcagtcccagcaggcatgtcgtgtctctggagccaacaattgtggccatggtttctaacctgttagtcacagctaacgttcctatttctggtaccagtggttacagcaacaatcagaagttggcactgtggttcccacttccttggctttctgatgttaacagttctctttgcagactattatttgttatataacaattatttgttctgcaaataattagtggagactccattctctgtaataaatccccttctgcttaaacaggtaaacagttccattttagtccaactggccatcatgcctcatatgcctaccgcttggtggggctgattggcagccccaccaagattgcacacacaatggaagagggataattcccccagaagaaaatgagatgcccttatcaagaaaaaattaaaaagggatgactggttgtgggtggcagaaaataacaaccaaccatcctgtaaatgaatacaaagataattaatcatcattttcagggtatcttgtaagcccattacacaaagcaaagttttctgaagtcctgaaatattacaacacattatgaaagcttaactacccccaagggaaggagtcagggaatgtttcagagacatctgatctcagtcttaagactcaaagaaatatgaaggtctttctaggtagtgggaaattaatgacttaatttgtactctgtgtctgtatgtgtgtgtgcacacgtgctcatgcacatgtgtgttgagtatctaaataaagattgaagagtcaaaaaaagaagaagtcttaataccttttaatttacaaaacaataatatgtctggctactgtgactctgtttgataaaagaaaaaccaatgctcagagaactcagcaattagtatctttatgattcaattctaaccttctgatcctattctttacttaatatactatgctgcatcccccaaaatcttatttacctttgttcagtaactgtacacaggtatttatgtaaaaacttcccaaatataaaaaatggatgaactatgccaaagttacttgtttttgactgaaacaatgggcatctaaaatgccagaagtctctgtgtaattaaggtatatgaaagggcattttcgatatggtttgaaagttctgtccaataaatatgcttttctttcaatagaagatgcccagttgatcccaaaatgatcatagcctatttgagaatctatgtaaaatatcattatctttcataacttttaaatattgtgtgttgctattaatatatctttatttcatgaaaaataaatttctgtaaaatatttgcctgcataagaagaatcacatacaaaaaattttggaagaaaatataaaaatcaaattgtgattaaaatgtaaggaatttagaggcttgaatcaagaatataaaattactcatatatttacatatttaaaattgattaaatactgcaatgcctaaacttacatgataaatacaattatatgaatgcctatagctatggtatttatgattgcacattgaaagagaaatgctgaatgttgaataattttaaaaatgagatatttcatacttgtattattgagccttatgaaataaaaatacttttaattaaaatcttctataggtaagattttctttcttggacaattgagtgttatctaaaactccccttccaatttaaaaaataagtaaatatgacaatgtattcatcgaaatggaaaagaatagagtttagtttatactaatgaccaagtgacaataatatagagttttcaaaaaataagtaagaggacttccaaacaccacaattaaagaaaagttttactatttaggtgagaagtagcacaatccaagttctcattaatagagggttaatggaacttgaatggaggaacaatagtttaaaacaaagacaaatataatgacataatattgaagtgaatttgtgggggcagagttaaaaactaaataacttttttttttaatcaaagaagagacagtaataaattatttaagtaagagatttctattataggtaaactaggaaggcaaaagatgttttattttaaatacgagtgggcatattcaatacaggagctcagagtgagaatgtattttacgtattaaaggctttctatttaaaccacatttttaatacttttgaattgatatagaactatgctttttagcatgctattctcagtctctacttaatcctatttaaaattataatatctaaagcattcaggaagctagcatataacataacttaaaggtggttatatttgggaaagcacagcagtgtgtgtctatgtacctactccatcaattatggaacacactataaaaaatagctaatggcattcaatgaacccactagtagtttgcagttaattttcatggtatttaataaaggatagagattaaatagaaacgttatgagtaaaatattcagtctttggaaacctgcagattcctaaaaatattaaataattataggtaaatcaataatagttactgagtactcggtaaatatatgagttatttagaaactgagctgcatggagacttagttttgacttttgtataatatattacacaaaattttcaatcttgaattagttttaatgtagacaccactaaaatgaaatagtagcatggaacaatgtaaaaagcatcgttaccatttcatgatagggcatgtattttggcatgacagaattatgattttgcagccatttaagttatcttagtacacatatattttttaatttaaatttcttcattatgatttcaagatttacttctcaattgaatgtatgctgttgaggtagaatattattttaaggtaatgcaatcagaaaaagcaagcctaaattaggaaagttttaaaagaataatatgcaaaggcatatttttataataaaactttcccttaatcttattataaaatcaaagcttcaattttcttaaccactgcatttcctctgttatatcgatataaatcccatccctcttttgagtcccttttcctgcagcaaatagaaataagttgtacctcataaaacacatcttttccattttactacagtgatgctacttttcagtgccgaaaacgcataatgcttgaaaaccacaattccaatcttaaaaatactgcaaaagtcaattaaagaccaatgagtagcatgctgaaatttataagtaagtacacaaatcgactggtagctttgtgccattgtcttatagtgcaaaacaaccctatctgaaggtaccagctccatgaaatcatattgcacaaaacaaatgaaatatcgcttaatatttgaggtaggagatctatttttttgctccagtttctacatataaatataaaatatatgctactttatttctgtttagaaaaataatagaagccatttgaccagaagattccatgaatctagtagaaaagatcacaggaatcgaagaggattgatttttgaatttctgccatgccattggccttaactaattgtagaaaggaatcagagccacagagttaggtggatgaaaaactccacaagtaaaagggtcaacctagagataaagaagcttcacaatatcttattttcaataaaatagtcctctaaagtacacaaacttttagaaattgaaattgggaacaggataaaatatttttgcaaatttaaaagtgacattgccttaaactgtttaagattcaagttaccatgcctaaacagctatttttaataaaatatgtgaaaataaatttttctatgaaagtttatttttgaactctaaagatttagtgttttgtgatggctaatattttctattatgatacatgttaacacattgcatagttttaaaagcatatttgcatttatgtttccattccaattaactactttagaaatgatcattattgcagattttctacgtggactttgtcgaaaatcttgattttaagttactttcctaagaatttttattacagtgatactcagtgcactattacgaaagtcaaattacaaatcacatcaagctgttgcagtttttgagagaaatcttattaatagaacagcttcagagaggttactggttttcaaaatacaaattaattgttgaattttgtattccaaagaacaatatatgatttaatgccattttgagtactaaatataagcttcctaaagtcatcatattaaattttcgaagtgcttaggactgaagactactaaaggggaaagcattaaaaaaaacaaaaaacacagataaatggaagaatgtaactgtggcaatgcttactattccctgaaaagtagctgatacactactgagaatgaaatgaattatttacataagtagtctgaagataaagtacactaagctcacatagtattacagaacattgtagaagctacattttcattagtactccatcttcataataatcttgttccaaagagtttttcaagttaatgcatcaaatattatatcctatgtattgaaaattatttatgttaacacaattggtagataaaactcctaacaaggttaattaaactagcagtaacaaacatgctgcatatggaggtgagtttcgattgagaaagagcgtacatgcaactgaaggttttctgcagtgatttgcggtacaacttcagatagtatatccaattgctgaagcactttattaaagaaaaatattgcatctgctacatactaccttttagaaatcataatattcattattctgaatattatactataaaatcaactaactttaatactgtaatttagttatgatcacattattgtctcagcaacagcatgaccatttttttcaatacaaattccaatttctaaatgctaaagacatttttctatcacaaaacatagttgtgtacaccaaaattattttacatatcaaaagaggcaaaggtattccataagtataccttgatagggagcactaaatccacggtatcgatgattgctgtctgtaacaaaatgcagtctgagccagtttttgttgctgataattggtggtggtatattcattccagataacctgaattacaaaagacaacaacaaaaaaatttaaaaagcttttcagcagtaaacgttttcacaaaattgggaccaaacaaatgtccaactatattcatgactttgcactgtcaactttttaagcacaaatgaaatagttcttttatgcatagaaaagtcaatcacagaatagtgcaattccaaacacatgctgttccaatcaggttgtgtgtattaatacaatcaactataaaactttaagtgcacatgatttttgatttatccaaatttatttactgcaccaataatttatttatggtattgttttattagtattatatagtttatcatttattaatatgttatatattgtttattatttattatatcttatttattatttattatatatattgtattcttattgttaataataaacataacagatattgagctgatggtgctagtcaacgtgcttctcatatatgtattgatacaataaagttacaaaatcgaaagacctcataaattgatatccttatttccagagtgagactgtacagttattttcttatactccctcctatccacttaatgttttttcagtatttctcactggatggcaaatttcacagtttattttcatagaacaagcattgcttttatgtaatttcataatcttataaatgttcatgactagctttcattagaatatataattctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagaatatataattctataatgtattagaggcctgatccaatggagaggcagaaaacagattgtatatatccaaacaaatatagttggatatgtagtcttcacatatttggttgcaagaataccatttataatatactcaaaacaagtatcttaaaacaaaatattggaactatgctccagatattggtcatgattaatatataaagtacctcttgctttataattttttgaagatttccagcaaagcagtttttatgacatcatgaaatagaaaaatactgctgtattatacttctaccatatatctaaccatttaaattttaagtgtttgctataaagccaaagtaaaagagtctccaaagcaaggctattacatagttaggaagagtttcagattaaggtttcttaataacacgttcttaataataagagtttcagattaagagtttcagattaaggtttcttaataacaagtatatatttcctattcttcaaagctcacagttttcttcttcagaaggcaaaataaacagctgatttattatactatgtttgtggggtgggagtgtcaagaggaattacaaatattctctcaccttttggcaattagtcatgctaggggaacagtagaaggaggatggaaaatctgtcattgtatatgtaatcagtgttaaggtgtaggtacagggatgcaaggaccctctaaccaatactcttcatctttatccctgaaaacccaactttcctaagatgtgtgggagctagccaccacttttagtggatgaccacctgcccattaaaatgtaaaatcacctttattgtattattgtgtctactggtgtacagaatgttgaattccaatatgaaaacattgggataatttttatatatttctcatttttattcttggtttgcagtgcattttccgtaatgtttccctataaatctattttctcttttcatagggatgaatctgtttatttgttgagctgactgactttttttccaatctgaatttagttaacaaaaatatataatataattgtataattttagactcaagttttaaaatttgctttcattactttcagaaaatatacaggttatgtttactcttgttgattaaaatagtaactcagtgaaaaactatttggatttgtttcaattatattttcaattgagtagcatagttcatgccagattttgatttacaatttggttttgttcaattccctatttcgatgaacatgaatatccgttagggaaagtttaaattatttttgacaggctgcacacatttccagatgtaatgagactacaatgcatggaggtgtgtaatacaccaaagcagagtttggagatgaccccctaaaagacccagttcagtacatgagaatcggctccacaaggacattaagaaatgcgagaaaagaaaaaagacaaaatgttcaataaaaatgataaactttccatcttttccagggacatgaaaggtaatttcagtaatagagtacagtaaaggcaagtaatagctactgtgtaactgcagtttgcaacttgaatttactttcagtaatctaagggagtggacctgaagaaagtagagctgcagtagggagaagtagaatgtgcatgaggtggagcaaataatgataatttaacaagggtgaaactaagaagtattcctgacagcctcaatgcttcagtgtatgaggcaagaccttagataagccaagaaactgaactagaaagcacttgtaccacagcatccctctgccaccagagagaaatatacagtcattggttataggcgagtcacatgggctttgaaaatcacagtcactgaataatgttcattatttacactcattctaaacaatatggtttggtttatggcttatggagaaatctcacaaataaatctctatatctctgtccttatttcacatgttatcaggaaaaccaggaaatgagggattgagaatatatgccacttggaaagattccattaaactacttaatttagataattactaaaggagatattctaaaatataacttattgttatccctgtgtcaaatcactgtggtcatttaagagtaagcaaattctagcataaagtcaatgagaataatcttttaataagaaatagattgtacacatttattcaacagttatttaccaaacattaactatatgacaaataccaatggtaaaggttggaaatatgatagtaagcaagagaaaaatcatggttttatacagtaaaattaaaacatacaaacaaataaataaataatatatatttcagatagtggcaaatgacatataacaacaataacaaaaaacccagtaacatgataaagaatttctagaaataaagtttccattgttttaatatattttccatttcaccctaaaaatctccatactcaggattatatgtcttaaaccactaaaggggatttaggataattatatcaagaaaaatatggtcatgataaatgtcatacatttgttccctaatactctagttatttgtatcagaaaatttgacgtgtctcttgagtaataaatacattgtaatggaattactaaaaaattattaatgacatcaaatttcattgcatgtttaatgaggaaagaaatactgacaataatacagagtaacttataattaatctttgcaaaaaatttttagttctccaatttactgcagaaataatgattaaatcatcaatttatatttaaaatcctatatgtttctattgtaattaatcctttagagaatgtaattataatccttacaacatgattttaagaattagttaaacataagaaaattgagagaatgacagcttttttgataaagttcataaaactattctgagcttattcttttttttctttaatgttaaaccgcttttattataagataaattgtcaggtcctcatttcagccatatctggttttcaaactttctcaaattttgtagtttcatcaacagctatcatttttgattgctctgacatctactttttaaaaaaatcttcccaattccctaaaatcatccaaatgtaatggcctatctatattatccataggtggagtcaaatcttaaactcaggatttttcacatcattacctccatgactttgtatccctctttttcacaattctcccactttcctctaattttacttgtctctctctctctccctctctcaagcatgctcccgtgctttctcactctcttgcttttaaaccagttttgacctccttccttctctagcacttagataagatgtatccatcatgaatcttcatgaatgttctttatgaccttgttagattatggccctatgttgagctgctattagttgctcaaattttattctttcatcttatccctggaactttgcatatacttcgctttgaggctgaaataaatatcctttctttacatttattgatttactctaaatctttctcaggaaaaccagacaaagttccatggttaagagaggtgcccaatctccttctctgtcctcacagaccacctgcacatgttctcatcatatcttaattttttatgtttaacagacacataacaattgcacatacttatggggtacaatgtgctgtttcagtacatacatacattgtgtaatgatcaaatcagagtaattagcatatccatcacctcaaacatttatgatttctttgtagtaggaaattcaaaatcctctcttctagctattttgagatataaaatatctttttcgttgactatagttaccctacagtgcaataggacactggtacttattctgcctttctagctataaatttatacccattgaccaacctctcctatcaactcaccaccttcctcagtctctggtaaccactgttctatttgctacttctatgagaccatcgtttttagattctgaatatgggtgagaacatttgatatttatctttctgtttctgacttatttatcttaacatattttccttgaggtttacccatgttgtcccaaatgacaaaatttgtttctttcttaaggctgcatagtattccactgagtattgtgtgtgtgtgtgtgtgtgtgtgtgtgtgtttgtgtgtgtgtgatcacactttcttaatccgttcatacatcattggacacttagagtcgattacttgactattgtgaatagtgaagcaataaaaataggagttcatatagttcttcaacctattaacttcacctcttttggatatttacctggtagtagtattgctgggtcatatggtagttctatttttaattttttgaggaacatacatactatttttaataatggttttactaatatatattcttgtcaacactgtagaagggtacctttttctctgcatctttgctaacacctcttttgtctttttgatagtagccattctgactaaagtgaagtgatatctcattgtggtactgatttacattttctggatgactagtgatgttgaacatttttttcacacacctgttggccacttttcttcttttgaaggttatctgttctggtccattgccaattttttcatcagtagtaaagtcagagcctttagtgtatccatcactggagtaatgtacattgtacctatcaagtaatttctcatcatccacccctctgccatcccttgacctttccaagcatccattgtctatcattccacgctctacctccatgtgtaaacattatttagctcccatttataagtgagacatgtggtgtttgtctttctgtctctgagttgtttcacttgagataactgtctccagttccctccatgttcctgaaaaatatattatttctttttttttaaggctgaaatgtctagatctttttcagactcttcataaatttcctttctttagtgtctgctactgaagtcttttgtgttcctttggaaggctcacatttctttgctttttcacatttcttctttccctatgcgtatatctgtgcatctggtagaagagtcacctttccgattttatgtggtagttttggtaaagtgaaacattttcatgtatatgcgtcttagggtgtggtttagtagggtgttttggctttgattctgggtagaagcaggagtgtggtttatgtgcagtttcttcagctgtaattcgcatcagcaatgtctgagtgtgtcagtgctctggactgcaaaaacttacggtaataatggccaccatgatagtttcagactacgcatacttgggtgtgatagtttggctggcactagggtgggcttgctggagtccaggacctccactaggccagctatattggtccaggagcataccgatgcagtgaattatctagggtggaaataccttgcagtgggaccaccacaaggctaactggtggttcgggcaaatgctcacatacatgagttgactggttctggagtgggttggcaggggagtggagccaccactgggttgaatgttgagctgtcaggcacacatgggtgtgataggtaagccatctctgtggtgattttctggggagtcaggacaagcccagggtcagctttcccactctgtataactgcctgttccattggagcagggcatagcatagtctcagacactggagtcacagctgttctgctgaacctaggctccaagtagccaggtttttgttactgcagccatctgtgtgagtgtagtggaatgtcagtagcacatcacgatggataaacaatgactattggctcccataataggatgcactacagctatgggtctggtaccatcaagatagtgatgtgctatagcaccctgggtcacagggatagggggtgcacataggctcctcactctggagcaatgcagccatgttaactccaggaagctccccaaactacattcagaggcagtgaggactgtgggcctttcttgcagcaagaactgtagatgtgtatgtcgggaacggggactgctggtggcctccagcttaactttttctcacaaaaagaagtctctcccatccccaagctcatcccagcagggggaacagagtggcagagataggtgcttcacttactttctaaacttccattctgggtttctgtgcttcacagagatttcaccacttccttgtggtgaagtatccagcatactcttcattcactctagttggaatgtagttctctattcattgttttggtcctttgtttttggttggacaagtaccaggcatctctaggaaactatcttgctctgaccacaaaatttatgattagccatttattactttacttagtgataagttttctatgtttcctattattttacattttctttaacagggctgttatatccctgatacttagcataatgattgatgcatagtgagtgtatactgtcttatatatgtcaagaaaataaatgaagagaagttatttgggcacatgccctaactttcagtctctttgaatttttatactctttataagttaggtcaatatttcaatttatattattattaaatgttttagttcttttcttattcaaggcccatctaaaattctatctccttcatatgtcttcttcaactcccctggctaaaatttatatttttgttttctgaatatgaaaagcacttggtataactcttcctatggcatgtcttactgctttcaccttgtttatattatataatctatgttctaaattataagaagctgaaaagatctgcatggtatatatcgaatccataagcacatttcaaactgtagataatgaattatgctaattaagtactatcctattacaaaatttctccaagtgtgttctgaacattagcaaccaaaaatgcctggggatggaggaaattacactgtccaataattactaaattgctcttttgtaaccatattctcttcctgtagttttaaaatgttttcatctagaatttcttaaaactgcccagcaaacattctcccattttcatgctttgccataatatcagtaacatgcaatgaaatttattctaagccattgatattgttcattgcctcatgtctgaacaagaatgcattttatagtcccaagaaaaactagcatattcaaaaatactcaaaaaaataaaaaaaactttctgttgtgttgtgcggggtactaaaagttgaaaaaatattttaggaactaaattaattcacttatggaatgacgttaaatgcattaattttccacactgtgcaagtcatgtatgtagagtgtacagatgtttacatagaccaggtggtgtttccttgtcatagatgcctgactgtgctattgattaggtagtcaaaagtcactggacatcaggacacagaattctgcatggtttaaaaaatagcattacaaatctaagtattgtgttaggcagtccactcttcagaagcaagatattacaaagtagttacaaagcaaaggagataattggctatagtaagctttatttcctttccttctccccttttactcttaaccacacaccataaaacccacataccctattctgtaactctcttctgatttcccacttatcacttatttccaggatctatcctttagatgaattctcttataaaaaatggatcttatagatctgggttccttttatctagaaacatgcttcagaaaaatctatgtttatatattagatataatatgtatagattcaaataccaaattttaatcaagattaaatgcacagtttgcatagaattacaggcatacctctttttttgcatttttgtttattgtgctttgcagatattgtggggtttgttgttgctgttgttttacaaactgaaggtttgtgacaatgctgcattgggcaagtggcatttttccaataacatattgtcacttcatctctccatgtcacattttaataattctcataacatgtcaaaattttcattattatttctgttatggtgatgtataaacaatgaaatttgatgttactcttctaattgcttttgggtgtcacaaactgtgcccatgcaagatggtgaacttaatcagtaaatgttgtgtttgttctgacttctctactaatcaaccattcccttgtctttcatttcatccttgaacatctctatccctgagacacaatattgaaagtgtgaaaattaataaatatacaatggcctctaagtgttcaagtgaaaggaagagtcacatgtctctcactttcaatcaaaagctagaaattattaacctgagtgagaaaagcatgttgagagccaagatagatctcttatgccaaattagccaagttgtgaatgcaaaggaaaaattattgaacgaaatcacaaatgctactccagtgaacacacaaattataagaaagcaaaacaatcttttttgctgatacggagaaagttttagtggtttggatataagatcaaaccaaccaccatattcccttcagccaaagcctaattcagagtaaggccctaactttattcaattccatgaatactaagataaatgaggaagctgtagaacaaaaaatctgaagctatcagaggttggttcatgaagcttaagaaaagaagacatcttcataatataagtgcaaggtgcatcagcataaagtgacgtagaagctgctgcaagctatccagacggtctagctaaaataattgatgaaggtgactatactaaatgacagattttcaatgcagaagaagtagctttctactgaaagaaaatgtcatgtagacctttcatagctacagagaagtcaatgcctggcttaagtttcaaaagacagactgactgtgttgtcaggggttaatgaagctggcaactttaagttgaagctaatgctcatttattattcaaaaatcctagagcccttacaaatcattctaaatctacactgcctgtactcaaaaatagtccaggaccatatggattcacagcagaattctaccagacattcaaagaagaattggtgcaaattattttgacactattccacaagataaagaaggaaccctccctaattcattctaagaagccagcatcaccctaataccaaaaccagggaagggcataaccaaaaaagaaaactacagactgatatccttgatgaatatagatgctaaaatctgtaacaaaatactagctaatcaaatccaacagcatatcaaaaagataatccagcctgatcaagtgggtttcataccagggatgcagggatggtttaacatatgcaagtcaataaatgtgatacaccacataaacagaattaaaaacaaatatcacatgatcatcacaatagatgcagcaaaaacattcaacaagatccagcatccatttatgattaaaacacttagcaaaattggcatacaagggacatatcttaatgtaataaaagccatctatgaaacacccacagccaacattatactgaatggggaaaagttgaaagcattccctctgagaactggaacaagacaaggatgtccactctcaccactcctcttcaacatagtactggaaatcctagccagagcaatcagacaagagaaagaaataaagggcatccaaatcagtaaaaaggaagtcaaactgtcactgtttgctgatgatatgattgtttgccttgaaaaccctaaagactcctccagaaagctcctagaactgataaaaaaaaattcagcaaagtttccgcatagattaatgtacacaaatcagtagctcttctacatgctaacagcaaccaagtgaagaatcaaatcaagaactgaaccccttttataatagctgcaaaaaataaaataaaatacttaggaatacaccaaaccaaggaattgaaagacctctgcaaggaaaactacaaaacactgctgaaagaaatcttagacaacacaaacaaatggaaacacatcccatgctcatggatgggtggaatcaatattgtgacaatgaccatactgccaaaagcaatctacaaattcaatgcaatccccatcaaattccaacatcattcattacagaattagaaaaaaaaaatctaaaattcatatggaagcaaaaaagagctggtttagccaaagcaagactaagcaaaaagaacaaatctggatgcataacactacctgatttcaaactacagtataaggccatagtcaccaaaacactttggtactggtaaaaaaaaaaaaaaaaaaaaaaaaaaaagataagcatgtaggccaatggaacaaaatagaggatgcagaaataaacccaaatccttatagctaactgatatttgaaagctcaaaattgatcatggacttaaaagtaaatctacgaaacacttagaaaaacatatcacagaaaatctttgagatcttgagttaggtgaagtttcagaattaagcccaaaaacaatattcataaaaaataattaacaaattggacatcatcaaaattaaacacttctgctatgaagaagatactgaataagaagatgaaaagacaaatacaaaatgtaaaaaaaaagtgttaatatatcatacacttgacacagaacttatatctagagtatataaagaattcccaaatgcaactgttaaaaagaaaaaaattcacaaaataagaggaaacttgaacaggtatttcacagaagaggatttacagatggcaaatagttacatgagtagatatttggcaaatgcaaattaaaatcacagtgagatattatgatacacctaccagaatggctaaaattaaaaacagtgactatgccaaatgtgaggatgcagagaaactgaaccactcatataatgctagcatgaatgtaaaatggtataccaacactggagaagaatatcagtcttttataaaactaaaattgcacttgccatgcaattctgaaattgtactattgagtactcattatcccagagaaatgaaagcttatattcacacaaaaacctgtacatgaatcttcaaagtagctttacttataatagcccaaactttaaagaacacaaatggtctacaacaggtgaatgattcaacaaactgtagcatatccatatcatggaatactactcagcattaaaaaggaacaaactactgatatacacaacaacttgcataaatctcaaggtaattatgtataaaacagaacattaagagcaaaggaaaaagcgaatctcaaaagttacagattatgtaattccattcatataacattcttggaatgaaaaaattaaagatatatagaactgagtagtggtcagtaggtgttatggtggggcaggttaggtgggaaatagctgttcctctaaaaggatagctgaagggattcttgtgatggaatttccctgtatcttgactatagcattgtgataaagtgcacagaataaaatacacttgcacactcacaataaatgcctgcaaaattggtgaaatctgaatcagttcagtagattgtaattgttatgttaattttcttgttgtaatattgtgccatagttatgaaaaatgcttctcttgggggatagtgggtgaacaatatatggggttcatatggtttggctttgtgtccccacccaaatctcatcttgaattgtaatatccacatgttgaaagagggacctggtggaagtgattggattatgggggcagtttctgcctgctgctctcatgatagtgagggagttctcatgagatatgatggttttaaaactggtaggttctcctgtgtgtcctctctcctgctgccctgtaagaaagcgttttcttctctttcgccttctgccatgatagtaagtctcctgaggccttcccagccatgtgaaactgtgagtaaattaaacctccttgttaataaattacccattctcagataatatctttatacagtgtgataacagactaatacagagagttggtactagtagagcgagttactcctataaagataacctgaaaatgaggaagcgactttggaagtgggtaaaaggcagaggctggaagagtttggagggttcagaagacacgtagatgtagaaaagtttggaacttccttgagacttgttgaatagttttgaccaaaatgctgatagtactatggacaatgaagtacaggttgaggtggtctcagatggagatgaggaactgactgggaactggagcaaaggttactcttgctatgcttagcaaagactctggtggtattttgcttctgctctagagatttatggaactttgagcttgagagagatgatttagggtaactgccagaagaaatttctaagaagcaaagcattcaagaggtgacctggcttattttgaaagtgtacatttaatatgaattcataaagagatggtttgaaattggaatttacgtttaaaaggaaagtaaagcataaaggtttgaaaaatttgcagcctgaccatgtggtagaaaaggaaaacacatattctggggagggattcaagtcaactgcagaaatgtgcataagtaatgaggagctgaatgttaatagccaagacaatggggaaaatgtctccagggcatgtcagagaacttcacagcagctcctcccattccaggcctaggaggaaaaaatggcttcctgggctgcactcagggccccattggtctgtgcagcttcaggtcttggtagcccacataccagctgttaaagctccagccatgcctaaaaggggtcaaggcacagcttgggccattgcttcaaatggtccaagccctaatccttggtggcttccacgtggtattgggcctgcaggtatgtggaagacaagagtttgaactttgggagtctccacctagatttcagaggatgtatagaaacacctggatgtccaggcagaagagctctcatgaagaacctctactagggcaatgtagaggggaaatgtgagttggagctctcacacagagtcctcactggggcactgcttagtggagctgtgagaagagggccaccatcctgaccccagaaaggtagatctaacgacagtctgcaccatgtgcctggaaaagccacaggcattcaatgccagccatgaaagcagccgcaggggctgtaccctgcagagccacaggggtagagctgcccaagacctgggagcccacccattgcatcaatatgccctggatgtgaggcatacagtcaaaggagatgatttaggagctttaagatttaatgactgccccaacagggtttagacttgcatggagcctgtggcccctttgttttgataaatttctcatacttggaatgggaacatttacccaatgcttgtacctgcattgtatcttggaagtaacttttgattttgatttttttttttttttttgcttttgcttttgcttttgcttttgattttacaggctgatatgtggaagggacttgccatgtctcagatgagactctggacttggatttttgggttaatgctggaataagttaagactttggggaactgttaggaaggcattattggttttgaaatgtgaaaagtacatgagatttgggagggtctggggtggaataatattatttggctctgtatccccaaccaaatgtcattttgaattgtaatccccatgtgctgagggaggtacctggtgggaggtgattggatcatgggggcagtttcctccaagctgttctcatgatagtgggggagttctcaggagatctgatagttttaaaagtggcaatttcccctgtatactctctctatctcctgccaccatgtaagaatttgcttgcttctcctttgccttatgcaaaccttatattctatgtttcctgagccccatcccctcacatccatgcagaactgtgagtcaattaacctcttttgtttataaattacccagtctcattagtatcttctgaggagtgtgagaacagactaatacaaggatctctctgtattatttattgcaattcaatgtgaattatttcaaaataaaaaggttttaaccttaaatattagatcaaaattattcataaatttacagcaaaattactcttactaacccaaaactggaaacagcccaattgttcatcaactgatgaatgtatacacaaaatgtgatatattcggcaataaaaatgaagtacagatacatgctataacatgagtaaaccttgaaaacatcatactaagtgaaagacaacagtcacaaaatatcatacattatatgattctatttatatagaacaatcagaataggcaacaataaaggcaacaataaagaaagtagattagtaattgtccagtgctcctgctgttggtggtggagatggggagttactgctagtgagtgtatgttttctgctaggagtgaagaaaaacttttaaaattagtagagagtgtttcagaacactgaatataataaataccctttgacttacactataaatgggctaatgtcaacatatgtaaattatatctcagcaaaggtgtcagaaatacataatggattattagtaaaaatagagaatataccatgcaaatattaatcaaatcaaataaagaatggttaaactaatgctatacaaaacagaccactcaatgaagaatactaccagaggtagaatattacataattatagaaaataaattcatcaataaattttaactatctaaccatattcatgtatattaacatgaagcagaaactgatactactgaaggaatagacaagtctacaactacagttagagattttaacaatcaacaaccagaacattaacagcacatagaaaaacttttatagagtattacactattgagttagaattgcctaagcttccattttaagaagagagaaaaaagaaaacaatctatgcaggagtaaaggaatgataatgacaagagctcaaagcaatgaaattgaaaggagaaaaagagaaaaaaattctaaatccttgttctttgaaaaaatcaataaaatcaataaatgctttcctagactgatcaaataaagaaagatagggaggaatacaaactttgtcaggaatgaaaatggattatcattagatgatgtagatatttcagtaataaggcagtattataaacaagtttatgtacattcaagaacatagatgaatctcaaaaggattataagtgaaagatccatatactgtatactgtatggatgcatactatatgatttaatgacattctgaacaaagacaagactatacaaatggaaatcagaacagtagttgctgagggctggaggtaatgagaaggaagtaactacaaagggccatgaagcaactttttggcatgaggtaaatatttaatatctttattgcagctatatgattgtatatgtttgtcaaaatacataatgttttatgcataagaatgaaatttactgtaaataaaatatacatcaatacatctaagaaaaaaataattttaagatgtttttggcttgccagtcaataacattaacaaaatgttactgtgcttagaggcataaaattggagaaaaagaaatttattcactgaaataaaaggatcagaggtatttgaagttttctggaaaagatcatcttccctatggttagaggaaataaacctcaactattattagtacatatagaaatgtacatgcaaactataaatattctaaattgcttttccttgcacagtaaggaaatgcattcattatttgcccataattgcattctcaatacattccattcccataaataaactattgcttataacaaattttctttaggcctcttgaactgatacaatacccacgagactggtttagaaagccaatgttttaaaagaaaaactaattataaatgagctagctacttactttatctacttgagattaataattttatttattgttttcattggactaactaaataaaattaatatctatgttggatctagtcttcacattttctcattcacaattttgagggttattgcaattaaagaacatggtaaatgttgaacatgaaataaatgatcagtgcgtctattcaaggtgatccctggaaagtgtaatgcctaacttttccatcatttttcttattctaagcacaatatatgaatacttatgaatttaaaattggattttaaatatctttaccttcatcactaaataaaacttttattcctatattcctaggaatagaaatgtaacagcttcaggtttactcaacagtagacatgtgtgtcttcaattacctattcaagagcaccactgatctgtttctccaaataccacatataattaccttattttataaggagaatgtgtaaaattttaaagataattacagagcaacatgtgcagaaaggatgtggctgctaaatctagaaaaggtgcaattcaatcccactgtactgcccattccctctttctccctctgaaaatcaaagaaacaaagaaaaacatataaagcaaaaccttttgtaaaactgtttatttaaacaaatattactcttcttctgtagtttatctctatttcacattaggtctgcatatttctgggtaaataagtgaatagttaacctgcaaaatttattaatcctgatttatggaggatgttagaactttcaaaaattccctcgttttctcacttctttacataaagtctttaccaaaaatatttaaggagacattttagcatgtgaactatgcatatattttgcaggttgatattagtaataataagacacagtatttacagagagctatttgctatggactgcatacagtttcaggtgcattttttatttaattccagaaaggaatacccatgcactatgcaatgaagtagaaatttttcatggtatgtggctgtgaaacagatgtatattgcaaatattgctattttattgataagaaaaccaacatgatttgtattccagttattctaagagaagggagcattacaatttgtagtgacataatcaggtatatattaacatttattttatttatctgataatctggcagtttaagtactaatcttatgttcatataagcctgaaagtagttgaaaaagcttgaaatcactaataatatctgtggtcttcaatttcattactttaatttatttccaatatatttttaaaaatgtatatattatgcatttgttttctatttatgtcattctcaagactgatacctctcaaaagaatgtctgataggagagatgttattttctacattatttatctttttattttcctgtattcatttcattgatttttctaacaatctacaagcaaaatctggtctattttacaagcaagatacctcaaatcccagtatgttgtactacattgacaattttatgatgtagttacaattttatttgaaaaaatgacaaatgtattggtattcttttagagatatgactataattagcttttttgctgtttttaattttcactatgcatcaatatctatcaaaccccaaactccaagatctcaaattaaatttgttttaggacattaggcaaggatcagacaatggatttattatgcaaaggcaaaacaaaaaaaaacaaaacagaaactgaatttcatattttcttaattctccagtcaaatctgtaagcacattcaggaataattttgaagataatataataaaggggttatttatatggagttgtggaaaaggaatcaaaatggaatggggtggcaccaagggtcatgtatttccatttggaaaataatggaaacacccgtgcagaatgacagctggtggctgggactgtcatagggaaaacatcagttccactcaatggctcaaaccaaaaggaagccagagggcaacagggtctgcagacaattaggcagaaaatagactggggcaaaagggcaggaacagagaatgagttacacaggtgtcagtcaacatacgtattacttatttaaagatatcaaagatgaaagactgtctagtaacagtagaaaaaaactgtagttggaatataaaacatatatgtaatagaacatttacagttagacacagtcataaagataacataaaaatcatcacaaaaaaataaatcgtgcttatattgaggtatttttttcttaagctaagaaaccattcattgaataattgtcaaatgttttctatatgccaagtactctttctgaaagcatattaatgaataaaacagatacagagtcagctttttcatgctagtgaggagacatcacagaatagaatttagcaagattacagcaaaaatggaaattattgtataatgaagtagaagagagtaaagggactgaggaatcaaggggtacatggcctagcaaattctcccatcttcttttatactctcagtgaggggaaaatattgtgacaagttgagtgtgtgctttctggcagctccaggaagtgtccagcaaaagtacctgtatagtttcactgtcatgaaaggaaaggaaaggaattccttactgggagcccttacaggaaaaacaacttagggaagaaagaccataatataaaatccctccctcccaacatgcatttgcctctggatttcccatacaaacaggtctccaaacttatagtatttgtaacggttatagtcagaaaatgaatgctttttctttggggatgtttcattttacttcatgccattttatctttttatccaattttaaggctaataactattaacatgacaaatggggaatgagtctctgtaccatatttcagcccagatataatttttgtcccttgagggttctctaaatgtatttttaaaaataaaatgtattttaaagctgatttttatggtatagtgttctatgaaatcctttgaattacacgtttactgaataaatattgtagtacaaaatccatggtatataactctataaatttatttgaatgagtaatgttcactgaacagctaccatagtaaaaaaaaattaaccatgttgtatttgcattttttcctaccagtttgaattaaagataaaatatgtttatacatttaaacataagtatttatatctatggttagaatcttatacatatttgtatttttaattttaaatgctatataacctactttcagataaacaatgttgaacaggaagacccttaattaaatgggttgcttacttcacttttataagaaatttaaattgtggtatacaattagcttatgaagatatattcacaacagacacaatttacatacacccttgcatacatatgcacaaataatcaggcatttatttatataaaacattaattatgggattgtcccctccaggatactaatcacactaactatagttctcatggcctccacacacatttatttgtgttttgtcttttagaaagagaagaaaaaaataaaagcacataagtggcacatacggattgtgagagtaaggagtagtaaaaacttaaagaaagaaggaagaacaaaaattgtatcaggactatttaaatgaaaaacaggacagtacagaattggccagatagttggcaacaaaaattttaataaaagaaaaacacatatgcccgtactccaaaatgaaaaccatcaaatacaatattatagtaccttccttttaatttattcaagaattattttttcactcaacactctcttacaaaagttaattgagcactttatatatgttgggtacccttctaggagtcaaaacaacagacaaagatatcatcctcaaagaacctgcattcttgttggagagggaaaaaataaacatgaagtagtaagtacacagcatgccaggtagtgataagctctacaaatgaaactaagtggtgtgggtggtacagagagatatatggttagaggtctgagaaagacctgtctgataatggtcctattagcagagttatgaaggaagtgaagacgtaagccatgtagttatatgagatatatcatatatatgcatggaatcttgagcaggactctgtaactcgagtggagtgtccaagaaagacagtggttaggaatgctgttggaaagatagcaatgggccaggtataatatgaccttgcagggttattgcacagtcttgtgattatagtcttccataaggagaaagccattggaacattttagtagaggaatatcatgtctgatttgcatctgataaaaactgagctgatgtgttgaacagagtagggttagggcagggacaggtggaagttacttgaataaccaagtgatagttgctgatatgttctgggaatagaattgatggcaatggaggtcaatagagaggttgctttctgacttaattttgctgagagccaacggagtttgtgagaaaggaaagagtcaaaaatgactctaaattcttggtctaagcaattggagagatggagaatccttgattaggtggagagcaccatcagatgttgaaatctgggagaaacagtgaaagctcagtgttggagatgttaagtttacagtgcttagaagtccaagtattgatatcaaatacacaggtggctaaaggagtcaccagtatatacatatggtgtttacagtaacatttctagatatgcactaagacagtgagcataaatagaagaccaataacttgctccgcttctggattccccccacacaccaaggtttactccagaggcactataaagacaaaaggtggggccagaagcggtggctcacacctgtaatcccagcactttgggaagctgagttgggcagcttgcctgaggtcaggatttcgagaccagtctggtcaacatagtgaaacccggtctctactaaaaatacaaaaaaattggccacacgtggtggtgtgcacctgtaatcccaggtacttgggaggctgaggcaggggaattaattgaaccagggaagcagaggttgcggtgagccgagatcgcgacactgcacgccagcctgggtaagagagtgagactccgtcttaaaaaaaaaaaaggggggggtgggggggaagggaagttttgagaaattttctccaacaatggaatgtgtgggtcctaccttgtacccctctgtacattaggggtggggaagtcaggctttggtgtggaagaataaaaataggaagagaaatgttagaattccactctcacttctcatccaccctcgccttgggatgtcattgtgctgccctcacattgggggaaaattcctcaatttctccctaccttgtccttgctaagtgatacaggactgtcacttagatctgaaacttttagaaaatcagttaaagaccacttggaggagccttgggaggtttttgctcaccatcagttccaatctaaagggatttggaatagcctaattttgaagtatatcatttttattatcaactggtatgagttatgtttacactaaggatattaaacttttttatttttccccactttattgtcttcctttttaaacttttttcatgaaaaaaattgttatgtctgtattgtttcattgtgattttccaaattgcatttatgcttagaaagcctttttctattcagaaattaaatgaatcttcattgtgtacctcctacgatatacttttgcttctgttttatacattaaaatttttaatcagtctgagatatattttgcttcaaagtaggagatgagatattgattgattttttcctatgcagctgtcagttttctcagtaccatttgaaatactctattctccatttgcttatggaaattcctacctcatctaaactatgttctaaaacatactagaattaatgctttgttgtactgatttcctcaattttaatatgtatctacaacatttttaaatgatcatatctctttgtatttctacattcatgtcatgaaacactagcttcattttgtatgtttttgtaaatttttatgtccacctgcatttgttttcaaacttgttgagttgctgaaaaagaactttgagcttgtcactggggttatattgcactcgttttgaaagaattaacagcagcgatcatggttagaaacagtaaaaaaactagtatagtagaatcacaaattaattagaatagactcaccaatgagaacagataccagatagacagcaaaagtataagattaatactatgtctttgcagttatctctgtcttctttaatatctctcagtgaagttaaatagttttctttacagtacctgcacattttcttttaggaaaactctttatttgacattttgcagaggtatattttagcattataatataatctaacgttataatttttctaatgtattttgtgtatttatcttatgctcagtttcttgatgtctcttctcaattttaagtattatttacataattcttctggattccctagatttatgtgtcttttcctttcaaaattaaaactcttccaatttcaaattttatttatttaaatcagaacttctagtgttaaataccaagtgtactttcgaacagaaatataggaatatgaggggagccgggaactttggttgcatataaaagaaggaaatggaaataatacaactgaaggaaaatataatagatcacccagccagataaaccttaaatgtgctgcttttaacctggcctctaactgcatggaaggaagccaacctccacgttgttcttcaatccagcaatctgcatttccacctagttccaagttatcatcaattattatttactcctacttcctaaatattcttcttctgaacaatcaggacttagaccagatcctcaacatatataaacaaaattattataatagcatcctaactagtttcgtgtctctaaaaaatattctatgcaccttatgtgttgcaaatatagtattctttctaaaacttgttaagttgtcacacgaatcttaaaatcagtggtactcaaacacatacataataggtcacccttaaatacaaacatgcagggtctgcaagatctaacttatatttatgtcttaatcatcacttctcaattcttctccctccttgccttgttcttgctacgaaatcttgcacttttatgaagacatgtactgtatcataactaagcctttacacaggttttattctttttgtagaatgtcttctgttatctcctcttatgtattttattatgccagatttttagagacttaagtcagcatcattttaacaggaaaatgtttccagaagttgtccaagctgtgttaaccacccaacttcagagctcagtatcctcagtatcctgtgatcaaaacattttttacaatatgtaagaaaatttagagtagaaaattatattcccccttccctatttcatccacactgttttaaagcctttgactgactgaattattcttgaaaaatgttttgctaaatatgtttctttgtaacttagatttcaaattgtgagctaaagcaagaataagaatatagtgaaagtctgaacccataaaaacaaaatatatgatcaagtacaaccatgtttagttagtaattttgtatctaataatttagaagaagcaacttcttcctaaaaggaaatcattgttctaggcttaattttggaaaaaaaaatgaagaactctttgagaataaagctgtgatataaaattagacaaatatgattttataagcacatacatgagaaatctcaagaaagaaacccattccatcacatatcctaggattttaaaaagcagaaatttaaaagttaaaagataagtagaatcctataattatatgaattcactcagccctaccttaaattcttttcatataggtcaatggttttataaatcaataaaatttgtccagtgttatagaccagacactaaaacatacgaagataacaagagtgtttccatcactaaattcttcttgaaaagatgaagaaatgaggataattaatatctgagattgatatttcaaagtattatgatactctgactttggaggatagttggaagttttacaagcacaagacagaacagaacatcctattaagagtaagaaatatgaaatagcaaattttgttttccttcactttttcaatttcaatttttaataggaatttacttcctctaaaggaatgttactgtcttcagtgtctagaacagtccataataggtagtagtcattcaataaattctgttgaatgaatagataaagattgttaaacatttttttctgattttgaccctaacactatgcccagcctagactgattcacagcccaactcttgagagacacagagcagatataatcatacaatattctataaagtatcttttcactacaaataagtaaaatgccaaaaatttagtcatttccttaaaatttagtggattcttatatgccttattgaataacaaagaaaatgctgtaattagtactagttttttggaactggaatataactgtgaatatatcaacataaatgtggcccacatgttaccaaagtttaaaaaccactaatttacaccatctcatccttttttaacctatttcattttctccagtttctccccaaatatcctttgcattttattgttctgtaattttgtttatgctgttatttcttttgtctgaaaagataaagtatagaaaatcttgtctggagagtgtgaaactagttaggatgctgttgtaataattttgattatatattttgaggacttgcccaactgacttgacaaactactacttatccttaaatattcagctcaaatgtcactttttcacttttctgtgaaatgtgtgtttcatcttgatcccacaacactttatattgcctctattttatgtgcaacgatctaaaaatcccataaatatttgtctacatgtattactattattccttaagggtagagaaaaaaagtccagtatccatacactctttaaatcttggttaaatgaaggggctaaacaaaacaaaacaaacaacaacaaaaaaactgcttatgataccaagaacaatcgccttgcaatgcttttttgaatgccctactagttttctaaaggcatacctgcatatattggttactcaatcattcctgacaccaccctttccataattgtaccattttaaagaattttattcgtttcaaccaaaacgtctcacgttattgtctttttgtcctaacacaaactttggggttatttggaatacatctaactcttcttctaaatatatgcctttaaatatgtaaaagcagctggtctatatgccactaaattctaattttactctagtctatggtttctaaattaaaatcattgatcccgttcctctaattcaaacaaaaaaaataaagccaaagcaagtaataaacaaagcaattataaatctaccaatcttaaaaattcatatgctataccatgaagacttcttctagcacctgaactgaacactgggaactggagtgtggttcagacagcacacacctctgctaatatgaaaaattgtaactatttccatgtttcttctcaggctaaaattcaacttacacttgtgcctcaccagcacgaaactcggcacatcattttactttcagttgttgttgttgtttttaatattagacggaagagtacaaattctaaatactaagtttttttcctgtaagccctagcaataattcttttcataagacaagttgtatatatttttttcacagaattttcttttagaccaaaatatctgggaaatttgtaaacgaccctttttacttttgcctgcctttaaatgactgaatcgatttacttttaaatgttttacaaacaaacaaaccttttattgaagtaattccagaaaaagaaactctggatcctcagctcatgtggtctatcgggaagtaccctcagcctggcaagcgcttccactattctcattgcccagtcagcggcctccttcagacctctgctgggatacgactgtctcagtcaggctgacgccaaccacacgaggtgcgaccccaggtgtgtgagggaaaggcccctaccccacagggaacaacagccacggggaaaggaaaagccctaaaaccctcttgcggagttttaaaaaagaaagaaacaaacaacaacaacaaaacaaaacaaaaaaagccttatttgaacaaacaacaataacaaaacaaaataaaaaaacgccttatttgtgccctgagtctttctccacaagagcagccacccaggtgtctccctctgagagttctgaagtccgcgggcctgagaggaacgcaaaactccctcattccgagtcagtcacaagaggccccgcccccagcgctgctggatgcagcgtcgattggctgcccctactgtcaaggcctctcctggacgattcttctccaccaacaacctatatcagacatgagattggcttatgcactgctgaagtcctgcccccggcttgaggaggccggcgtcaaagagctctccacagcctctgctgtttttattgatacaaggacaagattcataagggagtcagggacttggaggggcgagggtctgagcggccctggaaatttctgaatcccagggctggaaggacatggagacttctccagttctcacactttacagacgatgtaaccttctctcacaaaaggtctaggggcagatctggtctccaaaagagggacatgatgctaagcaggtcctgggagagcaggctgtgccaggaagagtttattctgcgtctctgttctatctagcttttgagctcagagatgaggcgactatctaagttggccaaggccagggtatacaccatcaggttgatggagttctgcagaaagtgcagagcaaaagcctggcctccacggaagaagaggaagttctgagtggtctgagggaggctggacatgcactcagggagctgagccccgatggatgcctgtctcctttatcccatcctgttgtttccccattaacacttaccactttctaatagttaccgtaaatatatttaattaccatttcttcacttatatttcttgtctatctcttacttaaaatgtaagcctcgtgaggaagggattttctgttttgttcactgatgcaacctcaaaatatagaacggttctggcacagagaatgtgactaataaacattttggaataaactaattctaatatttcatttgtttttatggaagtccaaaacaaaagtgctatttggtttcagttatccaaagtcaaccacatagacagtatattatttgttaaatcttgtcaaaaattaactgaacaatcaggatttcttcctctatttttgaatttaccagaataaaaagccaaaaatgttgaacaattaaatcccagttttatgttcaccaaattgtcttaattggaaactttttacaaaaagaaagatgcaagtatcttgtgataatcaaaataagtatcctagaatttttaaattatttgtagtcatttcaggaattatgacatttttcttgagaatttgtgaatgcttaaatgtatggctccagacagttgcagaataatggaacaaattattactaattacattgcttagtggtgtgcatttgattctataaataatcaggataggtctgggtgtgtgtcacagtggcaagcataatcaaatattaaagaatccgtaactaacacaatattgtttcagaatactactgtaacttctttgaaattaggtctgtatcttataaagttttatcttgttttatatgtatgcttacctagcgtaccaaagaggaaagacagacttcctaaggaaataaagcaactctgaaataatagccaatgtgggaccatgtactgttagatagtttgatgtaacttcaattctttttttttttttttttttttgagaccgagaccgagtctcgctctgtcgcccaggctggagtgcagtggcgcgatctcggctcactgcaagctccgcctcctaggttcacgccattctcctgcctcagctttcggagtagctgggattacaggcgcccactaacacgcccagctaatttgtttgtatttttagtagagacggggtttcaccgtgttatccaggctggtctccatctcctgaccatgtgatccgcccgcctcggcctcccaaagtgctgggattacaggcgtgagccaccgcgcccagccaaacttcaattcttactcggaaaaatcagtggcaataaagtgaatacaaacagcttttctatggatacttttttaacaatccacagaattcatgcttttgtcagttatattaaagtctttataaagcagtattttatgacatgaagcaacatttttctgaaagaatactctagattaaaaaagaaagattacatttgaataattacatacttcttaaacttttatataatattttattaaacatgattgcatttactctgcataatgattttgcgtgtcaggtaggctcattggacctacattatccttgtgatacagtattaagatgacagcagaaaaataagaaccatggtagatttgtcagtgttcttttcccttgtcctgtgtctaccttcatttttcactttctgtcagtaaactaaatttatgtgaataagcaaactcagttacattaatgatctgaaaaccctacaagtctgaatattttctctatccaaacttttgaattctactcttagaaccagtgagtatacagcattttgtgttttataagtctcttatagaagtcaaatgacttcaggccggcctataatcccagcactttgggaggccgaggcaagcagatcacttgaggtcaagagttcaagaccagcgtggtcaacatagtgaaaccccatctctagtaaaactacaaaaataaggcaggtatggtggtgggtgcctgtaatcccagctacttaggagggtgaggcaggagaatcacttgaacctgggaggcagaggttgcagtgagccaagatcacgccactgcactccagcctaggtgacagagcgaaaatctgtctcaaaaagagagaggagagaagtcatatgccttccagcttttatactctgaacactccaaaagtttcaaggacacctgagggcagcaaacaaagtgcccaggggcccatatcctagacattcctgactactaagttgcactctttgattttctctgttctagtaggaaaaaaaaaaaaaagtgctcagggcttctaaaatgcaagtcagtggtgctaatattaataatgaactgtctacttttcaatacagaattggctttaacataatgttgacagatcaactgacaagaacgattattttttaagaataggaaacataaaatcacagcagacacacacaaaaaagcagatcaataaatatgaagatctcagaaacaaaagggcaaactatattctatggtacattgacttgttgtgcctttatgttgacattttcaattgtatggaagctttttaaataagcaagatctgatggtagcacgtattaaaaatgatcttagaaaggaatgtaaaaaggagaagcaatttgaaatatttattttctgtttataattcatataaatattgataaagagaatattttcagggattacatgggtgtatgctatccatatccatatgatatataataggatatatgattcagaaggctgacaacatttcacattgcagaatgtgtcttatggtgtgtccaacattacagcacatctcatcattttacaaaaatctctcaatggccaaaatgacattcccatgagaagatttacttttaagcaagtaggtacaatcagttctctttagcggaaataaaaacattgttgcttcatttagaaaattatcctcaattttaacataaatttaaaaatttaaaatagatatttaaacatatgatttctaaagttaaaaaaagttttatatttcttagaaggcatagatctgagtaatgtatatatctagtttccatgactgcatatattgtaacatatatgtgtatgtatatgtgtgggtgtatatacatatatataaaattcatgaaataaaaaggaataaaacaatgagagaaagaaaaaattgatttattctgtaaacttttaaacctatcacatttaagatgctcagatatattgttaaaaacatttgtattctacacagagcacattcaattacctacagaaataaattatggatgattggtgatctgatttataagcttgccaacagagttcagaagcaatgtatcagaaacaaaaagactaccacatcttaaataagaaaatggcattaaggaatttgccaactattccaatgatataaagatcacacatgtcaaaacaagaataagtttatatcaagctttacagaatagtacagaaaattaaagaaaaaacattttaaaaatatatatttgtacgtatctacccattcattttaagcatagagaatctgaaagagtggttttagcttcatgacttatgcccagaagagactgctctctgattgttgttgtctaactggcaattgttaaaataaatatatgtgaagtcactttaaatataaatattaagcatatgagccaatccaaacctcatatacaaatcaaaatactttatatatagatccatgattacctattctttcaactacataatttgagggtagaattatatattcccattttacagcaatttaaaattctgcaaggatgaagtttccagatctagcaacagtgacataacatttggtgggagaagggaagtgagaaagggtgtgttgtgaaggaattatttccaaattgtcatcttccaattttatttcaacaatttagcgaagattcaacattaaaagtgaaaaaaatactctaacaatttttccacaatatactgaaaatgtggtaattcttttgaagttgacactttactaaataaatgctgtatttctgtcctacaatgaaaaaatacgctgttggttacattagcctggaaggctattctaagagttatttcattccacctactgcttccagtgagaacaacacatagtctggatagataaatgattgtccattataattgccaaatgagggttattttttttaactaaacttgctgatatctccaaaattaatactttgggtatttgtcaaattatatatacatttcaagtatctccattctgacaacaataatggtcttctatagaaaaactacagatttttatgtttaataaattgttttttaccgttaaagctctatttgcaaatttctaaattttactctctttgaatttgtttcagttactcaaacttcacacactaaaggattacacttagaatatacaaacagatatttgttgaccacctacaatgtaaatacatatttgaattgttttaaggtctaatatgttaactacagcaaaaatgctacatttgtgataaagacactactgatcactttggtcacccaactgtattataattttctgaaggtcaggtcttcatttgaaattcatcacattgcttacagcatgaggacataacaggcgctcagtaaatgtatgctgaattgcattaaatgtcaacacctaaccttcaatgaaaagtcatcacttttttctatcaaggaaaagagcaaatgtgacaagatgatatgtcaataacaaactatgaaaagaggaaatgttttcaagacttcactcaaaacttaccttcactttttacattataatacatttggagatctgtttctggtacttgtttaattttttgtttcctattagtaggatttggatattttgactttgaaaatattttcatgcacctaacttgtagtaaacattaataaacactaactttacaatacatgtagttacatatttaataagtaaccaagtaaagatgtaaaaataggttgtccttgggtttttaagtattggcttttcctcatcaataaatgggaattagatgtatctgtgaatctttattacattaaaattctgaccaaaggagaagtgtgaaaatattttagctgtccaagttaaattaagggtaacattttcttttggagtatgtaaatgagattttcctctagcctttcaaccttaaaaacttacatcttctatgggaaaaggggaattaggtatctgtaagtaaaggatacattcaacgggatttgaattcaatttttttaaaaagcaattctgcaaatatgcttaccatctaataagaaaaattaaaaagttattaatcaagataatagtccaagtgtggtggctcatgccaggtgtcatggcccagcacttcggtaggcaaaggtgggagtaaacgtttgaggccaggcattcgagaccagcctggacaacgtagcaagactctctgtctctaaaaatttaaaaattagctggtcatgatagctaacgcatgcctatagtccaagctacttgggaggctgaggcagtaggtttgcttgacccagttcaaggttaaagtgagctgttatcatactactgcactgcagcctggataacagagaccccatctcttaaaaagataatagtgacctctgttgtttcacacttgtgttactgcataactaagagaggtattagagcatgtggattttacaataaaatattattatacatggatataatagaaaaatctgatgtgaattcaacattctcctccttataagtttcaggaatcaattgaatgacttgctaaataacattatttgtgcttaagctcatttcaaattaacttttacatttagtagcacttctgataatgtatcaataaaacagcctgtatttttttcaatcaagtcaatgactaatgccaacaaataggcttccccttctccctcactaccaacccaacacaccaactccagtaacataggatgtttaacaagtccttctcaggaaaaaagaaataaaaaaagaacatcaaagcaaaatatgggcatatctccctttgtccttccataattatgcttttgttcttcctagctacagaaagcctaccaacatccatctggtagccagcactggattgtattcttaaactttttctaattttagctttgtactggttaaaattatataatttaagtaggaatattgtattcttaaactttttctaattttagctttgtactggttaaaattatataatttaagtaggaatatattcatgtttttataaacatatataaataattatatgtgcatgtggagttaaatacctaatatccttattgacttgctgacctttgatccatgagatcacaaactttcctataccacttctagaagtaatcattactattaattttatgtatatttaatatacttatgaacttacttatacatatacaagtgaaaattgaattataattttcacaaatttttaaagaagtttgtataaatgggctattactatatgcactgtcctataatgtgtctcctttactatacatattgtagaactttatacatcagtgtgtgtagtatttgctgctatgtatcatttcatggaactaatgtatctggttttatttatgtatatcagcttaagcatacatgcaatggtttcttcagaataaagaagagtaagtggaattattaattatataaatttagaatcccacggccttaaatttgaggtgagagcaatcagcatgacatgttattttctccagcaaaactgtgtatctatgtatccttttctatgactcagttcaacatcttaatggtggtctgccatgcctctgattcagccctggcctagttcttcaaattgatttcttaccaaactaccctagaactatatggaaaactttagttcactcttgttatgacattttgtattactcacatctcttaaattctctcttttttaatctggcttagagttcgtggcccaattacataattactttctcaaaattattatttctcttttcccattttccttctattcagaaaaatatctaattttattcacaacaaaattgttgtctactccatacctagactctcataactaaacattttgagagaaaataacattattgcttaattttcttacttcagactcatgactacaagtacgtcgacactcaaaactactgggagatacgtgtttttctcatgaatatatgtaccaattcttcaatacatttttttaagaaaatgaaaacaatcccatgaagatatcatatttctaccaggaaatctaccatccactcttatatgtatctttattattttctttgtgttctgtagcaattgaaaaattgcccatattcttatcaagacaaatttcctatttgtttgtctatcatttgctccttcaatcattcccactagttttctcctgaatcattcaaaacaatattaaaatatgttctaatctccctcatcttttaagaaatcccaactttatgttttcctccagcaactgcccatttcttgcttccctttaaagtgatactcctggaaaaaactttctgtacacgctgtcttcatttccttgtctaacatttttttctttaatccattcctcatgggctttcatccactccactttacttaaatgtctctagtggattacaaggctctttggtaagagcttctctctattctggaacactgtgccctagatgtctgtataggtctctcgttctcacttttcttacataacctattctgtaagaacctccctgactgctacatttaaaatgttatctaacatttgaaatgttatctactacctagatagatcgtcccctttccctactttattttccttcataatcttattcactacatagcatattttatatttcagttagtttattatctgtaacaccaaccattgtaatgtatgttttattcaacactgtattatcatctgctacaactctttcttccaccaaaaagtctcactctgtcgcccaggctggagtgcagtggcgtgatctcgactcactgcaacctccacctcctgcgttcaagcaattctcttcctcagcctcctgagtagctgggattacagacgttaagccaccgcgcccggccttgagaagtatttcataggttctcatcattctgcactgtttggatttccttctgtactattaaactctcatttttcacaaaatttgataactcctcctattataaagtgtttgagtccattgtcctgagacttagtcataggagaccttcttttctgagtgtgcactttttacccaagtgatctcaacaagtccccaagctttaaatatcatccatattctgctgactctcatgtctataactgtaatcctaaattttcccttgagcttcagacttgtataaaattatgatgtgaattgtatgttaaaatcattttctacattctggtttactgcaaaaacagaaaatattagaaggatgagcataacattctttaagttttaagttcaagagaagaagggttataaaggaagattggttgatttttcagggatagcagagtttcttgagtatatctcttctgagatccttacttctccatagtagaggcaaggcatttggcattgttatttatcaagttgaggtactgtaaaaattgctcttaaagtttgaagatgaaccttctcaagtaccaggcaaaggcttgcaaaccgcagaaggtcttatatgagaagctggcataaaaactgtgacagttgggtgaagaggataagatgagagggcagcaggacacagaaaggacccatgagattcccaagatcctgaaagaggataaggtagtgttgtcctggtagagtgtatccagatgattaagaggaaaaatatcaccaaacattataatgatgataactcttttggacatcagaaaggatgcacccccactctgatgatttcttgtgtcttaaatccagaacagaggaaacagtgcttgagtgcttgaacagagcagaggaaacactgtctacacgaaaacacttaagcagcaggaaccataagtgtggaacacccatgtagtatgaacccatcctgcaactactgaatgccagtgttagaaagaaaactttcaatgacagcagaaactgatgcaccatcctagttatcatacagcagcataccaaagcagagataaagcaagtttctgatggtgatgtttaagtgttttcattgctaaacaatatattcaaattatctacttaacattttcacctgggtttctaatatgtatctcaaactcagtatgtccaaactggaacttttgatgttttctctacaagcatatccttcttctattctttaatatcacatggaatggcagcattacacaccaattggttgaacattcaagagtcatctttgaattatctgttctcttcactctcagaaggccagccatttgcaaatcctcttctgcttccaaaatgcatctgattttgttttactttctttgttgttactatcatatacggaaagtccccatggtctcacctagacctggaaatagtctcttctgattctattgagcactctacaaattggtcttcagccaatagccaaagcattttttataacctatgtgtcactgctatgcttaacttctcaaacttggaatgaaattttgactttttattgggctttacatagcctggaaattctggtcttcgtttactctcttatctcctttcccatgaagtaattttacatttactacttttctagtcacactgacatttcttaatctttaaatttgggaagctgtttgccaccaccaggcctttgcacatgctgtttgctaagcttggaatgcctttcctcaaaatggctctttggatagctaatttttcagttatctactcaaaagcttattcctcaaatggctgtactacaatgtctaacccaaaataggccctccctactgcagttcactatgccattttaacactcataatgttttcagtttttggaactattttacttatttatttttcaataatttcagaagccctggccttagaatgtaagagtcatgcaaccagagaccttgcttatattattcaccaatctatcttagaactttggaagaatacagagtctaatttagaaaagcttctgaaaatgtaattgaaaagaatgtttagtatcaatttatctttaagaaaagaaaatttaactcttctttttcagtcaaaagaatgtatctctatcaggggtctttggacaccagtgtgaatctcattagagccaaaaatttaccagaacataaatttagaacaactcataataaatatttatgaaattataattttggccatattattatcactcaccattatccagaacacaaatttcaaaattagcactcaatgatttcatttgaaataatcataagaaaattttgttattagtaatattgatagatataaaatatttacatacgacaagaaccaacactcccatattctatacataaaatgaaaagctttcttttttaaaaattctattctacttttatatatcagatggcttcaaaataattactaattttagaagcaatgagatgaatagatatgtaggatatgaaaatagatatgtaggatatgaaaaaaatattaatagaattgtgctcaccttggtagataactatggtattgaactacattgtaatacgtgtcctaaataaaagactaaaatagaaattatgcaaacattttgtttaatctattatagaatcactaaagaaaaattagctatttttacttagtaagtggaatattttaatgatctgaaagggaggatttttaaaactgaatatgctgttcttcataaaataagaaaatatgtttatatggaaatattttaattgaaatatcaaaattccatagaatatttacatcagttggtacacagcttctttcaaataaattttattaccctatcaagaaagcttttgagaattataatctaactttatttctttttattgtttttaattagttatatattttatttcatgggttagccagtttgaaacattaagtattgtgggttgaagtagaacatgacctgattttaaatattcccagctaaagttaaataaaatatgcatactttagataaagtttgaatattatgtttgtattgctttttacctaacttattgagtttgctgggtttttttaataaactttcaaaacaagggaaaatatcctatgatgtaggatagtacagaaaaatgttggaaatacagcccttaagtttagttttgtctggtattgatacatgacatggaataagtcaatttattcattagcattccaatttttatattagaaacattcataataaaaataatacacttaaagatgctaagttgatgaaaaagtaacatgggggtacttatattgcaatttttattttaaatgttcccttaggtactgtttctactttaattaaaactatttcataaatctaaagaagaagcttccctagcgatacctgtaaactccacattttcttatggcttcacttattttaaagtgctgaaagagccaaaattttattttttactctatagttagtttttaattaaaatattcaatgccacctactaaaaaaacccacacaatcaaatacagtaaaaagaagtatactggagataatatagacttcaacaaattaactataattattcttgattaatagctaacacatcacactatagctagcatggcaaaaggtaagtggtactataaccatctggaaattaacaaatttattcaataaattacataaagtaacattaatgttttattatacatagcagaaagcctactcatgattccccaaagacatttgtgatggttaaaaatctaaacagtttagaaactgacagtaaaaacgcatacaaatgttcatccctgtaggcatctcaaagcaatttggatgattttattttgtgtaagttagattatataacccaaaacatacattcccatcactgcatgaaacaaagcttattatactggtgctttgagacactaatctagcacctggaaaatggaaaagtaagaaaagatttgtctctggtacccttggccttcatttggaatgatcctttcacagtaccttgataacagctgccctgaaattgttgcatcttacttccctagtttacaatccactcattttccctcctatcttttatattgttctgcatttgatgcagaacaataaatgctggcacatgaatcagatacaaattttccatgctaatattttcacaaactacttattaactaaaaggaaactactatttaaaacatatttaaaattgacatatttcttcataaatttgaaaagtggcttaaatgttgaaaaagatctgaggttatggttgtatgtaagatgcagatgtcatttgctaattagcttaagtttcagaactatgaatcactttaaagatatcagctatttctaagaaagtttgatctattgggaacaaagaaaggaagacagagatttagagaaggttctgctacttttgcttctgggtgttcattggaaacagccctgggaattttccgtttaaactgcaggaggaaaaataagcagccagagagttagcagaagatataggcaagggtaattttttttcttttaatatgatatgcaaattaattagaagcaattaacctagcagtaggactgaagactttagggccttgttttatttttatttatttattttttttttattatactctaagttttagggtacatgtgcacattgtgcaggttagttacatatgtatacatgtgccatgctggtgcgctgcacccactaatgtgtcatctagcattaggtatatctcccaatgctatcctctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatctgggttggttccaagtctttgctattgtgaatagtgtagggccttgttttaatgtcaaggtttatgtggaactgaggagctgtgggtccttagaactatataccataaacctgaggttacttcactggcaacaaaacacaattaactatagacacaaatatagtaatacttctcctttatatttgttgcttatttaaaatttttgcttttaagctatggtattcatgtatttaataagacatactctattttacaaaaaatattaagttcatattatgcatttggattttctttaaaaaaggtagccaaaaaagcaaaggggttgtctcaaaagatattgcagaagctgtgcatgtttctacacagcaccagccaaaactcagttaaaaaattggagaaaagcataactctctaccctgcatcgcaaatcagctgaggtttaggaaatgttaaatgaaatgtctccatctgctatatcaagaagaataacaatacctgtaattgccaacaccaataatacccttgaaaaatagtctttacatatcatctctatttcttttctatacaattatcttctcaatgtgatctgactttaagtagctgcactctattgagataagtcagattactaatctcacaaaccccctggagattttttgtcatccttcttagcttctcagagcagctggaacatacccacctcttgtcttttctgtggggccataaccctgttatctctttccactccttctcagatcttttaaggtcccatatttctctgatctattgtgttgtttggaattgcatgcacatcactcttgtgttttggaaggtatgcagtccctgaaaattgtagctacacattatagggttctgctatataggaaaagaacatcagctttagtatcaaatagactttactagggtttcagaggaattattgtccacatgaatactagattcatccaagagtttaattataattcagagtagatatgtgagtcaggaagttaagctcctatgaggaactaggagcctggcctgaataactgagtaaaggaaaggcattatgaggctgagagaaaacaaaaacaaataaacaaaatggcctgatgttttcatgtgtttttgaattgattagtaaaaggtatacatggaattcactgttcacatatttcaaatagacttttgtcattaaactgttttgatttacagatggtttaggtacccatatatttttgatacttgattgctataactctagaatttatatccctagaattatatgcatattttaaggtagaagcatttttatttaatgttgttgggatacaaatcataggttaataaaaaaaaagttaaagcaggatatcaaaaattctgtaaaggaataaatacataacttaaatattgtattttatcttaagatgtgtagatgcatagcccattcactaatcttatgatatagactcaagaacttttctttaaacatctaataattgtaattatttcattatgtcttctttgtacataattcatgatacatagtttcttatcattccaagttgaaaaaacttgagtaaaaattagagacaccagttaagcaatcttagtttgaaaactcttaatttgtctattgttaattctattacttttctattattttctacttttaattattttatattaatggcttcctatttttaaagatatcttgtccacacctaattcaggcaaatttttagtaactcatccttaagttttctctaagcattcaaattggtttttgtacaaaaaaagttcattgtttatttattgacatttcatcaagttacatatatacacactaaaagtatcccaataagcctaagaagtttgtactaaatacaattgattctaaataagcatgaatatgaactgctcggaacaaaattattcagacaatatatgtggtagtctgctaaacaaaatagcttattgcactatagaaacagttcagtatattttatcaaagaaatgaaacgtatttgttagtccagttggttgattaaatagaggattgatgaaaagcaccttgtattttgtctgattatttccacaactgaaattgttggtttctacaataattactaatatataaatgtgtaatgaagcagtaggtattaaaaagcagttgaataggcctattactactgcttatttccaattcttccctgtatcatgaaaatgaaaaggctggtcaaatgaaccatatcattaaaatattacatatttactttatattcaaatgctcccttttgtttgacaaaaatctaggtgtaactgttgaggaaaagccagacacatttgtattgtctctttctaagctgcatattatattgagccattatttaagctatttaatagtatgtatggtataacctatggtctggaaatttgttttgcaaagctatatatatattatcatttaattaatctgaaaatacacaaaagtattttccgcttttataggtgacttacatatgtaaatataaaaggagttatgctttattatataatattgattactgattatagttttgttaaaggctaacttataagtaagagttaatttgcatcatattttgactgtttacatacacattttttaaatgtttccagaaagaaaaaaaaaattcaaatgtttcaatcacattccctacaaatattttacatttgaagttttccttcattttactggtaaagcatccagctagaaaaataaaaagtaaaaaaaaaaagcaaaacaaaactttaccattcacagtgatagaattgagattagaattcaggttacctgatgccttttaagtttgcattacagtaacagaacatttttctctctttcatagtactttctatttaactaatattgtcattgctgtgtcaagttatttatccaaaggtatcctcacttcatggatatttatttagaaactgtattgatttaaaacagatactacattttatactaaaaatagcatgcacaatctttaatatctactttaattactgcattttcagatttatatttaatttgctaatgaaatagtgacaagattcatgtcaagcatgctacttatacacttgatttcctttgaaaattaaaactctgacctgaaaataagcacactgttcagggataccatcttgttagtttagttgttagttacccgctgttcttaataaatcagtctgcaaactactgatccatgttactgcatttttacctctctatttgttggaaacatgtgcctacaaaccaaacataactctatttagtttgtcaaattgaagatatcctatctacttcaggtgtaagttatgtttacagatatttaaagcaaaataaatatcagtaaatgtaatatcagaattatgattttcaaatcataattcacaatgaattcaaatatttttaatatcagcaaatagatgatagtaataggtgatacagtattattaagttttataatacaataaaattcctttaatatattaaaaggactataataaatagtaaggtctaagcaatgaattttaggaaaaccttttagtatattaataatagtcctttaataatatattaaaggactcgcctaaaattcattgcttaaactatactatttattatagttacaatgacagaaacttgcctaaaattcattgcttaaactatactatttattatagttacaatgacagaagcttattataatcagtatattttaaaatcatttcagtggttttacatgaaccatttgctttgtgtttattctcaaacattgttgagcaccttaggtagtaaccttaagaaatccttgaattcacagattaaattaaaactgtatttatgaatacaattagtaagtacccatttggccccattttgtccatttcattaaaatatatagagagagatattgtcttttctatgtttaatatataacttatttaacatgttcacagagcaagcaaatcatgaggcaataagaaaaataaataaattatgcaaaacttggggttttttaaaaggactttttaaattaattcatttatttaagatctacttcactctccaaatgtatttgacactcttaacaaaaacgaaaataatacagcaggataaaactaagctattgaggaaattagtaaaggataattaataggagaataagataaggccacccagtggtgagctatagccaacaggtagcttgagagagctgattctgttcatttctttgtaactccatgttcagtgatagcaggttagtagcttggttgatcataaaattaaacatgccacaaataacaaattacggctttttcttttcttttcttttatttattttggaagacagggcttagcagtacatcactgaagccattctgtctctgaaaatatctcctagaagatatcctgaatcaactccattatattgacaaaagattgctgaatatgacaaaaatatgtgtcacagattagcaccaagataaatttagcttgaatacttttaaagaaaaacaattgatacttttaataagtatgcatggaacaattaaattatgtggtgttctgttgtatctacaaaaatagtgaaaatatacagctatatagttgacaatattgttggtaatctggagttataaatgagctaattaggtataaatgtatatcaaatacagtgctttgggcttgcttggattgtactaacctatattattttgcaataaataagtaactgaataaattgtttgttgatttcagccttaggttgtgacaaaaaaatacaaaacaaaatattagtttagagaagacgtaccttgctattttaagttctaagtacatgaaagttataagtacatgaaaaagctgtttcagatgattaaagtccaaataagaggcaaggcatggggaataaaacagcctcatgtttttgtttgtttgtttgtttttcagacggagtctcgctctgtcgcccaggatggagtgcagtggcgcgatctcggttcactgccagctccgcctcctgggttcacgccattctcctgcctcagcctcccgagtagctgggactacaggtgcccaccaccacgcctggctaattttttttgtatttttagtagagacagggtttcaccatgttagccaagatggtctcgatctcctgacttcgtgatccgcccgcctcgtgctcccgaagtgctgggattacaggcgtgagccaccgtgcctggcaaaaacagcctcatgttttaaaaaattatctggtctttatcatatgtcattccttcagaccctccattatgatgtcagtgaaggttatgggcatcacagcattagtagctgaagttattaattaggttcacaaaacttcaagtcaatagtttttatatcacatgtagaatgtacatgatatattagtattggtatcttttaatgaaggtgtatgttctacagtatacaaatacattacagttatattttatattatttattatattgctccatattatataccatattgggtatgtaaatatgaatgctttatacagtgataaataaacaaatggcaatgcatgctctgctcaatttttttttttctgagaggtgtgcacaataaaaaagtttggaaacccttattcttgctcttgtctcaaggtcaaagacccaagaaaaagaaaaaaaaaaaaaagaaagaaaaagaaaggacaaaaaagcgagacaaattgtttggtatattgtgctatagattagtaggttaattattaatgataaaataggtctaaatttgtacagtatattgttctgaggactttagaactctaacgtagagcacaaagagaaaaagtgtttttgaatattaggtggaggcttcatctgtagtttgttatggagtatgaagaggagagggtgaggtatggaagtagaggacttcagttaaaaaaaaagaaagagaagaaaacaaatgatgagaatgattagatcgactacctctaaatgatgaataattctaaagatttgtttcaccaatcagtaagtgaaaattttagttagcataagagaattcttttcagtggcttttaatttctgccttttaaattaactgtgtcccagattccagctctcaatacatcagagaaaaatatacagtatacctcatttgggctagtattcctgctataaatctgaaaaaacaagcttctcaaatatcaatcatgcatatcataaagggggataaatcagaatctggtctcatttatgactctaatttacaaagcaaatttatagtataagaaaaagatctgttagcaaaagttctctaacatcatggactatctctagagaaagtagagctagaaaaaaaacagatatcattggttaaaattctcatataggatgggactaagaaaatattgctttgtaagtctaatatgctattccataatacattagatcaggagtagggtgggaatgatgccattttgtttatttctaaaggaagaaaacagcctaatttggattaagtaatattaagaactaaaacctgaagaatcatttttagagcctcctggtaattcaagattgatatttgctcccttttgaaatgacaagtgaagaaaaagagaattccaatattttttgtcttctttttctctgaaaatttccttgggaaaacaagggctatggaaaatggtgaaatggaaattttaaattcccttttatacttacattctactaagatccagacttcctcttttctttgtaaattgtccagtctcagttctttatagcaatgtgagaatggactaatacagtacatactacagtgcaagaatcgaagttagtgtaagcaaaaaaattactgattccattacaaacttcttagacatatgaaatgtcttcagactattcataattatcaatcctactgagagcagactagtacggaatggactgaaattgcagcatagatatttaggatccattcatgaatgcctcagtccttaagctttgtgaagttctaaaatttatatagtgtaaagcttgaaatattaggttggtgcaaaaattattacaattttgccattgaacacaatagcaaaaactgcaataacttttgtaccaacttaatatgtcaagtatgccttaattgaatgcattcttagcacaggttcagacaaattggacactaaaatatttataagttgacggaaaattttacagcagaaagtaacactcaaaaatagtgacttattttgttttttccaatatattaaaaatacttctcatatgttttttatttcttataagttcagcaccaagaaaagagtgctagcagtggttaatgcatggtgtgcttagggtatgaatgagttaatatcgctctttaacttgaagataataaatggtctgagcaactctcccatagcattatcctaaaatcaccagggcaacattctgcttcagtggtttaaatgtgccctggtggtttgaaacataattgcactgctctggacacctaattgactacaagggactgacttaggtactttgaataaaatttcattactttaattattgttcagtgaggtgttccaatgttttaaaacaaactgttcatgtgaaattttgtttctgtggaaaaatgctgtataaaaagagttctgtataaaataccaacttttgagtgaagttaataatttcatgtgcatttttagtataataatctttagtcataaagcatatttagtgaatactactgtgaattctcgatgacaaacagccaaatgtcaaaaagcaaaatatttggacaattgaaaataaggaaaataataacagctaaaacgtactgggaccataatgagcttttcatcatgtaaccttatattccaatgagatggacattaatatgctaattttagagactcctgcacaagagaaatgttgctgtgattggtcagatccagagccatttattggaacatttctctatgatgggcagagtaactatgatttaaagtctccaaaccagttttcatatctttcctatctattcttttgtggtaaacacacctagcccttaggactgtgccaacaatcatctttgtgtacctggttagaaatgtcaactggcaaccttctccacaacagcaattttacactacggaagtacaaattaagaggtcctattagatgaccagaactaagccttctgtaccagaaaagctccctattatacctaaaagcaacctggtctttctcaattgttaataaatagcataatttattttctatttgactgttgatgttcttgctattttttcttctatttgtgttgatgttcttgctatttttttcttttatttcactgttgatgttcttgctattttttcttctatttgactgttgatgctcttgctggttttatggctgggaaatgaaaaaattctagcgagacaaattcatctgcaaatcttaacagctatgatgtgagtctcactatttaattctgtataaggataaacaggtaaggaaacagttactagggagttaagcaacttaaccaaggtttcaagtgaacaaaaacaaaccaaaaaaaaaggaggattagagacgacaaacgattttctgatatatatgaacttcttacctccctgccaaaaaaaaccacacaaatgttattaagttccctaatttgcttcaaagtgggctttaattttgtactatagaataggctattttaaacttggcacacacaacgctgcctagtagattagactataaatatatgcccactccattctatagaaatccttctacagtgaaggaaacaaacacagcagaacatagcaaatttctgggttccactgtctgcaagtttggaacaacatgtcttctctttcagtgcccactaaattctggtgctatctgtctgattagtgttatagttatatagtaatatgggattataactaaaaataccctatttattttaaattccatgaatgtaaacttggatagataatttaaagtaatttaaacactttttaactgttagaattctgtttgaattcagtgaacaaaaatctgacttacagtggccctaatgaatagatatttattgatcttacatagcaagatgtccagatgtgggcagtaatgggatggtataattgctcaaagtgccttagaagaaagatttcatgagtacttcttactttccaatactccttcccttccagggcacattgaaaactgcaatttctcgccctcttgcagttaggcaggttcatgtaactagttcaagacaacagagtacgggtagaagacatgccactttcaagttaaggcagtgaaaagcccctttatgactgtcttgctgtatccacctgcttcccttagaagccatgttctgtaactgcacagacaaaatagcaacagtctaggtgcctgggtcactacttaaaaggcagttgcccaagagaggagccaacactgcaactcactttgtctaactgagaaacacacctttgtttactaagccactgagatgctggagttaatttgtttcactccattccctagaccctgactgactgatgcatgatgatggctttcattatcattcttgcagtaagataattgttacacttctagccacatttagcactttttaggcagaaaggtaggggagaaggtggaggagaaatagccaaaggaatttctaccacgtatgctttttaaaaatttatctccaagagggcaaaatcagtgacttgtacataaattccacaggccataactctttcatatggtcattgttgctgcatgggagtgtttaaaggtaaatatatttaactgaatactattccacctctaaaaaatcatttgttagtaaaaaggatgagaaaattggtggcattaagtagtacatcaatagtgtctgccataatcctggtagaatttttctcacatagtcactgcttttgtgtggggggagggggtgaaaatacttaagatctatcatcttagcaaattgtagtgaatatacagtacagtattgttagtcatcattaccatgctgaacattagatttccagaacatattcatcttgcataaatgaaactttgtactctttgaccaacaactcccaattttttccacctctgaaccccggcaaccaccattctaccctgtacttctatgagttcaactagtttagattccaaatataagtgagaccatgctgtatttgtctttctgtgtctagcttatttcacttagcataatgtactccagattcacccatgaatagtgatgcaatgaacaagggagtataggtatctctttaacatttcattttatttcctgtggatatacactcagatgtgagattgctggatcatatagtaattctacttacaattttttgaggaacctccatactatttaccataaagagcataccaatttacatttccaccaacacttacaagaatgccccttttgtccacatcctggccaatactaatcttttgtcctttatctaatagccattctaacagatgtgaggtcatatcttattgtggttttgacttgcatttccctggtgagtagtgatgtcgagtgccttttcctaaacttcttgatcattggtatgtcctcacttgggaaatatctgttcaagcgttttgcccatttaaaaaaaaatcacttatttgtttttgttttagttttgctactgagttttgaaagtttcttatatattttggatagtaaccctttgccagacatatggcttgaaatatttctcctcgttctgcagcagggagtttcattttattgattattctctttgaggtgcagaaacttcagtttggtatagtcccaattgtttatttttgcctgtgctttcagtgtcatagccaaaaaaatcattgcacatatcgaagtcaagaagctctctatgttttcttctagtagttttatggtttcaggtcttagaggtaagtctttaatacattttgagttgatatttgcatatggtgtgagataaggatccaatttcattcttcttcgtgtagatacatttttttatatcacttgttgaagagatatttctttccccattgtgtgttcttggcaaccttgtcaaagatcagttgaatgatgatttgtaaattgattttcttgtctatctattctgttccattgtctgtttttatggtagttatattattttgattactggatatttgtaatatattttgcaattagaaagcttgatgcctccagttttgttcttcttgttcaaattgctttcaaactaattctttgaagtggagtctttcagggatccatatcaattttatgaatttttttccatgtctgtaataaaatttgttagattttaatagggtttgaattgaatctttagatcactttgggtattatgggcatttaaaaaatatttgctgtttcaattcatgaactcaggagatcttttcatttatctgtgtcttctttaatgtccttcataaacataattttagtgtacaaatatttaacctccttggttaagtttattcttaaatattttattattttattgctattgtaaaggagatttttaaaaatttccttatcatatggtttgttgtttcaatataaaaatgtaactaatttttgcatgttgattttgtattctgcaactttactgaatttgttttttcattctaacagataattttggtgagaacttagggttttctatgtatataatcatatcatctaaagcattaattttacttcttcttatttagatgttttcttttttttccttatctaattgctctgtcaaggacttccagtactttgtgggacaggagtagtgctagtgggcatccttgtataagatcttagaggaaaagttcactgtgtttttttcatttcccccattgattatgatgttagctgtgggtctttcatatatggtctttattttgctgaggtaaatttcttctatatctgttttgtttagatattttaaattacgaatggatgcccactaattttctttgatctcatctactactacagcatcaattataatttccaacagttattctcagtctcgcttgaattctaaatatcttctaccaacaatttcccttttggtaatctttcagtaagtgtgtactcaaataatcattttttatatccaattccaccttttcctatactcttcatttcatttaaaatcaggaaatttcaagacatgcccagtttctccatgttctttatcctgtcttacttctagctgatgagcaaatttcaaaggcttttcagtaaatcaaatttaaatcattctgttggtctttaacctgggtacaacttaattgattcttgttcttatcatcacccacgaacactaaattttcaagcttctgtgctggcattcttgcacacattcactccatccttactcaacaataacaatgattcttacaactctaagtctgactttgttactgatctatttcaaatcattattcatacccccaaggaaaaaaaccttcagaaaaaaaaatgcattactaaatatatcaaattcattataatcaggaaatctctcccgaattttcctttttatgaaccaaagaacatgcacatttatccatatgaaatttctttgcaatactctttgagatactatttgagattcaacatactatttcatcttttagagattttacaatttattttttctattgggagacactttttcatggagctgactcgtttctgcacacctggtaagtcaatacagtgacttttttttccgactatctttttaaggattttttaaaattacaaacagttttgaaatatggagttcgtaaattctttgataaaaagagtaggtttccttatatccttggggaagagagacagtgattcagtctagaggaatgaacaagtaattcttactgctcactagaactcatggtttcctataaggcaaccccctgcacatgtaggtgtaacctggtcctcttcataacaccctgtggaaaatgggataagagaatgtaataaaaacttgaagctcatccagcttgctgtgccatgattagtaaaatcctgtgtttctgactacaatgtgtctcatgctttctcctgaatatttgaaaatgtagcagcctaacttgttagtggataagtaggatacaaaagtgacctctcacaattcttttttttttcagtaaaaatatagaaaattttaatgacaatagtttaacataatgggcatatataggacctttcacaattcttgacagcattcgccttcggaaatgttgcctaattttagtccctatgttccccagtcttgtcatcctaattaattacaggctttgctctaaaatttagctgaaatatatgtcctcttcgaagactgtcttaaatccttgaaacagtcttgtcctcctatactgatccaagtatattgcgtacatgtctctctgaatctctcatgaaatttctaatttacacttaacctttctgccaaattgtgactttattgctaaatattatccttgtttttgacagtagcttctatgtagcaagcactagatgactctttaagaaattatttgtagaatattatcttaaatgtgcagtctccaaaataagacttaaagcacacacagagacacacacacacacacacacacacgccaccttgctttctgttgatctgtcatcacatatctctttcctacatgaaccaaacttcattctcactgtttctctaaaattgtaatgcattattaattccatcttcttaagcaagttgcctgtaattataattgtctttctaaaaaagaaaatgcaacagctgcacctactctgaaaatggatccttggagaatgtaattaagttatttcaatttggaaactgaatattatcaagagctatgggatgtataaccttaagacagacctttctaccaggtttttaaatagtatgtcatttgcagaaacctagataactaggaaattagaatgtaaattttttgcatactccaatcagaggcttagtcaatggaattatgtatcatataatcttacttgctatagttagttagaatatttgctagaccacagagcaaagaaggctagagccatgtgtttactacctttgtgacactctttatagctttatttactttattttatgaccatgaagtttccctataacccacaacagatattgcacaactgtgtttcttaagtcacaaacttaatctcaaaagaaacccattatacatttgtaccctctccagtaaggttaatttcaagggcataaactgttttctacagtttatggcttcatacataaaaacagaattattttataatggaaaactatcttccaggagaataaaaaataaacattatgtcgtatccagacaattcaaaaagtatgttaaatattgcatttaaacatttagtaaaacttattaattataatttatgataattttttgtaggcttttgataaggacctacattttcatggctaaaatgatcaatatatggctaaatggttggtgctgtattatgcactgtttctaagcaaaatgtagcccaagtgaattttatttaattgacataccacttaatgttaataacacttgggtaatactgaagatattgctaataaaaatagaaatctcgtattaaaaacaaattttaataatcatatagaacaattgccattgacatcgtgaatcccatattgccaataatacaattttctctgtataagtcttttcaaagaaaggatcttattacctcagaagaaatcatttatttggggggaaagcattaatcatattaaatgtctgctaatcttagtcaaattctctcctcttataatttataactattggccttaattttttcatctattcaaacaagctaagtatgatccttcttacattacctatactttcaacatctgaaaagatctcatataaccatcctaaatgttaaacttttgatgctgaagatcactatgaaatagcttcaatatctatatatgcagtcagaattgtcaggcttaatgaggccttggctaattcatttctcatcaacatagaaacataggcttgcatatttgaaagagtcttattgaagattaagggtgatgaaatatgcctatattattcagggtaactattctgtctcaacctatttaaatgttatccaatattattagaacacttcagactgataaatgttgatattgacccttataggaaagcaaataatagatgaaaaaaaatttgtaaagtatgctactgttataaataataatatacttaaagaatgcaccagtgatatcctgcaaagataaaaatattctattggcaacataaaagctgaatatgcttgtaaattattccacttagtcaaagataatttaatagactaggtgatttaaaaaattcaatcaagcagtcacaatttctctcgtatcttcaactattgtattcctactgagtagtttcactaaaagttatctttgaaatggaatttaaggaaaacaagacacaacaaaagttattagtttatgaaatgaactgtaaattcatggaactttttatttgtgatatggaaataagagcatcggaataaaaactggtccaattagaattcaggatactctaatggatactagatagatagcaaagtatctacacagatatatagattaagaatttgcatagacacaattatccttttgaagttgatagcttgtcattacacttgttcataatacatcttttgctgccactgtcaagggcaaatttgtgaactgatcataacattggtctaatcccttataatttatattctgaatgaacttaaataataaattaaagaaagagggtaatgccataatacccagaacagcaacattaaaaagtccttcagttagaggcagtttacaatcataaaatacaaacttttatttgattaaatctatagtagtacaagaaaaatgtgattaatgtaaaacccagaaatattaaatctcttaattaagattacccagtaatttagacatagagctatcacattatacatattagaatgctttttcttcataaaaacatgacatttttaatataacctttttataaataaaagtaaagcaaattttagctcattaaagcatatcctcaggtacaagggtaaaatggattccaaatagaaggatggcaaaagaactataaaactatggttacaataatgtaggcaatattttattgtatggtaaagtcaaggtaaacaatttataactataatgtcactggaagcacaaagatactaaacttttaaaaattcaagtaataattcatcatattatttatcacaagatggtttgaaaacactgttatactattcctgaagtgacattatagagatggagaaggttgccaggtattagggagacaaaaggaagagaagtggctgtggctatagaagggtaatatgagggatcattgtgatggacttgttctgttttgagcatggtggtggttacaagtccacaagtgtgataaaattacacagaattaaatatatatacacatacacacgagtgcatataaaactggtgaaatctgaataattttgatggattctataaatttcctgactgtgatatcatactatagttattcaaaaagttactattaggaaaactgtcaggaaaggcttaccggatctctggatgatttcttccaactaaatgtaatcttaaattacctcaaaataaaagataaaatgtaaaaacactctaaaaagttactaaaagcaaaaaaaaaataaaattaaagtttaaaaacagttataaaaaaaccattatgctagcaaatttatataaaaagctctaagaatgtcagtggctcacgcctgtaatcccagcactttgggaggccgaaacgggtggatcacctgaagttaggagttccagacaagcctgatcaacatggcgaaaccccatctctactaaaaatacaaagattagccgggtgtggtggcatgcacctgtaatcccagctactagcaggggctgagacaggagaatcgcttgaacctgggaggcagaggttgcagtgagccgagatcgcatcactggactccagcctgggtgacagagcaagactcttgtctcaaaacaaaaacaaaaacaaaactctaagatacacttccaattgaaggaagctaacattcaaggtttaaaataggagcataattgatctcaaaattatatggctttttaaggaagaggattatttctaatgaaacagtatgaaaatgaaacattaattggtttatacagcatgtttaaagaaaataagtagattgctttgatcccagtcaagtgatcttatagtataggaaaattaaatcaaattaaattttagaaattaaatgtaaacaaaagcatgaaaagacatttctttacttatcaataataactcaatgagttaaaaactatctattcacatgagtatacccagggcaagggaagaacatcctggcaaaatcaggctaaacaacaaattatattcaatgctggcataagatgccatttacagtcacacaggctgtgtactgtacaacactcaggaatgtcatttatgcagactatcatattattggacactcctgaaattgtacattgtgtcacctgcacagctgtactgagtggttctggggaataggagatatgctatttatttatttattatttaattttgcttatgctactgagatcccgttaagacaaattagagatcaaacagaaagattaaatgttttcttatggcatacaaaatgatgaacacccaatgtcatgtatgccacttccattgggaaaataacttcaatttagtaaattaaacatgaaacacgttctatgctctaaaatactgttacattaaaggaaattagaagctgatcaaatgaaagctcagactacctctcaataaaatacatgaacataaaatttcaattgtatcatgactttatttggacttatcttagtcattttgctcttacataaatttggggggtttaatagggtcacatcttctggttaatttttgaacacccacatgagcttttaatgaaggtagaaatcttcagtataaagtccatttattttcctccttgaggaaaattagtttgaaaatattgccagttacctaaaggaactgcatcattttcatattctattcacagagtaatagctgcacagagtcctcctaagaatcccatctgcatgtaaatgccgcagaaagcagtcctcacaaaataccttcaaagctagacaattacatttagagaacgcagccagggctcctggagcaaagtatactgggaaggttagagtcctagttaatatgtacctgataatttatgaaacattcaagattattgaagcaacacctgtttaaaaaaaagatgtttgcttcacagacagaatatgttttctctttgagcaaagattattattataagatttaagcaaccctgacccagaaaaaatatatttgaatacattcttttgccattcaccttttaaagagtaattattatctctaattatcctaacttactcttctaaataaaatagtaaaatcgagcagatgattgagatagtataatcaatttgggatttctcagaataaatgtcattgttcaatacataatggtagaaaaatgtagatggaaaatacattcctagcaaattctaagattggcaaattaaagattcttatcttaatacaaaatctacattaatacttctaccaaagatattcttatttcccaaatgaacttgctggcaatagtgagacaatgactggaacaattttccctagtatcacactttgatttttttttcaactcagcttcattacattttatcttcctaagtaaagagaatattatatatagctgctatcaaaatttaacaaagactgcatctgaggttgcatcatgagtttcagggatttggtgaccttattagagaaaaatgaagactttttgagtgctaggactgaaacctcagtcttcttgtagaaacttagatcaggacaaatcatgtagacatgatacagataaggaaaggcacactagaagaacaaaacctaaatctttgactgttgaagttaaaattcagaaatgtttttttcgtttgatgctatatttttggagttctttgagaagtcacagaaaccagtgcttctgtgttcagttataatattctgacttcttgattacttgaaataagacattcctgtttaagtgcactgttgcaataaaatacgcaaagtcatataagcaagatgttaaagtcgttttcaacttataatacatagccttggtatttttaaatgtttgtttgtttgtttgtttttctctccacatttctccacttctaagttgagatgctctttttctgaacttgcatggcaccttctgcctcagtttttggaattttcactcatctctctcttaggggaaggacagaggattgtttgtttgtttgtttgtttttatttagccgttaacatgttctctggaacatatactgagtgatgtttgatgagtagatggttttcagcacttcttaaataaaacaaaacactttgtcaatccactcaactatacacatgggaagactgcactaaaatcccatgacaggtaagtaattaaattattttacatctctctttcttaattgagtaatgtccataaaaacaatttttatgcttttcactacttgaaagtggcattaatataaactacaccttgtggatgtaactactgaagctatgaattcaataattatttcaattcataaatattcattatgagcctaccacagacgaagcactatgctaggcacagaaaattgacatataatgaataattttatttgcctttgaggagttatctatctaacagaggagatagacaaaaatatctccctaatgcaatatgatgagtacaataatagaggtgtgtgcaaaatataatggaaacccaaataaggaagtcattcatttttcaggcacaataagattttctactactatgaatattttcattacaaaaagcacagagtcagtgaaaaattacgtttgttcatgaagtttacagaaggcttatttccctaggtgtagtttctaaccagagaaaccaaatttgactgaaataaataatgcagaccatatgaatgtatttccttcagttctacttaagtaagattcaacacaataaaaactcacgatatttttacattctcgatatcagctattttcatgtatgccattattcctgttattttgaagcaatgaaagacaaaatgagcaaaaactgctatatcttctagttctctgttagatagaattggaaatttaaattttatttctcccaaatcatcttccatatctaatatgaaaacatagtaacaacatcatattttaattttatattgttcttctttgaatacttggaaaaataatgtacaggatattaaaaagtttagctattaccttaaatgtactgtgaaaatgtaagaaattactgcaaattttattaattaggctcctaaagatgccataacaaaatatcacaaattgggtggctttaaataatagaattttattttttcatgtttccggataccataatctcaaaatcaaggtttctacagatccatgttcactgtgaagcctctgtagaataaactttcttggctcttcctagcttctggtggtagttgacaaattctcagtgttccttggcttggaggtgtgtcatttcaatctctaccagaatcatcaaatggttttcacccctgtgtctttgttgggactcccccactgctggaaaaaggtaagcagaagatcctcagcagtccacattcccacaatatacacctgcagtactagctagaggaaagccccctcagcaccccgataccctgagtatagggagttacctggagtctcttgtgactgcgttgttccagagagttcacgctgggtctctcccgccttctaggacccaagctgctacagcatggtatcattttgagagcagagccaccatcacactacatcttgccctggggcttgatactccccgcatctcaaaaatccctgggactctgcagatttctccccaaaccaatccaaatggttgcagcaacatgtcacaagcttgacccagcagtatagctgtaacctagcacctcagaccacatagtacccctatacctctaggaaattaggcagctgagcacaacagggtggctcacctccagataatatgaggcaaagcaaaaactccccagatcctgagagccacgtacccggacctgcagctgccagcaagaacatcaattcctctagcagggaagccactatgcatccatgcatgccctctggggatctgagaactggcccacctggacaatcactcccaccctgaccatcactatgtgccactcaccatcccaaggactagcctgctggggcccactgcaagcaccactgatgcccttgtgttctgccaggggcccaaggactgctctacctaggacctgttgctactgcatgccaaacccaccctcttcagcaatggggcagctgtgcctttgcctgctacccaggagtgtgaggatagacccacctggggcccatcacccccactgctggtcctgtgcatacccccgatcagcttgtccactgtccctgttcccagcaaagctgcatccagtctccacaaataaatgcattctaacctactcaggaactcacagatatcactgaaattgattacagctaagtaaatcatacaaagattatacaactgtgcccaatcagaaccaaaaccaaagcactctgtccaacagatactatagataaatctacagaaaaaaaactttgccctataaatctactccacaaaattggaagaagtgtgtacaccaggtacacagatatcaatatagggtcataagaaacatgagaaaaacaaaaaaggaaatttgacacctccaaagaaaaggaaatctataaaattcatgaaaaggaaatcaaaataataattttaaggaaactcagtgagaagcaagaaaacacagacaatttttaaaaatcaggaaaacaattcttaatctgaatgagaaattcaacagagatatcatgtaaaggaacaaaacagatatcctatagttgagaaatacaatgaataaaattaaaaaatacaattgagtgtcaacaatagattagatcaagcaggagaaaaaatttctgaacttaaagacaagtcttttgaaataacacactcagacaaaaaaaattacaagaaaatgaataaagcctacatgatatatgagacactattaagcaaacaaatattcaccttttgggagttctagaagaagatacgggagaaggcacagaaaatctatttaatgaaataatagctgaaaacgtcccatgtcttaggagagaactagacatccagatctaggaagcagatagatccccaaactgattaaagtgatagattttggcagtttgaatacaatgtgccttgaagaggaccacagaaatgaaatatttctcttcaaggcacactatattgaaactgccaaaatcaaagacaaagagagaattctaaaacagcaagagaaaaatgtcaagtcacatataagggaatgctcattagactaatagatttctcagcaggaaccttataagccgggagagaatgagatgatatattcaaagtgctgaaaataataataaaaaagctgtaagaaaactacctagcaaagctaggtagcttaagttcttaagctatgcttaagaaatgaagaagaaatatggtctttcccaagcaagcagaaactcaggaaattcatcacccctataatggtcttacaataaatgtgtaagggagtcttatatctggaagtaaggtacaatatctaccatcatgaaaacaaacaaaagtatacaactcactggtataaaagatatacaaatgagaaaaaatataaatagtaagagaggaagaaacaaataatatacaaaacaataagaaaacaacaaaataacaagagtagatctcacctatctacaactttggatgtaaacaatttaaaattttcaattgaaaggtagagggaggatcacttgagcccaggagttcaaggtcagcctgtgcaatgtggtcagactctgtctctataaaacatttaaaaattagctgggtggcatggtggaatgtgcctgtagccccagttactcagaaggctgatacaggagaatcacttgaggcaagaagttgaggtggcagtgagctatgtttgtgcctttgccctccagtctggacaacagagcaagatctttccttgaaaaaaataataataaaggaaaattttaaaaataaaatgatatagactggctaacgaataaaaaacaagacacaagtatatgtagcctagaaaactcttttctcttataaagtcacacaaagatttaaaatgaaggaattcgccaaggaaaggaaataaaaggcatccaaattacaaaagagaaagccaaattatccttgtttgcagatgtcatgatcttatatctagagaaatgtagactctaccaaatgcttttaaaactgataaaaaaattagtaaagtttcaggatacaaaaaccaacctacaaaaatcagcagtatttctattcactaatagcaaactagttaaaaataagtcaagaaagaaatcccatttgtaataggcgcaaaaaaataaaataattaggaagaaatttaaccaattaggtgaaagatctctacaataaaaactaaaatgtattgataaagaaattgaagatgacataaacaaatggaaaggtatcccatgctcatggattggaaaaattaaacatgctaaaatgaccatacaacctgaaggaatatacagattcaatggaatctctatcaaaataccaatgacattctaaatataaaaaatataaaaaaattctaaaatttgaatggaaccaaaaaaaaaaaaaaaacccatgaatatccaaagcaatactaagaaaaaagaaaaaaatccatggacatcacactacctgttttcaaaatatagtacaaaactatagtaagtaaaccagcatggcattggtatgaaagcagatacgtagatcaataaaacataatagagaacctgaaaatagatacacatatttacagccaactgatttttgacaaagatgtcaaaaacatacactggggacagaaccccctcttcaataaatagtattaagaaaattggatattcatatgcagaagaatataattagacccatatctctctctatttaaaaaaaagatcaatttaaaatggattaaagacttaaatgtgtaagaccagaaactataaaactactagaagaatgcatacgaaacacacttgaggacattggtctgtacaaatattttatgattacaaaataaacaaatgagactctattaaactaaagagctttggctagcaaaggaaacaatcaacagagtgaagagacaacctgcaaagtgggagaaaatattttaaaactatttatccacaaaggactaatattcagaatatacaaaaaattcaaacaactcagccaaaaaaaaaccacccacaaataattcagttaaaaggggggcaaagatctaaataggtgcttgagaaaaggaaagtcatacaattttggtgggaatgtaaatcactatagccattataaaaaacggtatgaagtttctcaaaaaactaaactaaaactaccatatgatccagcaatcccactattgaatagttatacaaaggaaattaaataagtatatcaaacagatatctgcatcttcatgtgtactgcagcactattcacagtaactaagatttggaatcaacctaaatgcccattgatgcatgagtggataaagaaaaggtggtatatatgcacaatggaatagtattcagccataaaaaagaatgaaatcctgtcattaatggcaacatgtatgaacctaaagaacattattttaagtgaaatgtcacccatggaaagttaaatactacattttctcacttatatgtgggagctaaaaaaaatggtgctcatagatgtagagtaattttatggttatcagaggctgagaagtgtaagaggagagtgctagagagaggttagttaatgaatatgaaattacatctacttcccagaaataaattctagtgttctagaacaatagaggatgaatatagttaacaataattcattgtgtctgttcaaaaagctagaagaaaggattttgaatgttcccaataaaaagagccaaccggctgggtgcagtggctcatgcctgtaatcccagcacttcgggaggccgaggcaggtggatcacgaggtcaggagatggaggccatactggctaacatggtgaaaccccatatctactaaaaataaacacacacacacaaaaattagccaggcgtgggtggcgggcgactgtagtcccagctactcgggaggctgaggcaggagaatggagtgtacctgggaggcggagcttgaagtgagccgagatcgcgccactgcactccagcctgggcaacaaagcgagactccgtcaaaaaaaaaaaaaaagagccaaccaaccagtacatcaaaaattcctgataacgccccatcctgtaatgttccatcaatcaatctatagaaatagagaataaattctaacactataaaccatgacgttttgtaatttatcattccaataggttataaattgaacctgtagaagtaggaagtcaccaataaatttgacttgtagaagtagaaagtgtgaaaaataacaattcttcataaacaatatgacagaggcaaaataaattcaaaatatattcaaaatatattattgggagcttttgacttgtgtaattctaatttattttgttaaatattaagaaaatatatcataaatatttgtaatatatcttgcatttcatcaggcatatctactgagtataacagtgctgagtttggctttacgtatgctaattaagaatatgagcatttgcaaaagacattgaaagaataggggtttatttttaaagtatgatattttattggtttttcttgagttatattctaatcctctttagcaaattggtactatgatctgtattttccttgaaaattgagttttcagtttaaatcagtgtcctattgaggacgttcattttctcaatcaaagatctttaataacttaaaaatttaatatatgtggctttacttctttgtgtgttttccaacaaggcaaagtgtaacctaggtgtcagctaagtcatctcttttaatatctgaatatgttttgttggaaccgcatcgcatagcaaatgaaagacacctgattctctctctctcacacttctgcaaattcctaggagtttatttttttaagagtcattttccactccaaatttctctttgactactcttgatctcactcatgtttcatttcctatggttgtttttgtctttctaaaggacccaccacaaaccacatacgtggaaagtggcatcttttttatgaatccaccaacttcttattcagaagattaacttgggtaggaagaatcaatatcgtgaaaatggccatattgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcatgctacctgacttcaaactacactacaaggctacagtaaccaaaacagcatggtactggtaacaaaacagagatatagatcaatggaacagaacagagccctcagaaataatgccgcatatctacaactatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaattttagacctaaaaccataaaaaccctagaagaaaacctaggcaataccattcaggacataggcatgtgcagggacttcatgtctaaaacaccaaaagcaatggcaacaaaagccaaaattgacaaatgggatctaattaaactaaagagcttctgcacagcaaataaaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggccaaggacatgaacagacacttctcaaaagaagacatttgtgcagccaaaaaacacatgaaaaaatgctcaccatcactggccatcagagaaatgcaaatcaaaaccacaatgagataccatctcacaccagttagaatggcaatcattaaaaagtcaggaaacaacaggttctggagaggatgtggagaaataggaacacttttacactgttggtgggactgtaaactagttcaaccattgtggaagtcagtgtggcaattcctcagggatctagaactggaaataccatttgacccagccatcccattactgggtatatacccaaaggactataaatcatgttgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaaggataagttcatgtcctttgtagggacatggatgaagctggaaatcatcattctcagtaaactatcccaaggacaaaaaacgaaacaccgcatgttctcactcataggtgggaattgaacaatgagaacacatggacacaagaaggggaacatcacactctggggactgctgtggggtggggggaggggggagggatagcattaggagatatacctaatgctaaatgactagttaatgggtgcagcacaccagtatggcacatgtatacatatgtaactaacctgcacactgtgcacatgtaccctaaaacttaaagtataataataaaaaaataaaataaataaagatgtatacaaacaattcctccagcaaactgggattaaggattacattctacaccagcaaagaatacacctgaatattgaacattaaacacatatttttcttcaaactttctgagtcatgactctgtcagagaatttctctttttttcgtgttctttcttttttttcttttggagatagggtcttgctatgtagcccaggctggagtaccatggcagtgaaccatggactaaagcaatcttcactgaaggaattccctgatgtactacttttcttttcaacttcctccactctcctctttcaatacataattttcattcaacatcactcttggttttcctcttttcttttgtattatttgcagataatgttattcctggaacaatggaagaatctcactactagccaatctgttctatgccaaagggtgtcatttttagccaatcacttaacaaaggcaattgttcttcaagaggaattctaaggtagctatttttttctattttccacaaaataatttaaatacaagtcatagtactaatttagaacataaatcatattatctaagacatagagttaacaatacattgaataatgacacgtcatcttctatatagcagaataaatatgtaattatcttgttaaatacatggaagaaaaaccctgaaattttttattgcaagagagataataaagggatattaattttttaaatacccattattttgaaatatagaagatgctgaatctcattaaaatcatctggttttatggactatagtgcaaataaggcaagtatagtgcaagtcttcacttgtcttcctttatcacttgtgtcacttgcctttctttatcatgccctttgttattggactttgcagctcctcccaagagtctgtctgctttctcgagaactgaaaattccatatcatcttataaggtctgatatcctactgttctatgcttaatctggaaaacaaacaaagcgaaaaataaaataaaataaaaaagaaagcacctgccttttgactaaccatgatgactgttggttgactaaccattatcccgttttgtagaataatatagggaggtatgttgaacagaaaatgagtgttcagaaaaaaaaagttaaagtcattgtagcagagaaagtcattgtagaagggaccagtgagtttaaaaggaagttttaatgtttcgcttttatgctttttttgtatgaaaatgatcctatatgaattggctacttatttttaaatccatgccatcaaaggattttggggctaaaatatttgcctgtaagcatttactagataagagaaattagtcaagttaggcataggctagtttcatgaaaaagatgctaatggaggggagttgcagaggtgactttcaaaagtaatgcctaaatcaagaaattatattttgatgatctgaattattaaaagtattcagaaaattgtcttattaagatgaaaaaatttgaaatatttgtttatttaaaaatgtaagctatttgcatattagaaacaaatataccagtataagataagttctcaattattaaaaccttacattctctaatattttagaaaattgtaggttctctgttacaatttgtttctttctacacaaactgacaagaataaattgtttatacagacttatgaataaaatttatggataaaattaatgtgcttagaagaggcaaactgctttggaagcccctttcttccccatccacactgtgctttgccaacatcttcaatctcctcctccattgtcctaatattccatggcccagcaatgctgttgcctgtcttgttatgcttacatataagttaacaagcctgctgtagaaaaattatgcaagcttataattgtttctcttacaaacatatgttgtgaaatctcaaccctattcaaaatactgcccagcaatcctttgattcccaccccctttttctcacattctccagagaaagtatttcaaataaatctcactctgctaaaatatcctaacctaccacctctcctcactttcaggacatgattttgcctctttcttaagaaagaaattagaaactattagaaaaaaatacatagagagagttcaatttctggtcactgcacttataaacttaaatgagatatatctatctttttatactttgctcttatcaaaatgaaaaaggtgtttcctcttggctaggactaagtaataggttaataaattacagaaaaaaaaatatgccaagcattagaaattatgattaaattaaaaataggtgaaaggagtaagcaagaggaactttggagtttagtgtcaaagttgtaggggctctgagcaatgctcatgaaagtatttattaaagtagagcaaaggtaagactggtctgatagaatgaattaggaggtattccctcctcttctatttttcagaatagtttgaatagtattagcattagttctcctttaaatgtttggtagaattctgcactgaagccattgactcccaggcttttctttactggaaaactttttattatatctttgatctcattacttgttattggtctgttcgggctttggatttctttatggctcagtcttggtaggttgtatgtgtctagtaatttaacagtttcttctagattttccaatttattggcatatagttaatcacagcagccactgatgattttttgagtttctgccgtatcaattataatgttttctttttcatctctgattttacttatgtgtatctgctctccatctctctctctctcttttactttagtctggttaaaactttgccaattttgtttaatcttttcaaaaaaacaactttttgttttactatcttttatattgttctctttatttctatttcatttatttctgctcttatctttattattgcttttctattaattttgagtttggtttgctcttgctttcatagttctttaagatgcatcatgggtgttttatttgaagtttttcttttttgatgtaggcacttgtagctataaactttcctcttagtactgctttttctgtatcacataggttttgtatacccatatatgtggtatctataccttatttgtggtatctatttttggcaataaagatcatacactctgtgatattcaatcacccattcccctgactctagtctttgataaacagtctttgtccttttattcccatatgtagagcttcgaaatcaattaagttccttacaacctctgacataaagcagtctcctaaatggcctattaatcttcactttcttcatctgtctcactttttagttattgtatttttttcctcctgcctttcacaggcagattatcaaaggaaagtttactttctactactgtatctatctgtgccagtatagacataaacataaacacacacatatttctataatatgtaaaatactagtgagtattcattatacacatttttcctacagggattgcatcaataaaaaccatgtatcagagattgctagttatcctctaacaccttttctccttttctttcctaaaaatgggattttagctgggcaataactagctagaataaggattgctttcccctgagtccctaacagccaaatagccatgtaattagattttggccaatgggatataagcagaaataggagaaaatgaaatagaaaatgtaggtcagcaactaaaactttgtttaagaggtagctgatgactgccatttgggttttccttttccttgttcttcttcctaccgtttgaagtgtaacttaatggctcaacttgaacaagatatgatcttgggaatgaaagtaacctacaagtagaacagtcaaataaatggatcctgagtgtttgatactaggtggtggtggtgcggttcccataaatgcctacctccagaaacctgcattaaaaacaaacaaacgaacaaaaacaaaacacaaacaacttgtgtcttgttttagcctcttggtttttgtttgcattttgcttatattttcttttattcatagttaaacctaatccaaactaatttatgtaacttcagtcaaatcaagtacaaccattggaaaaaacatgtaaaagcagattatcaatgatgtcaaattatatgtggaacaaaaattatttatacatttcacaaatgtatgtaaaataagtatagtgtgaaatgttcagggctaggcattctgtttattttgagatccaagttctcattaagatcctgttatttgagcaaagatatgtgtacagatagaaacaaagcaagagagaaagtaatctggaaggagaaaaatcacaaaatctttagattgttgaagtcacaggaaattatgcattccaaagtagggtgaacagaaacaaaagatgagaaaaaagctgggtagatgccatcatatacagaatggatgatggaagaaaaaagaaaagaaaaagtctgaaaggatatagtcagtgagtaatagaaaaagatacaagaaagaaaagacatcccagtgaataagaatgaaggatgttctggaaaagaggtaataatcaacaaagtcaaatgttgcagataaatcaagtgagataagtattaaattaggaactaagaagttattgctcattttgtaaaagacagttccagagaaatgatgggtaagctagtttaatagtaatcgattagggagcaaaaattgatggtataaaagagaattaagaaaattggggcatgacactcctgagtagttgagaaggaacagtgcacaaatggaggaactacctttagatgggagtcagccttcactggaaacttgtattgactaaatttgttagtttaaatctaaatgtttagtattattttaaccaactaataaaaataaataattgtgcaaaacgattttaataaaacaaaatgtattacataccttattgcattcttaatttgaataacattacatagattttctatgttatataacctgcatgccatgttttcactaatattctgatcttgataaccatattgttcccttgacttcagccagtatttcatttttaatgacttaaaaattcttattcttacttcaaactatatatcataattaagtcaaacatccaataggacatattctttttggaatagtgcttatctgcaacctacatcttaccaattgaaatcattatttatcttctgggcccaatgtattaaaatgtctttctgacctttctattattatttacatattttccataatctaatctgaagaaattactattactctctttgatattcaatcactcattccctaactttagtctttgaaaatcagcctttaaccttttatttccatatgcagaccttccaaattaatgaaatttcattcagcctctggcatagagcagccccctaaatggtcttttaatcttcactttcttcttctgcctcaccctttagttactgtaactttttcctccttcctttcacagacagattttcaaagggaagatttctttgactatctctactccttcactttgcttaaatgattctccccactctttatcattaatttttcaatgtctggtaggtgatcaccatcacagtattaactctgccaataaacaagcaaaaccacaaaataaataaaaattcttctcacgctactaatctatttatcactaggtcttatttattctatcaaatcatgtatttgtatcaattaatttactatagtttacaataatctattgtatatttcaaagtagctagaagagaataatgtagatgattctagcatacagaaaagacaaatatttaaggtgatggttatcccaaggacactgatctgattgttacaaattatataaatgtattcaattatcatatgtgggccaggtgcggtagctcatgcctgtaatcccagcactttgggaggccgaggacggtagatcacgaggtcaggagatggagaccaccctggctaacacagtgaaaccccgtctctactaaaaatacaaaaaattagccagatgtggtggcacgcccctgtaatcccagctactcgggaggctgaggcaggagaatcactcaaaccctgcaagcagaggttgcagtgagctgagattgcaccactgcactccagcctgggtgacagagtgagactccatctcagaaaaaaaaaaaatcacatataccccaaaactacgtgcatctattatgtaaaattccctgaacaatttattcataatatctgttctccaattctcccttaaaactattccaatcacactgtcacttgcaaaattattttcatcaaagttaacagtgacttccatgttgctaaatccatttattaatttaggaacgtattttataataagctccaaaaaaggagaaaaaaactcttcccttgctcctactttctttttaacctattgtcccaacactctttcttgcaaaattccctgaacaacttatttatagtaattgcctataatatctcttctccaattctttcttcaaacccctccagtcagcctatcacctacaaaattactttcatcggagttacccaatgacctctatgttattacatccagtgatcagttttggagcttattttattagcttatcattcacatttgacaactggccaattccattataattttttcttttggtttccaggaaaatttataaagtcaatcttatatgtctgtgggatctgtattagcagattcaaccaatcacagatcaaaaatatctgaaaaaaaaatccatacaacaataatacaacaaaatgatacatacagtttaaaaactatgtacaaagcatttgcattatattaggtattgtacataatctggagattatttaaagtatatggaagcatgtgtgtaggctgtatgcaaatattactacattttatataaggaacttcagcatcccaagatttttgtataatcaggggtggtcctggaaccaatttcctgaagaccctaagggataactgtactgtattgtttttcctcctatctcatttactctcactctcaatctcctttactggttcatcctaattttgctgacattttagtgttggagtgtcccacaactcaggtattagtttctttttcctttttttaaatttaataatcacttcaactggtagaaacaggaataattacttccactttgagatttccaaatttagaagttcagcccacacctttgacttgaaactaagatttgtatatccaactgtccccttgaaatcttcaactacagatttattagccatctcaaacttcacacatccaaatttaagctccacatcatccctccaaaaatgtttcatcaatagccttcccaatattagttaacttaaattgtatttgctcagttcttcaggtcaaataatctgggatctgtattagcaggttattagagatattctttagagctattcttttctttctccaacttcacatttcaagaaattctatcatttatcttgaaaacccaataatttagcctcacctccactgctattttcttatttcataattataaactctcacttacataccacaaataatgtctgttcttttagctttccctcctatagtttattctccacacggtagccacagtgactttttttttaagtaataaggtcaatcatgtcattactgtgctcaagcccctcaagtgaattcacatttcatctaaagtaaaagacagatgaatcttgagccaggctctattaattatctttctttccctcctactgcctttacccatggtcattcttttctagccacaatggcttcttaggtgtttctacaacacaataaggcccactctgctttaagtattttgctctagatgtcatttttgcctgaaggctcatccagttgactaacttccttatattcatcaggactttgctcaaatatcaactttacaattaagtaagctacacactcatcaaaacattcttgctctcttgacctctcttactcttccacatcttttctttcttatcactctctagacagagtgtaggggtaccttatttatgttgattactgcttttgttctagattcagctttggctccttgttgatggatgacaatgggtaagtcatgtcacctccctagatctcaggttctcacctataacatccaaggtttctcttaattctgatattatggcattgtcagcttagacgctatgacagaaacaaagaagtaaaacgttcactaaatacaatactttgtaaataactatttacaaagccttggatggagagttggattagatgctctttaaaattatttccaaacttaattttgatttttactagaattccatttgtttaatgtttattcaacaaatacttgttgaggtgcctgctacataacagcattgttctaagtgcttctgtgtctaaagcaccaaagaggcctgctctttcttcccttgtctgcatgaaagtatttcacaagacttccttctcttaccttttcaaatgactccttcggttttcttttctgtatcatccttctaagtccaggacttatatgttgttaagtctcagattcagtcccagtcttcctttgttttctcattttatcctctttctatatatccaattatattgttgcctattggttcacttaccatcaatattaactaaataccagtgttgtgcttctactctaaattattgaatcatataagaaatatagttgtctagtagatggctttaattgcacatcttgaagaatattccaattaaatatattcaaaacaaatctcaatatttacagggttctcattccaaacttaacctttcctcaacaatttccaactcagtgaatattactactgccttcaccatttgttcagatcagaaaactaggttttatttcaatactgccttctttatcaccccccagtccattacaaagtccttttgattatacatcatcagtatctctcaactcagtctacttccttacctcattaatatgactctaattccagctaccgtgatcttttcttggaatactgcaatcatctcttaagtgatcttcctacagcgaatcgagtccctcttcaaatcaatctcttcatttcagtaagaataatcatttggatattcaaacatcttcaagtaattgttttggataaattcccatggttcttagcaaatcttcacatggcttaaaagatcctctctagtctagtgtttacctatctctttcctttatcagtgtcatcttattcattctttcactcagttactgaatcataatctactcaatgatataattagatacaaatttttaaaatagcataaagaagcattttactttaaaaatattatgtcttaaaagcatgttctgaatactttgcaggtttcattagaccataccttgagtttctaaagaaacaaaccatattcccccagatgatggtgtttaatttttgctttcagataacaaggtatataacaagtctgcttaaacaaaggaaaattacttccaagactattcaattaatttgagagaaaccatcaagtttggactggcatgctaaaaaacacaactgtagattacaataggaataacttttatttgtttatacaagttttgaatttcatctattttttatgtaaatagctcgatcttcaaaaatatccttcagctctgacaacctcttcacataactttcctgtaagatcttttaaatatccaaacctgtaaaagtccacattcagttgttctttgttccttagtttgcttcaacaacatcaatgcaaggttaatagaagctatttacttaccatatggtaggtggctcagaaccttctatttctaagtaatcatatttctcttccatttgaaaatcagtaaatatgagtgaaattgtgtccccaggctctgctacaatggtccaagtgcaatcagcattgttatggtactcattaggaaaactagggctggatatgatgccactggatcctctcattgttcctccacaagcatcttcagctgttaaaaatgacaaaatattcagttgtaagttattgagataaatgcaattgttcagttgtaagtaaagcaagtcaatatgtttggataaaaataacagttcaaatgtgataccaagtgcataatatactaatagagattaaataaaatgagaattttatgaaaaaatgtatcagcacatatacaagtataaagtatatcttaacaattttataacaattagttgaaatagcaataaaagtaagcaaaaaatctacactctaaaattagacattaggaaaatagaatcaagattttattttcatgtttaagtgacaaagtgagttaaacaaaggaaacatgtatcttaaagtctgtgatgggaaatctttgatcactttgtttattgacggaagagctttttggtttttcaatgcaagtatgtacaacacaaagacataatttaagagacaatataatatagttcatgtcaatggtatgtttcagaagttattgaaaaacgtttgtagaaatacaactcaaataaaaatatatcacatatccaggatattttgtttacagagaaataatagggtaactaatataactttagaaatatattcatatgaaatcaaacaatgtatcttttactaaatagtcatataatgtacatagatacaacaccataaataactttttgactaaccttacatttggaactgtgattctgagtttccaaattggggccatagattctccactagtctacttttggctgatggtaggaactagcagcgtggttatatgagtagctgtgtttggtatgcaaacataagaaaaagctcctgtttcataaaggaattgaagctggggcatttgccttactataacattgtttaggccagtcaagctaataagttacaagttcacttgtgaaataaattgtcttattacttatgttattgccttggccaactcagggaattccttcaagtttttgaggaaaactctggctctataatgaccaattattatttgatgtgaccgatagctccagaacctaaacaaatggagatggacaatatctttgtattcaattccatgatgggtagaacataaaaaaaattgctttgttattagagacaactttattactgtattatatgcatcaaatagtattagcttttttctttcttgctctttatccatttacctccataatctataaatcaaaaatgtaagtatgttcgtcttaaaatatatttaacttttatcacacactaaatatattttttaaaaattttattgtgtgctctttctctcttaagtttgttagataactgaaatgaactagttgtcttgtctagaccatgtggcatactactacaaatatttttaccaatgccttcaagacctaaatcttctagtaatcctgtcctgccgtctctaccctcaaccataaatcacttctattctttcccttctcaagtaccaagaccaacattgaatactgctttgataataaattatttcactagcatatattcacagtttaactggcccacaatctatttaaaccagctcactgagctatttattttccttcctctggataaaatctgaaggagacacataacattctggatcacactcagattaaagaaaaaaatcccacagtttagagattatagttcaagtgttctcatctcaaaaataaaaagtatatgaagtaaggcatacgttaattagctcaatgtagccattccacaatgaacacatatttcaaaacgtcatttgtacatgataaatatacattacttttgtctgtttaaaaataaatgatttaacttaaaaaatcacaatccatcaattaatatatccagtcctgggtaaccaaaaagaaattaacttcattttgattaagcttctttgctccctataccttggacttgtggcagatggagcagaggtggggcagaggtgagatggagaagtcggtctccttccttgtttccctgctagtatttctgttcatcctcccctttctcactgagatctctatgagcctcctggggttacaagtaggaaggatcagaggatctgaatcctcttattttcctaacactaatttggcactggtttctaagggctttgacagacaattaaagaaagatgattctttcactcataggccctttcatgggctccacagaggtgtccccatcagttccattactgtgggtgactgtgtctctccagctggctgcttacatttctgtctcatgctatgggtatagaacagtacagtttcatcttctttccaaatgtctcctcaccttttgagattggcctcttggacagcatgtaagaccatgccaagccagaactccctcacaaaaatcctgcatttagtcaaatgaaaacacacccatttattcaccctctgtggaaatgcagtttctttcaaaatgcagtcctttgggttcacaatagacatttaaatactttatccatcattttaataataataatatattatattccgtaagctccaaggcatagaaatcaatttctctacatgatctctttgaatttcctcaacctagactcacaatgctgataaataactctacactcctgacacatggaagagagaacaacccagaaaacaactcacttcaaggaaatcttgattttacagcaaaataatttctgttcaaatgtatgactaattttcacttgaaaacaaggatagggactcagttcctccagcattcaaaccaatgttcatgtcgactcttgtactgagttctatgctcaacacttctgtttaatttgtttgttatgacagagactatcatagaatcagtatctgacaaaatggtgaaataggtaaacttttcttcagtaaatgttagattaaaaaaaattttggtttggtgtccctacttgaatgctgaattcaaggcaatattttaaaaaaaacaacaacatattttctgtaattatgaattcatagcagaacatactacctaagtcaatttaaaaagaacttatagtggatttgggacaagtaaaaggcagcattagaacaaaccatgaaactcttgaatccagtgctgtgctctttctgctaaataccatggcttggtctctgttcaaaatgagttggtacatatcctgtaaatgacaggatagagccttctattctttcatcattactctgtcacagcctccaggcttgcttgattaataaatgatgtctacagcattttctatccaacaattcacagaaagtggggggttcacagaaggttgttccatagaaccatctccttagaggctcaagatacacataggatcatattggttatttgtataaacttcttgtgaaacaaaatttattcattttgtcatctgtccaaaaagtattcattgagatcttccaagtgccaggaggaaaccatgtaatctctctgactataatgactataaaacgttttcatgatccctgttctcatggagtattctattagtgagtcaggctctaagcaaatgacaaagtgaatacataaaattacatttctgtcaggtcctatgaagaaggaacatttagtactaatgctgtatgtttgggaccttgaactagttatcgaattaaggaacaagaatttcctgaggaagtgatgctggaccagaaacacaaagcaaaatagtaagcagtaactacatgaaaagcagagggaagggtgttcctgcagcttcactgacacttttaccaaggtaatgggcctgtgtgctacagtaaaaagggcgaggggctatctggtaccaaatccaattggaagggcaactaagggtcagaccttgcaggacatttctgacaaaggtatggaatttattcatagtaatggaacattaaagtgtttttagtggggatgtgacataattggatttaggttatcaaaagatcatttagttgctctatggagggataagagaggaaggccatagctgatgaagattaagaggctgaatcaagagtccacgcaaattcttgcatgcttcattgctgcctaaagataaaacatctcgttttgactatattattttatttttatctcattatcttcaaaagattagtttggtctttctagatatgtcagaagaaataccatgatgacaaaataatcagaacatccatcttaggccaagacttaagaataatatattttcacctaaatagtaaagcaatgccattaaataccttagacttcccttgaggttaactagaagttgtgatggcttccgaatgtggttgcttaacatacagataatacagtgagtaataaaaacaatggtggattctctactcttgttctaggaaaagtataaagtttgtaagatttaaagtcatttaatttttcatatatgtatatgtatacacatttacatagcccagatgttagcaaattgcatgttaagaagtttgcaaagtcaatctgttgtaaaacatgaagaaaaccacaaattcagctaatgggatcaataaagacaatgtggaattttaagaatgaggactaaaactattaacccttttggaatttggatttattccaattttcaggagcaatattatcaattccctcgtaagttcttagtgaatttaaatctattaattaaaaactatggctgttaaaaatgttagtaaacatcattttaattgtttaaaatattataatataaatctatcatcaaataacaccatttattatactttaaaataactgaatttatgtaaacttcataaataatgcttttttatctcttacctatagagcagggagaaacataacaaaataaaataaagattagttgtattaaagtgaaaaggtttttaaaaatagttcactatgatttcacaaatgtactttttcctaaaattaaatttttatttacttttaatctctgtgacagttatttagatattgtaaatgtatgaccttgttttggctttgggtatgagaccacaccatttcattgaacataatataaattggaacttttccaaacatggctgttaataaaaaaataaacacagcttcataaaacacccaaatggttttctgtaacacatcttttccaatactgatctcatactatgctctaccttgctattagtttctgctgaaatagcttagtgttgggggtggggtgcaggaaataggcttgtttatcatcaaagagaaatgaactgtaaattgtaggagagaagtacacttggtcgattccagatgctaagcattcaattcaatttcaaattttatcatggaacattttttctacaattctcctttgctaaatctataatttccatcagcactcaagtgaaactgacatctatgtgaggctttttatttcgtcccaagacaggcatcactgttgtgtgcctaattaggcaaactatttaaatattacactgtcattaattagccatcttattacatatatggagcagtagttaattttgtgtaactgcctctacttacatttaatagttcaactctttgcattcttgtgtttaaagagaaacccctttctcatggagaagaaaattgagcaactgggtaaataactggtaaataacacttcagattgataattttgttttatgtttgtcacggtacaacaaataataccttcccagcttatgaagaaaacaaaagtgcattttcaatgattctgaaggaaattaaagattctcatatttttatttttcagtcaagctacctcagttcctttcatattaaaacagatgaaattaaaatgaaaaacatgtataacagatcaaagaaaaatattcaatattcactgagataaacacctctgagaagtaaaaagagcaaagtataatggcattttagctttgaaggtttatttttgaatgcacaaatatgcttattacaaatatcctacattaatttccatttaccttccaaagagacatgttgagaaaatgagagacagttaatgcactgaagaaagtaattaataagtatgtgtttttaaacatacagcttaaaatacttctcagaatctctaaataagacaaaaatataggcattcattcaataaaacttaaattatttaaagatttggagaaaaaaatatttaaattaaatcaagtaataaacatgaaagagcaagagggaacaaatttacattactgacttaaaaattaaaactgagaaaaatatatataataactgttttaaaacattagaccaggtctatgaagaactgtgatctaagagaggagaaaaactaagaaggagagccctattatcacttggctttctctaaggagatacattccggaccatagaataaggagagggattacaagtagagcatagtgtttctttcagctcagtacatagaattcaggaagcatgagcaatggaatgttagtcatagggcaaagttctagagaggaggaagctctgcagaagaaaaggactcaaaagatttacattagattctcttcattagtgtttgctaaatactaataaatgcatgcaattggatgaaatttcatgaagtcacataaagaggaatgtgtaagatgaatggttccaacaaagcacacagggctgagatttgttcaggtaccactagctagaatatagagtccactttgaatggagtattcagtagaaatctcaaaaggggtgcacttcagtagagagggtaaactatgcctagagttaaggccacttaaaaatgcaatacttaaagcttaaaaacaaatctcaaaagacacaaactgaaccaaaagtaattttaatacatacatactagaagaaagctcaagattccttaaagataactaaatccagacactaaatatcttaaaattcacaatgttcaatatacagttaaaaaaaaaagtactagccatgtcaataaacataaagatgtgactcataaccaagagaaaaatcattagaaacagaccaaaacatatggagatgatggaattagaaaataaggactttatagcagatataactatattcaactacttaaaacaagggttagcacactataccccagactaaatctggcttatagactttttttttgttttgcctgtgatctagtaatgatttttatatttttaaaggattgtaaaaacaaacgaaccaaaatcaaagatgaatacatgttagagaatatataaccacagcaaagcctaaaatatttactatttagcccttttcagaaaaactgaactcagtgaccacagtgaggaaagaaagggaagatatgaaaagatgaccacatgaaacgttaagagacacaaaatatattactagaaattaaaaaaaaaatactcaatgggcctcatagaagagtagacagtacaaaagaaaacacagtggacttaaacacatggcaatagaaactattcagaatgcagctaagagaaaagcaagatttctttttaaagaacagatatcccctataggaaaataccaaacagttgaatatgtgttattgaagttccaaaaaggttgtggagcaggggcaagcatggaaaactatggaaagattaatggtcaaaggatttacaaatttgatgaaaatataaaatccatagttacaaaaggcttagagttgtttgcatcttgatgtggtagagacgactagctgagatccgaaattcatgttccacttccatttatgaggtgttgctgggaggcagctgccagccaggacaaatattttagtgcttttcacatctaagtgaggccatgtagctgaattctgattaataagttgtcagtgaattgagatagaattgcaatctttgttatccacattctttattctctttctttttttttctgtttttgtaaaatagctttattgagatataactcacatgtgttcacccattgaaagtgtacaattcaatgccttttagtatattcagagttgtataaccatcaccacaatgaattttagaacattttcatcaccccaaaatgaaatctcacaccttttaatcgtcccctccaattcacctatgctcccttccccctgggccttagacaaccatgaatccaccacaggctctatagatttgcctattctgaacatctccaaacctgccaaagctatgccattaaaaggcactacagcaaagagcatcatgcaagtcgcatcacactgggggcctggcacagaagtggtggtggtggcatcaggcagggcctgatccatggggtccagggtgaccatgtgggtcatgcaaacggcattacacaatatgccatgcctggctaagttttgtgtagaaaaggggtttcaccatattgcccaggctggtcttgaactcctgttctgccttggcctccaaaagtgctgggattacaggtgcaagccatcaggcccagtcccttgaatactgttatgcaattgtcccccagtttccgccaggtattggttctaggatctattatgatactaaaatgtgagtatgctcatgtactgtagttgaccctgcagaacccatggaaatgaaaagtcagcccaccctatacacaggtttcacatcccatactgtattttccaaccatgtttcattgtggatgtggaaccctctgatagggagggctgactgtatttattgaaaaacaaaacaaaacaagggttgtgttagtagacccatgcagttcaaacccttgttgttcatgggtcaagtttctatctggatggaggctgtgttcttgggcagcttcaatggctatatgtttatgatggcagagtctcttttctacttcagtatttaaaatgtctgcctccctctcactgtaaacttcataaaggcagggcttatgtccctttttgttcatattatatctgttacttaaaactactatacctacatatatagtagggactccaagtgaatttattgaattaaacatgaaatgaacaaataaatgaatataagtatttaaattgatcatcaatttggattctgatctctgagaatctacagaatagaataaacagaatttcaaagaatacatcacagttcaaaaacataggaatagtatgttaaatggagcaaaaagtcaaaacaaagtaaaacaatggggtgagttgctaaatacattttaagaacaagatatgaggctggggatggtggctcacacctgtaatcccagcacttcgggaggccaaggcaggtggatcacgaggtcaagagattgagaccatcctggacaacatggtgaaaccccatctctactaaaaatataaaaattagcggggcgtggtggcaggtgcctgtagtcccagctactcaggaggctgatgcaggagaattgcttgaacccgggaggtggaggttgcaatgaatcgagattgcgccactgcatgccagcctagtgagaggacgagacgccatctcaaaaaaaaaaaaaaggttatgtatgttgcaggtcaaaataacataattggaaaatctctacctctgttcagcaagtggaaattgttaattaatttatattctccatccttaatttcaagaaagggcaacataactattcgcagattccagaactgtgtatgtaggacatttttttaaagtcattgataaaataccaaacttaatgagtgaatttagcagtacaactaaatagaaggaaatatacaaaaacatatcagagacaaacaattagactgacatttttaaaataccatttttaatataataaaatttcatatacctaggaatgaaggcactaagacatgaaaaagctgggtaaagctctactcaaaatattttaaagcattcttgagagaaaatacaaaagacctatgtaaacaaatgaatatgctgtctcccaaattaatctatggctttagaatagtcacaatcaaaatactggcaaatgtgcatgtgtaaattgacaagctgattttttaatttcctggaaatgcaaagagctaagtctaactcaaacaatcataaagaagaatatacagctgaaaaacaaccagatttcagacttattatacagctgccataatcaaaacaatggagaattaaaaacaagtatagaagagttaaccaatggaacataatgaagagttcagataaagactcacacatattcatgacaacagcaacgcttgatttatgacaacagcaacactgtagaacggtgaggataaaacatcttttccaattctggccctgaaaaattaatgtctttctctcattcaaaatacattcataccattccaatagctctaatagtcttagctaattctagtatcaagtcggaagtctaaagtcaagagtcctatttcgatatcatctaaatcagccatggatgagactcaaggtatcatttgtgcagaggcaaattgccctctgactgtgaacctctgaaatcaaaaatgatatctgcttctaaaatacaatggtcagacagacataggatagacattcccattccaatagggagaaacaggaaagaagaaaggggtaacaagtaagactgaaatctaacaaggcaaacaatattatgtcttatagctcaagaataatattctttggctcaatgtttaccctccagggactgagattgggttcctaaggcttcaagcagccttgctcccgtgacagttctgtgttgtggccctatcttcaaatcggctctgtgcctggagctctccaaagctgaaatcacatacccaacagtctactggtctggattctctggggtggtcctgctcccatggctccactggacactgacttagtggaaactcttcatggtggcttcacttccagggcagttttctttctgagttccacagctttctttacagggcatcctttgcaatctaaatgaaggcagccatgaccccataactttgctagacatagcccatgtcgttctaggacccaccaaagctacaccaggagtggctgagaagcacggaaacagagtgcaggcagcaagagctgagtttccataagtatccccagtcccttctttgaaattgttctcctccccaggctcttgtagcctggccttatgatgggaatggcagccccatgatctccaaattgcctttgacatcattcttccactttctcaattaatagcaccaggctgatccatattaatctctttatcaaagggtcacctgaccacacccttcctgttctctcctgtacacatcttcattttttataatatggacagttatacaattttctaaatccttaagttccacttccctttattaaaaattccatctttctatcatttctttcttttcctattttattataagcttcaagagaagcaaagtcacactttcaacaccttcaacactttgcttagaaatttctccatgcaaatatcctacatcattaaccagaacttctatctttcataaaacactaggacatgaacaatatgcagccaaggtatttgccactttataacaaggatcaccttttctctagtttctaataacatgttcctaatgtccatctgagacctcatcagaatcgcttttaccatccatatttctacatttttttaatgactaagtttttacctaagaagattgaggctttctctacatctcccctcttctctttctgaaccctcaccaagattgcccttaatgaatggatattcacagtaatgcaggctttttcagcatgtacctcaaaacccttccagcctctatttgttacctagttctgaagatgcttccacatgtttaggtattgttgcagtagcatccttacttcttggtaccagttttctgttttagtctattcaagctattatttcttacagatctggaggctgggaaatccaagatgaaggcactggcagattcagtaactggtgaggacccactttgtggttcagagatggtgccttcttgctgtgtacttatgtggtagaagggttgaatgagctcctgtgggcctattttataagggcactattcccattcatgagagttctgccctcaagacctaatcacctcccaaaaagtccaacctcctaatatcatcactatggagagaggatttcaatgtatgaattttgggggaacataaatttagaccacagcatgggacaagggaaaaagacaggattgaagtcatggtctttgtcattcccaggtcagaagttttcaaagaatttttaaattaaatattgttttaatcaacaaatcatgattatatatatatttatggggtacagcgtgatgttttataatatgtttactatgtgggataattaaatcaagccaattaacctatccatcacttctattatttatcatttttggagatgagacatttgaaatttactatgacttattttgaaatatacattgttattgcctgtagactccctgctgtgcaatagatcttaaaacttattctagtttatctgaaactttttaccttttagccagtgactattcactttccccctccgcccccacaatccaccaatcttattcacatttccccagttttgcttgtatttatttactgtgtgtttagttctatgcaagtttatcgcatgtgtcgatttgagcgtctaccattgcagtcaatatacagaacgggcccatcactacaagaattcctagcgttgctccttttatttatgtatttatttatttattttttgagagggagtctcgctttgtcgctcaggctggagtacagaggtgtgatctcagctcactgcagcctctgcttccgagttcaagtgattcccctgcctcagcttgctgagtagctgagtttacaggcgcctgccaccatgcctggctaatttttgtattttagtatagacagggtttcaccatgtttgtcaggctggtctcgaactcctgacctctaaacgatctgcccgcctcagcctcccaaagtgctgggattacaggcaggagccactgcgcctggctgtgttgctctttttaaagtacactgacttcccttcttcttcttcttactccctaatccctggcaatcatttacttatctgcctttcattttcaagattttcatttcaaaatgtcttataaaatgaaatgatacagtatataatcttttggggtttacattttttcgctcagctggagatctctccaagttattgcatatttcaatagtttataccattttattgctgagtaatattccatggtatgtatgtgattacagtttttgagaatgcatcttttaaaatgaggttggataccaagaattgactacaaattaccctaggataagagcttgccagttcaatgactttggtctgcaaccagacctctcagaatgcaatgatatacacaactgacccaataaaacatatatatatatatatatatatatatatatatatatatatatatatatatatatatatatatgtatatacacacacacacacacacgtacacacacacacacacacacacacacacttgtgagtgtcctcagcaagagttgctctttattttgtgttgcaactccagttgcaattgtcctgagttcctagaaagcccagttcttggactgagaagtagtcatgagaccgaagtcactgcagaaaattgaagcttatttcaatggctggataacagtaaaaggagagttctcatgtccaaatgtcagaacctcccaaatagtgctaatcacagttctcacttcactgaagattgaactttgttccaagagtgtttaagtgacttgcctaaggtaaaccagctgggattttttgtttagttttgttttgtttctgagccaatgctaaaaacagtcctctgaccacctcaataaatggcttagttttatattttgttttgcaagtggagtactggccttttaacatgatcaaaactgcataactaacttttgtgcacagtgcaatcccataacatgggggccttcccttaaaagaacacaaaaaggcctatttatccccgcaatgccacagctgactgtgccacctttgaaatttaactttgccttattttttggccttcttgatatctcctcccaggagttcccactgcactatgtgctccttggagccagagatgctggccacagtgcactaagtggagaaacctcagactttgaagtctgcaagtttcctagactaagaattatgaatattttgttttagttttatttatagatacagggatgcatgctatgtatatagtttttaatcataatccaatcatccatagtcatattaggagcagtaatttaaactgctgacctcagtgcaattgctgaaatttgcaaataaaattaaatacagcaatgaacatagtaatgttgcatctctttcctctgaggaaatgaataaatttctattccacatttaatgattacatctgaggcaggcacagtagaaaaaaagatagaaaatagctatgtgtcatgtaccatactaagcaacaaataatgtttttaaaggctaggtttagatgtgatttaagtcacattttcatacttcctataggacagcctttagcttcagggcaccatcttaactgtgttgctggctgggacattcagtcttgccaaggaaatagagaaataatcacatactgttgtttctgtctcacaatacttgcaatcagtcatgaaagtaaaagttctctatgtttcaataaattttcctttttacttgtcctaagtaactgcttcaagctgctagagtttctgagagtcttctctacaaatgcgaatcaataacccctcaaactaaaattcatgaaatcaattctttgaaatgaacacaatttttggaaaagataatttctacccaaactagttaagatgctttttgaatattaaatattctccacaggcagttgaatggttaagagtattgagccgactgacataaattgcagaatcatcatatacatggaggacaattgaaatcaataaagtagacatcatcttctactaaacagtatatagtatgaacagtggaaacctgggaaaccataatattaaattaattggtagagaaacaggaggcaatgaggtagatagagaagtggctagacaggtacaataataatcaaattatttcacaagaaagacaaaaaaagatatctaaagaatgagttaataacaatgtcaaatgtcatggagagactctactttaaaaatgtgaacaattatgtgtctattaggaagccactgctgaacttaggaaaagggtttcaatagaacgtgtgaaaagaagcgagaccagtcaattgagaaataaatggcagaaaaatgaatagaaatgttaaacaaagacaaattttctgaggaatttgaaaagggaagagggaaaatttactgttaggaagagataatagaataaagcaataaaaatttagtgtgtcttgctattgagaatagtatgtgttggcttcatttgtgtttggaccttggaaagatattggagagatatctatcagctgaagggatcccaggtgcagaaagaccctgacctaggcaaaagataaagaagaccacagtgtatagattagctattatgcatgggttagtacagtaattttttattcttatcatgcattagcatcacctggaggacttttaaaaagcatcctactgtagaccccattattaaccaataatatttttacaaaaagtaggaattttagggttggagatgaattataggtatttttaaatgttctctaggtgtttctgatggcagcctagtttgaaacagaggtagatagaacattggaaattttgagaaaaatcataccctaatcatcctcactttcataaatgaagtaatattaaagtttgcaaaaagcatcaagtggattgggaaatcaaggagagcgtgaaggttaaaaatgaaagtaggcacaaataaagacagagctttcataaaatataaagggctgagatgatgcctactttcgttacttaaaccatagtccttgcacccttccctgtacctacagaatcagaaactctggagatgaggtccagcaatggacgttttaacaagccttccaggtgaatctcatccttgctaacctttgagatacactgacctaggaaaattctgaatgcttaaataatggtcagattctaatcagcatctcagggaattcagaaagaggaggaatagatctgaccagtcccttgaagatctgtgagacatctcacactacattagctgactaggagaatatataattttgaggtgttctcctttttatttgataatgttttaaattaaatacaatataggtgctgaaaacttctaagtgaatagcttgatgaattttcacaaaatgagcacagctttgttgctaacacccaaatcaagaagagaacattagcctaatggtagaaatctcccaaatactccctctcagtccttgctatttccatcctgaagataaacacatttctacgttatagcataatagattatttttgcatgttttgaactttataaaatggaagctgaaagtatgtcctcttgagtctggcttctttcaatccgctattctttgtggcattcatccatatttttgcatgtaattatagtttattaattttcactgtttgacagtggtacgtgtcactaatttaactgtattatctctagtgaaactttgtgttattttgagatatggttattatgtctataatgtcttttgctacagatgtgagtaaatgtctaataatgtgctatgattaaaatgcttgtgtcccatcaaaattaatatgtttaaatcttatcttctgaggcaattgcttaggacagggggcccttttgtaggtgattaggtcctgaggacacagctctcataatgggattagtgcctagaaaatataggtccaaaggtgcttattctccccttcctctatgtgaggacacagcaagaaggcatcatctatgaatctgaaagtagtccttcaccagacactgtatctgcccacagcttgatcttggacttccctgtatccaggacagtgagaatgaaatttatgtggcttataaggtaccctgtttatggtatttcttatatcaggattaatacactaaaaaaacataatttatttctacagggaagctgatatgatttggctgtgtccccactccaatctcatcttgaattgtagttcccataatcaccacatgtcatgagaaggacctggtaggaggtaattgaatcataggggcagtttctccacgctattcttgtgatagtaagttctcacaagatcttatggttatataaggagtttatgccttcgctcgattctcattcttctcctttcttccgccatgtgaagaaggatgtgcttgcttttccttccagcatgattgtaagtatcctgaggcctcctcagcccttcttaactgtgagtaaattaaacctctttcctttgttaattactcagtctcagtatgtctttattagcagcatgagaacagacttatacagttaattggtacagggagcggggcacttactataaagatacctgaaaatgtgaaagcaactttggaactgggtaaatggcagatgctggaaccacttggagggctcagaagaagacaaaaaactgtagaaaagtttggaacttcttagagacttagagagggctcagaaaacaggaagatgttggaaagtttgaaacttcctagagagttgtgaatggctttgacaaaaatgctgatagtgatatgcacaatgaagtccaggctgaggtggtctcagatagagatggggaacttgttgggaactggagtaaaggtcactcttgctatgcaaaaagactgatggtattttgcccctgccttaaagatctgtggagatttgaacttgagagagatgatttaaggtatctggcagaagaaatttctaagtggcaaagcattcaagaggaaacacggcataaaagtttggaaaatttgcaacctgatggtgtgacagaaaagaaagacccattttctgaaaagagattcaagccagctgcagaaatctgcacaattaacaagaagccaaatgttgatcaccaaaaaatggcaaaaatgtctccatggcatgtcagatgtcttcacaacagcccttcccataacaagcctggagggctaataggaaaaaaatggttttgtgggctgggccccgggccttgctactttgtgcaagctcaagacttggtgccctgtgtcccagccatggctaaaatgggccaaggtacagcttgggccatggcttcagcaggtgtgagcaccaacccttggcagcttccatgtggtattgagcctgagggtacacagaagtcaagaattgaggtttgggaacctcagcctagatttcagagggtatatggcaacacctggatgtccaggcagaaatttgctgtggaagtggagccctcataaagaatctctgctagggcattgtggaagggaaatgttgggtttgagtcaccacacagagtactcactgtggcactgcctagtggagctgtgagaagagggctactatcctccagactccagaatggcagattcacggacagcttgcactgttcacctggaaaagccgaaggcactcaacaccagcctgtaaaggcagccaggagaggtgttgtacactacaaagccaagggtcagagctgcccaaggccatgggagcccacctcttgcatcagcatgacctagatgtgagacatgggatcaaaggagatcatcctggagctttaaaatttgactaccctgctggattttggatttccatggggcctgtaatccctttgttttggccaatttctcccacttggagcaggcgtatttgcccaatgcctatatccccattgtataatatctaggaagtaagtaacctgattttggttttgcaggctcataggtggaagggacttggttgtcacagattagaccttggaatcggactttttgggttactgctggaatgagttgtagcttcgtccccaagttcttcctatgattgattacatgatgtcattcaaatcagtaatgcttttcttgactaataaccatgtcagctaaaacaatcccccatcagtctcgattacaatatcccattatgtaatagatttttttaccgttgtctcatttgactttagaatataaatgccatcaactcttgactacattactaatacattagttacaactttatcttacatacctagaatgaggctgacttatggcatatatctaaagaatagcttatctgattaaatatgttttttgcttctcaatatgtccataaaatttattggacatttatttgagaggcagtaatgtgctgagcttaaaagtgactgctctagaatcagaaagacttggggacaaatctgacactaatagtgtgacctaaatcaatttacttaagcctattctggattggtgttatatttgtaaaattattactgactgggcatggtggctaacatctgtaatcccaaaactttgggaggctcaggcaggaagatcatttcagcccagtaggtcgaggttgcagtgatctaggattgtgccactgcactacagcttgggtaacagagccacaccctgtatctaatttttagaaatgtattattattttaatagtgcatttttattaactttaatgtttccagcagtctcagtttcaggttttctgacttctttatcagtatcctagaagttttatttttgtcagtaagaagattccagcaaggtgatggcacaattgacttgttactccctctggcaaaattgccgcagcaggggattgagaaggcactctcagtcgcatagatttcatttcgctcttgctatctctactagttaaatgacaggttcactgcttctgcttgtttctcattttctgctacaaaataagagtagtaagaagagaatagaaagtgagaacaaaaatgtagcaaacctttgtccataagaagccctgtgagaaaggcaaagtatgagagcacttttagtataatttgaagagttctacagagctgggttgcttaaaaataggctacctctcactctgctcctgaattctatattttaaataacagttggactttgaacctatttttccccaatgaaattcaggagaaagcagatttttaataaaacgttatatagactagacaatttggtaaataatggctaatatgtattgtgtaaacaaaggcactattctgagcctttaaaatagatcatcaaatttaattctaacaatagctctaagagactaagaaaacaaaatgaaacaattacttttcctattttataggagagaaaattgagtcacaaaaagttagtaatttgcccaagttcatgtagttaaaaagtggtggagacaagtttcaaaaaaagccatctaagagaatagccttaatcggtgaacacactgcagtttgagatgttaaaaacatagaaagaaagtgaagaaagttaagaatggaaaaagatgcccaaaggaggaaaagaaaccaaagacataaaaacaagcattgtcctttttactttttctagaaagtccttcctgactaggctgaagaatacatgacaacaataaacaatgttcgcagcaaatttctatctaaatttatcttctatatttgaatttgaataggaaaaatagttaaattcctaaaaataggaaaaaatagttaaatacatattgcaacatttcttactgggtaaataatgggaatgcaaaacacacattaaatttttgattggtgttcttaataaattgtaataacagaattattggtttatgcatatagaacaatcattataacatttctattgcatttttgtattattgtcctggatttttctctaaagtatggatttaaagagagtctgttcaaatttatttatttaataatccaagctcaatattcatactcattacacaaataaaaaaaattttcctaatcgtttttaaatttacaatttggaaggcatcagcctaaaaatacaatgtaaaatgtatgtatatatgttcaaacacatatatacacatactccaaaaaagtctaagaaatgaggttataatgaattcatctacaatctgcttcaagtatcaggactttttaaatgttttcaatgagattatgcaatatgacatacagaaagctcctgtgaaattttatgattgtactatagttgacaaaacttatattgaaatattttcatttcattaacaactgtaatcctcccatttgcatcaatatattcattgttttctaaagttaaatgaattaaataaatattgtccttcaatgatagatttatatgcatgttttattatttattctaagcttagtgtctgtatttttgcatacttaaatacatacataaatattttaaaattcaaagtcgtgaacaaagaaaataaaaattctaatatctttaataaatgatttatgctacaaataaaagtaagcagcgttttatgtatttagtagataatttcagcaccaatcttgtgcaaggtgttattgtaagaagatatgtgtcaggttctactacaacaaaacttactatagccaaaatgcatttatccaaaattatagctaatcagtatcccagctgtagattttgagctgtgtattcttcctctgaaatcttgccactgagtacatatctgggtcacctttgcaggatgtcagttgccatgtggttagggaatacaaactaattttatggagtccaaagccaaatgtaaatgagttctggatattcagcctttttggataatatttatcttaaatgataaataaaattttgactgtatagtaatataagaggtggacatgggtgttagacacccacatttacacgcagggcctcagaaacaacaatgcttacgtttttctaaatggttaattttagcatccatccaaatgtcagttagcctgtcagtgaagtgaagctgcactttcagtgatgtccgtgggctcttttatacagtgctaacatttgcataaaaccagcttttttgtgccttatgtttccaaatcaatttagttttgtgtgctaatattttattagagccctggagataaagaagcatgcaggtcagccatgtgtgctgctcaatccccaaaggaaacctctactaaaaaccaaaagattgacaccagacaagattaacaaaagaattagtcatgcacaatcaactgtgttaaatactggtggggggagggggaagcatcttcttctcttgtctttcagggtggcgtgctaatgcttccagtgtatattattatgtgcttctgagtgtaccattgttttctacaaaggtggatttgttagaaacaactatcaccattactttaaatgctactaatgaggtgatcacgtaaaatcttcaatcctctgtgctatttaatcctagacctacaccaagggagcttctccctaaggaataaaacagtttggtctctttctcagtctggggctgaataggcttgagctctaacctcaaaatactacataatggctgaaaatttccaaactgagcaatcaatgaacaaaaatattcaagaagtaaatcctttccctaaagggcttattatctaaaattgttggttaaaacatagaaaaaatattctatcacacagttagacagcattcacgttccacttctgaaaaaaaatggggatttgtttacagttctttatatattgtttaatgttctaaattttaagatctcaaaagaattataactaaagtatgaatactttaaaataaatatttcttcaaatacctcttataccatttaatatttaaaatctgaatctggattatttgaggggataattttgttgttactattaaaaaattaaccagagaatagaaaagaacgtgatgtataaaaaggtacccctttacgtagttttgatattttgtgttcagtacgacttttttccttcttaggtccacatcaagaaaatacatcatttcaaatgaagtacctattataccaattgtgtggtttcttcttgagacaataccttcatttctactcaaagtctacaggaacatagctaattgtcacatacattggatttagtagtttcactgattgagcatatatgctatgcaaactgttggatattttacttttattgtttatttaagtcttattcataagtctatattacatttgggaaaattagctcagagttgttaataaacgtgccccaattacactatgaaaaagtagaagcatccatgtttagataaatagtgtgaacaatgtgtgttaggcaggataatgtctctgccaacagatattttccctgggaacctatgaatatgttactttagatgacagatgataattattaacattgaagatacatttaagtttgctaatcagttgatgcaattaaaatccaattaaggctactgatgaaattatgagatcacccaggaatatttcagcaggcccaatctaatcacatgaatccttaaattgggggaagaagagggagaagaaggaatcagagagagagagatgtgctttttcaggttttcaagatagaaaaggaccaggagccaaggaattgaggcagcctccagatgctggaaaagccaaggcaatggtcagattccagaaaggaatgcagctctgataacaccttgcttttaggctagtgagacctgtggcaggcctatgacctacaaaattgtaagataagtttttgttgttttaagacactgtatttgtggtaatttgttacagcagcaatacaaaattaatacaaacatttgtaacatgatttcctactttcttaattattttgaaatattgtcaggcaggaggaagctaggaaataaggcaaaaaaaaaaaaggtctggcatgtcctttaaacgtcattggcccacccatgggcttacacaattaacttagctgaccaacattttactattagtaaataatgaagacttagtgaagtcacatgttagcttttagatttcactccaagaaatgccagttaactattgtatgattgaaaatataattccaaggtatggttagtggcctctgtaggtaataaccagtttcatatctaatccagcaaccttgtcctgtgattgcctctaaatgcctagcttctcaaatgctcttggaatggtattaacatgttactggttccctcattaattaataagccaaaatatatttgacaagtgttcattttatattggcatgatagtcatgatttcgtccttttgaaaattatgctttatcaatatcaactaaatgaggagtcagcaaactatggcttctgggccaaatctggtctattgcctattcttgcaaataaagttcctttgaactcagccaggtgaagtagatccaaatgcttcacacaggcatattctttcttaagttatttatgtaatttcacatgcattcttattagtagaaaactaagttggtcactaaaattgttaataaatttcctcagttttaggcataggatcaaaactcgtttctaactttcacttttcttgctctcctgaatatccacctgtaaaccagtggttctagtcctgagcatcaggaataaagagagagcactgtgttgctgaatcctttgcaatggaatgctctgtgtggctgaggtatccttttttgtgggtagagagtgcattattcataagcatacatttactatcttagtggatgtagatcccatctggcttatcttgaattcagatctgtctcttgagctctggatccattccaccaactatatataaaatatctgtctctgtttaaatgtgttaaggacatcttactctcaaaaaatctactaatctactactaattttaccctgcccccatcctaatttaattccatactgggcaatcacctttttgtatctaccaaagcccccaaaaactcattatccaagagaaatatttgggaactggcctacattttctcatatcctttctttgcatctgtaccaaatacgtggtggttcattctttcctccccattcatatagtagctagttgtttatattaatgtcataggaatgaaaagagcaaatggaggcaaaaagaataatagaaacagtaaagcaagagtggggtaaggataaggatggtgtacaaaatgcatactgcaaggtccttcatggtttgctaaatgaggttcacattttaagaattatctcagaggaataaacatgatcagtttacattacttatagactccataagacacataggcacaactatttttcggcatcaaaataatttttttctcacattatttaacgagacatcattgtataataataaagacattatataggaaaagtttgatgggactctttctcattatatttcttaaataaaccttgtgggaaaaaagaaaaaaaaccctatgggattcatttttatcatgaatttttatcataattcataattatctgccaagaatttcttatttctccataaaggctattttatttttggtgatatgttggataaatgaagaatgactaaggatcagaagtcacagtccttgaaaataagtgaattgcaaatatattatattaatagtcatcagtgatcagtatggctgatcacatgttgtggtagttgaaaagcttaataaggacacttgcctaaaaagagactttgttgtgtaaagaatctgtcatatttgccatcttttatctttgcacctctatactcctgcattattgctcttatctcacctatgaaaataacagaagtttctgttagatatgttttcctattcagtctattctataagtatacccagagtcatatttctaaaatgaatatttaatcataccagtctttaaaattctcaatggtttctagtccctgcaggtccacggataaatatgacacccaaagctctacaaacatactggaaggtgtctctttctaaacatagcatgctgttccatgtctgtgtcttaagttttgagtctttgttctctttctgctagataaagttctcattattcttcaggatataactcagaaatctattcctgcataaggagtaagcacataacttagtctttgaacaaggaatttttttgagagtgaaagggtgtacacaatgattacacaagggctccaagtagaagtggactgggcccactggtttgcatgatcctcctgtttatgccacatctgtgtatctatatttactatcacatgtgtcacatatgtctgtacacaatcctagctacacatttcttgagaatattcccttctacagttcaggtaaggatttggggctggagattaaaaaattgaggattatcagcatagagatggaatttaaagttatgaagctttgttacagtacatgggaaatgagtgttgatatagaagaactcaggagaggataggagggagacaagacagggagtgagagaaaaggaataaagaggagaagggatcaagaatcttagatatcataaaactgagagttcagaaagatgagaaataaatacagtagtaaagaagagtgggaaggactggccagtaaagtgaaattaaaccaggggagtaaggtgtttctgaaactaaataaagaaagtgtttaaagacaaagactgagcattggatattggatttggcaacttgaaaatcattggtggcttttagtcattgatgagttttggaggactggatagggggaagtctgatgagaaggagaggaaaaggagttatggaacaaagaaacttctttgaacactttattaaagaataacactaaagttagaaatgggagtggagtgagatagatcaaaggagattgctcagtaattattttttaaaaagacatgtaataggataggtatgcatgaaaaataatgttatgatccaatcaagaagaaaaacttaaagatgcaataaattatcattgtactgatgttacagtataattatctccattttaatactaacgcacttgagaggagaaggcataggaagtgtataactcttcgaattgactaaactttttcacacttatttcatttcatcctcaaaacaactctatgaaatctagtgatgttaaataactagcatagatgagaaacaataaagctaggctccaaacccaggcagtccagctctataatctcacactacaaggccagaatgagagaaagaaaaagaagcacagaaggaaaaactacagactttttcctgtggccttttaatgtccaaggggagacaaactggaaaaatacttgaaaattcatgggcacatacatatatcaaaaaatatatatatgtgaaaattatattgatgtatatagttgaaaatatataaaggatatctatatttaaacaaataatatagtaattgcaaataaatattataaagttgatgttaaaagaatagacaacaagtaccaatctggatgacattaataaaggcaattttgatgacattaataaatgcaattttgatgagagaatacaatttgagacagattgtccaggaaatagtatcgtagattggccaaaggataaaataggaggaaaagcagaaggaggaggaaggggaaggaaaactgggtgggctataccactccttttttatgttgtttatattgttattgactgttcaattttctacaattaatttaaaaaacagcagaggattctgtttaccctgcaagcctcggttatttccaccccttccctccacacctctccctccctgcaattaacacaggaagctctctcctaccatcagcctaagtcaatcccatcttttcccctctcctcctagataattccttcccctcttgtttttttcattaactacataacccttaacttttgcttccagcataatcttactcattcccttaagaatcattttctcactttcccacaccaggtgacaatttctacttaggtgtttacatagcaccacaacaccactttatactaatatataaatttatatattatacaaatgaactctttgagggcagagctgtgccttatcttacaattctcctttgactggcagagtgccttgctcccaagaggtgtctagttaacatttgttgaaaggagattgcgaatgaagaataattcacacactagaaattggagttccaaaatcatatattcacaatcacctgtcatgtccacttggatctgtcacaagcatttcaaacttggtatcaacaaaataaggtcataattttcttccacattcacctccttttattatgcattccttcatttaatcagccatccttgcatgtaacatttattgagtgctgactgtgtaccaggctgtatttcaagcccttgggaccaccagcaccaataactaccctgttgctccaagaaaaaccctctgtctcctactttccctcaccccattccccaatacctaagtcaccagcaagtcctactcattctatcctcaataaatcctgaatatgccaacttctccacatcaccaggtttactcctttcacctaggctttcatcatatttaattactgatcatcctaatgtgtctcctcacaaaaattctaatctcctttaatccataccctgtagagcagaaaaataaaaattctaagcatataattaaaacatgttactcccctcctataatgcttcaaaaatgttgactacatttggatcaacatcttaattatttcctgtaagtaccaagggccttcatgatgtggtcctccaatattgcctcacttattttgctagcaactgcaacccaaacactgtactcttctttcatttagtcaaacacttcaacccaggtcaaactttaagtcattgcctgtgacttttcctctacgtagaatattccttactacactcttcattgggaaagttctctattatcttttagagttcagtttaaacatcacccactaagagaggtattttcttactacctcgtctgaaataaatctacattattcttcatttcagatctttgtttctttcatgacccatacaacaatttgcaatttttgtaattatgtgttgtttttctgttctgccccatgaaggtgggaactaagcagattgagtactttggtaaatttttgttcttaacaaagtgctaaagaagcttaataacatgtttttgaatgagtgaatgaattaatgaaaagaggaaggaaaagaggtagaaaggaaggtaggaaggcaaaaaaatacacatttatagttttctgcttacctattaaaaatccataaaatttttttttatttttctatgagcaaaattttatgaccatctcattgtataccagattgtatactgaaaaaatagagatagaaaataaaatttgaatgtagaactttattatgcaatgcttatgtcaaaacaaaatttttaacatactgtattacactatgtagaatttattaaaattatacagagaaggaagacctagatgcattgatacaaatcatacatatatttaaaatatatttccaaacacaaaaaagaagttaatatgtttaaaaactgcaaaataaatagttaatatgtactcagacagaggcttccttatttaaattccaaacatatttgagtatataaaccagttccaataactgcttataatttcaggaccaatttcaaaatactgctctcattgtctgttttcttactttcaaattaatacatagctacatattgaatgcttacaagtagtgtgtggtgctaagcgaatacagtttttgaggcatcgagaaaaagtcaactaaatggcatacatttatatgtcaaattgggtagtatgatactttatcaaattgcaaaatgcatttctgctcaaatactcagtttactgaaacatttaaagaaatttgagaaagttagtgatctgttactagactctcttccatttggaagtaatcagtagaggttttatattttctcagcaatggtaaaggcacgtatgaactgttgcatacagaaacaatgttaaaatgcataatgaagattggattttcatatacacagagttcaattttacacatattttatgtttcccttttcatattgtgagcatagcttaggcaacagaaattcagtgactgcagctcaataggcttgacttatttcttcttgggggatattcccaccatttgaaggcaaaagtacttctcttagaggcactagggtgggattcagggagtataatacgtagagatgatagcttagagatttagggaaacatgctctatattccttcagagatccaatgataagatgtagagccagccaaagaatttaaggccaggccactcaggctttcctacggaacagtattagtatggaaaaggaaatttagttcaccttattaacatgggcaaccagatggaaatttgtcatgcaattctcatttactcagcaaatatttattgatagcctgttaaaaccaagcactgtgttaggctttaaggatagaaagataaatgatactctcaaaaacttcatgttcagttgaaagttataaattgcatgtaaaatcacaggacactgtgagaatcatggagagagccagctatcccaaggaggattcatagagaagtatacacacacgtgtaatattaaagcatgattataaaattagccaattcaaataagggaggggagagtggaggatgatgctgaagaggtatctcaggtgattctgaccacataatgaaacctggaatctggtaccaggccataaatttgtttttacaaagataggaagaaggatacagccagtaattttataataattttatgtttttattttacttatatatgctaattttatgatactctgaaaatctaacttatttacatatatatataatagcaataaggatataatgaataatactatcatattattatcaatttattaaaatatgatcaaaataatagcagcttacatttattaagctctttgtgataggcactgtcacactaagcacagtaatgtgcttagtacgcattataaatgtattcttaaaaaagaagtgaatttaggtaaatttgcacataatagtgacagatcagagaaaaataaagctaggaaaaagtagttaaggcttcacatgatcaataggactttgtcaaatagaaggatagagagtgatatggtttgtatttgtgtccccatccaaatgtcatgtcgaattgagggaggcacctggtgggaggtgattggatcatggggaggaatttcctccttgctgttctcatgacggtaagtgagtcatcaccagatctgatgatttaaaagtctgtggcacttacctcctctgtctcttcctcctgctctatcacagtaagacgtgcttgcttccccttcaccttctgccatgatagtgggtttcctgagccctcccagtcatgcttcctattaagcctgtggtactgtgagtcaattaaacctttttcttcataaattatccagtctcaggtagttccttagagcagtgaaaagatagactaatacagaaaatttgtacttggagtggcacactgctataaaggtacatgaaaaagtggaagtgactttggaactgggtaatgaacagacattagaacagtttggagggctcagaagaagacaggaagatgtggggaagtttggaacttcctatagacttgttaaatggctttgaccgaaatgctgatagtgatatggacaacgaagtccaggctgaggtggtctcagatggagatgttaaactttttgggaactggagcaaggccgctcttgctatgctttagcaaagagacaggcagcatattgcctctgccctagaaatctgtggaactttgaatttgagagagatgttttagggtatctggaagaagaaatttctaaggagcaaagtgttcaagaagtaacatggctgtttctaaaagtgtatgctcatacacatgatgaaagagatggtctgaaatttgaagttatatttaaaagggaagcagaacataaaaatttggaaaatttgccaactgaccatgtggtagaataaaaaaatcatttccctggggagtaagtcaagcctgcttcagaaatttgaatgaataacaaggagtcaaatgttaacagtcaacacaagggggaaaatatccccagggcatttcagagatctcccctcccatcacagaccaagaagccaaggaggaaaaaatggctgtttgagcaaggcccgggaaacccttgctctgtgcagcctcaggacatggtgtcatgtgtctgagccactccacctctagtcatggctaaaaggggccaatatgcagcttgaattgttgcttcagagggtggaagccccaagccttggcagcttccacgtggtactgggcctgcaggtgtatggaaggcaagagttgaggtttgggaacctctgcccagatttcacaggatgtatggaaacacctgtatgtccaagcagaagtctgctgcaggggcagagacctcatggagaacctccgctaggaaagtgcagaagggaaatgtggggttggagacaccacagagtccccactggggcactgcctagtggagctgtgagaaaagggacactgtcttccacaccctaaaactgtagatccaccaacagcaccgtgcacctggaaaagccagaaacactcaatgccagcccatgaaagcagtcgtgggggctgtaccctgaagagccacaggggcagaactgcccaaggatttgggagccaaccccttgcatctaggcaagttctcactattttgctcaggctggtctcaaattcctggcctcaagcaattctcccaccttgcctcagcatgccctggatatgagacatggagtcaaaggagatcattttggagccttaagatttaatgagtgccctgctgggtttcagacttgcatggggcctatagcccctttgttttggccaatttttcctttttgtagcagaggcatttacccaatgcctgtacctccattttatcttggaagtaacaaacttgcttttgattttacaagcacataagtggaaggtaattaccttgcctcagatgacactttggacttggtcttttgggttaatgctgaaatgagttaagactttggtcagggggtactgttgagaatgaataattgtattttgctatgtgaaaaagaaatgagattcgggagggaccagggttggaattatatggtttgaatttgtgtccctgcccaagtctcatgttaattgagggaggggcctggtgggagatgattggatcatgggtacaggtttcccccttgctgttgtcataataagtgagtcgtcaggagatctgatgatttaaaagtgtgtggcacttctcccttctctctcttcctcctgctccaccacgctaagatgtacctgcttcctctttgcctctgccatgattgtaagtttcctgaggcttcccagtcatgcttctttttaagcctgtggaactgttagccaattaaatctattttcttcataaattactcatccttagctagttctttatagtagtgtgaaagcgaactaatacagaagctttcccaaagaataaaaatacaagaattcacaagaatatgcaagacacattttggaaacaggaaatgcccaatgagactgtgcattgggaatagggaagggggcttacatgtaatcaggttgaaaaagcacactgagtctaaattattacgctatatgcctttgttatgaactgcaaaatgtatcctgtgacctcagggtttttacttttttaaccaagtgagtaataggatttcttacaaagaaaacatgaagatcattctgaaatttctagcttaagtcattatcaggatgatggataaagttttcacagtacattcttgaaataaaaagaaaaccaaaatcagaagcaacaaaagcaaaaatagacaaatagaaccatgtcaaaattaaaaatgtttgtgaatcaaaagggacaatcaacagagtaaaaggcaatctgaaaaaatttaaagaattctaaattatatcttacaagaaattgataacaagagtttttaaaaacttctaaaattcaacaacaaaagataagttaaacttcactaaaaatggatgaaggaattgttagatatttctccaaaggttatatacaaatagccaactaacaaatgaaaaaatgctcaacatcactaatcatcagaacaatacaaatgaaaaccacaaagagatatcacctcacaccgttaggattgctactgtaaaaacaataacaaacaacatcaaagcaaaaaataacaagtgttggcaaaaatgtggaataaatcagaaccctgtgccagtcggtgagattgtaaaatgatgcaacttatgtggaaaatagaatggaggttccttggaaaaattaaaaatagaactaccatatgatccagcaatcccacttgtgggtttatctccaaaagaattgaaagcagagtgtaaagtgatatttgcacatccatgttcataacagcactattcacactagccaagatatggaaatgactcaagtgtccatggatgaataagtggataaacaaaaagtgacatatatatatagaatggaatattattgtcttaaaaggaagaaaaccttatctcacattataaagtgaaataaatccgttatcaaaataaatattgtatgattctccttacatgaactatctgaaatagtcaaattaacagaaacagaaagtagaatggtgattaccaggggttatgcagagggggtaaagaggagttgtttaacaggtatagagtttcagatttgcactatgaaatggttctaaagatctgattcataacaatgtgaatgtacttaagagtgctgaaatgtatacttgaaaatgattaagatggtaaattttatattatatgttttgttaccacaatttgaacaaaatgtcaaggaggtcaaagtgaacaatattagcatttacagattgcaaactgtagtgattagaaggattaataaattcatatgtgatcaaataccaaaatacttttcttgctctgggttaaattgtaaaataggcaaagtctttccagcattttgtcactttcctatattacctccttctactactcctttctgtataaactcaactcttagaaggaatgcttcatgtaggcttgaggcttttattttgatttaaaaggctatgtaccttatttagtgctctatgatgacccaatgttctatatgtattagacatattttagttttaagagcatgatttcagatgagatcaatgctcatctcattgcatcacacagtattcacaatcttaaactggaaacacacagtcgaaggatttggtttagaaaagcctgtaagaacacagtcactcatttataagatatgaactatagatgacaactgtaatctttttaaaggaatcctgtgtgtttagctatgcacatacctatatttatatatgtgcatacacacatatgaaatatttataattttgtaatataacctaagtaaaccaggtaggggttttcaacagcctttatatttacatatgtatatactccaggttggatgtggtcttagtctgctttatgttactataacagaatacctgaggttaggtaattaattttaaaaaggggtttatttaactcatgattctggtagctggaaagtccaagagtaaggtggtggcatctgttcagcttccactgaaggccccgtgctgcattaagatatggcagagaagcaaaaaggtgagcaaatgtgagcaaatgaggatcaaacatgaggaggaatctcaccttgtaacaactcactccctaagaagctaatcaattacaatgagatctaatccagtctcatgagaaaaatattaagccatcttaatgatttaatcacctcttaaaggcacaacctcccaacattgctgtactaggaatgaaagtgctaacttgagtttaggtaagaacattgaaaccagagcagactgttttgaaaagcaagtgttggcattgtatacctgacacatattaggctgtagattataatttccacactaacttgttatatgtacacacaaatgaaatataaatatcatttataaattgctgataaattaggaataataaaataaataaaaattatttcagtttagatgcacacaataaaaataaatacagacaatttaaataatgtgtcagctcaattgcaaatccagtcctttgactccagttgttcctttagcctaaataattttcttgattattcatataaattaatatatattgtgctcctacatatgagttgactgcatgacaaaaatggctttttgaaactcaaaagaatatttgagtagactatagttctaaccaccatataatttacctgagtttaagaagaattagatgctaccttccagtgagagtatgtgtgtttcttatcactatatatttaaaatatgtattatttaaatattaaaaatttcccaatgcttagacaaaaataaagtcccaagagcaattcattgaaaatttatttatatatttttcagccaaatcttcgttttcttagaagaatccaattacttggatcctttcaaattaggaactcttagagaatcatttgaggagactggaccttttccccacaggtcactattggactgacctctgtggaaacaagtgttaagaaatttgaattaagccttaaaatacgggtaacttcaaaatattaaaaaatacgtattttaagtctaatttaactaaaatctccgagtttctctgattattgttgcattaattcattcatctaacagtatttttagtgtcaaaaatatatcaggcactgttagatattgagaatgcaaacaggcacaatatagaaattgagaaacttaagacatagtatgggagaaagacatttgaccatattacgtatcatataagcactgtgagaacaaattaagtatgagttcagttggaaaacaaggaatggtcaagtgtttctggtagtgggaagcagtgcttgtgacagaaaatactgagatgctaaaaagttttctgagccatcgcagacaagtaagtatttgataccaagcactttatccactatggtaaccactagccatatgtgcctattgagcatttgaactgtggctagtatgactaatgaagagaatttttagctactattaatacatacttaaatttgaacagctaactttggctaatggctaccatattaggcagtagaactatacagaactgtgagtaattttttatggttaggatatatattgtatggtttaaaggtcatggtgttagatgaagaggtagacaaaggcaaaatcttagagtgcctttcttgtcatgtttaagtcacagaaactaagtaggatgaaaacaaaaaagaacattctagatttattaaatgatcacggcgacataggcaaagctagtttgtcatggaggattagacgcagaaaccaggatttagtagattaaagaggtgaatggaaagtgaggaagggaaatcagcaagcatttactattttcaggtatgtcagcataaagagaaagagaaataaaggaagatgggtttgaggaaacaagtgtaaggagggattttaagactggggatactggagaatgttcatagatagtgggggaagtcagaaaaataggtaattttatagaatataatattaggttggattctagcagatttagtgaaaaaacaacacccataagtcaagcagacagcctataaatggaagaagaaatattctctggataaaacagagagtaaatttacacagaaataaatttgtgtatagatattgagaaagtttagtaggtttcctctgtgataaagaaaacaaatattaagatatacctaagcaagactggatgagactgagagtacaattctggagggagtaataaagattcagataaagttgccaagaataatgaaggtagaaatcagacagcaatgtttagagtccaagtgtatcaagttctcagttgtaatatcaacagatacttgtagtctcaacacaatacaacgttgttaactaagtttaagagtttaaaaaatttaaatgatggcggttttacctggtattgtctagaaatagagttagtctataattgatatattaggattacttaatatcctgttttatcacttaataaagactatgttattgaatttatatgtttataaaaagagtttattaattcagaatctacatgtattttaatttgtcttgtttagtttattcccaatgcaattgtgctagctcatttgtgctgctctatcaaaatatttgagactgagtaatttataaaaatagaaatttatttcccatagttttggagtctcagaaatccagtatctgggcaccagcacatttattttctgacaagggtctgttctctgcttccaaagatggcaccttgttactgcattctctatacaggagaaacatgtgtcttcacatgacagaaggcagaagggcacaccagaccatttccctctattaagccattttatatgataacctaattctaatcataggagcagaaccatcatgactcaattacctctcaaagaccacacctcccaatattgttcaacataaattttgaaggggacaagaacattcaaaccaaagcagtaactgacccttcatattccattcacataacactcagtttcttattggaattacatccaaaccctatagaatgacacaatgagtcccaagatagatctcaacttcttctccttagcactcttcaatgtgaataatataaatacttttccctcataacaaacttacttaacatttctgaagatatattgcaatgttctgccctatcaaatatgctcctgctctttttttccctaatgtaattccaaattgtctttttctttggcaaaatcatacttatttgattctacctaaaaccacacttttcaaaacactcaaaggacactcaatttaccgtaattattattcaaagtgttttcctaaacctgtggtatttatagactgtcttgaagtatgtcatccataattgtggacatgtatagttttagtgatgtataggctatttgagggtcagtgtcactagttgtaactaaaaaaattgaatttttaaaactactgaaaatggaacaaaataaaaatacagattaattgtccttagcttataaatgctggcaaattcacatatttattcctttgctagtaattttgctgccattttaaattgtagttctcatcaaataagtcaataggtttcagtaatatctagaggttaattccaatgctaaagataaattcattatacatcttaataatgaagatgatttgaagtaagctttcttaataaaacttcaatgcttttatatttactgcaaatacaattataagctataataataggcattggataaaagacctgaaagaatattgcaaattcataaggggttgtgttatcgtgatgggatttcagatacaggcaaaagaagacattttactgtgagagacagctatatttgaatttcagctgtgtgatcaagtagaaattatttagggtctctgaatttcaattccctgttaaagtcgttctcagaactaaacgtgttagtgtgtgtgtgtgtgtgtgtgtgtgtgtctgtatatgtcacatactacatatatctgaatatatgtatatatatatgtcacataatactaaaggaaatttaattattatataatgtttagtattgtattatgtttacaaatacttttatttacatttgaaatatcattaaacagagaaaaaggaaaagacctaagatttttgagaaatcctttaaaaatatccaatggatgggcttaacagaagagtgaacaaaagaaggaatgagtgagttggaaaacaaacaaaaaaaatcacacaatctgaacagagaaataactagactgaaatacaacataaaaaagacttgtcagcagtaaacctaccctaaatgaatggctaaggtctctaaatagcaaataataaaagtaaaataacaaaatttgaaatattagaaggaaaaaataaaagagtaagcaaaaatattaataaatataagagatttttcttcttaccttgaattttttaaattatggttgatggccagagtaaaaattgtaacactggttgtaaatatatgtacagaagaaatttatgatttactgtaaatgcaggggtataaagggatataaggagaggtaaagtttttgcaattcagctgaactgctaaaatgacggcaccattttacatgtatttatatataatatatgtttttatatatgtaaatgcacatagccgtgataaattatgtaaatataatgcaatacctagagcaaccactaataaaactgtaagaaatacactaaaaatgcagtatataaatttaaacagcattccacaaatatgctcaaataaacacatgaaaacagagaaaagaaaatgaaaaacaaaaagagaaagcagacttacgtcctaacatcaaaattacattaaatataaaagctctaaatacaccaaacaatataaagagattggcaaagttgattggaaagcaggactcaaccatttgctacctataagaatcccacttcaaatataacaatatagccatattaacagcaaaataatagaaaaagcagtatcatggaaatatttatcaatggaaaacaagagtggctatattactatcagataaaatacaggtagtctcagatttacaatggcttgacttatagtcttttgggtttattatggtgcaaatgcaatatgcaagcacaaggtttcagacttcaagcatcagtgattccttgaccaaagaccctctgagctgtatttttgacttacaagattttcaacttactacgtgttatcatagtcaaggagcatctttagatttgacagccaagaaaattaccagacgcagaaacggacattatatataatgatatagggaaaatccaccaagaaaacatagtaatcttaaatgtgtatgcaccaaaaaacaatgctgcaaatttttttgtgtgtaaagcaaaaactgattgaactggtaagaaaaatttttaaaaaacacaattatcgttgggagttttaacagtactttctcaacaactgatagagcaactagatggaaaatcaataagaatatggaacaactcagtaacactaccaattaacaggatctaacttgcattcatagaagactccagcctacaagagcagactacacattcttttcaagtaaccaggaaacatatgccaaggtagatcatattctaggcaatacaacaaaacacaactaacttaaaatatttaacattatatagaatttatctgtaactacaaaataatcaaaccggatatctataactcagagataaaagaaaaatcttcaaaaatgtggacactaaacatcacatttctaaataaactgtgaatcaaagagaaagcctcaagggatgttttaaaaacacattaaactaaatgaaaatgtaaaaacaatctaagaaaatatgttgggcaaacaaaagcactagagagaaaaacttacagtaccaaacatatgttataaaagaggaaagtctcaaatcattgattaaattcacacctcaacaacctaaagaagagcaaacaacctcaaagtaagcagaagtaagtaaataataaagaatacatgccaatgaaattaaaaacagaaaatcaataaaacagaaggatttttaaaaaatcaatagcattgaccaaaaaagacaaattattgacataaggaatggaagatgaaatatcactaaagaccctgaagatagaaaaaagtagaaaatactatgaatttacaatcataaatttgataacatagatgaaactcaccagatcctcaaaaagcacaaattaccaactgtaaaatatgaaattgtgctatagtaattaaggaaataaaaagtataattttaaaaaaagtccagaaaaagacttcttcaagtttaataagtacaaatgcttttgctgaggaattctaccaaacgcagaaaaacaacaccaattatacataatatcttccaaaaaaacagaacaggagagatttcatgactgattttattaagatagtatcttttgatatcaaactagaaaaaaactatgccaaaaaagaagaaaaaaactactaatcagtatgtcaatatccctcatgcatacagatacaaaaattctttaaaaatattagcacataaactcagtaacatatttttcaaatatgataaactaactggagcacattctaggcatacaaagctggttaaatatttgaatgtcaatcattataattcaccatatttacagactaaatgataaaaattttatacctataataatatcagttaatgcaaggaaaacacttgactaaattcaacattcatgatttaaaaaaactcagaaaaaaagaatagcagtgaactttctcaacataacaaagaacattaacaaataacctatagataaatttgtacttagtgctgaaaattttctataacatcaggaacaaggcaaaaatgcccaccctctccagtcattaaaaacagttgtagctagtacagtaatacgataaacacaaaggattaaaaataacatttgcagatgttatgtttctcttcatagaaattcctaaggaatctacaacaaaactcctagtacttcagcagggtctcagaatataaaatataaataaagaaatcaagtatatttctgtatatgagcaaaaacatgcagatatttaaatttaaaaatacactaccatttgaaatcatacaaataggttgaaatacttaggtgtgaacctaacaaaactagtacaggaactgtatcccccaaaattataaaatgctaatggaagaaatcataaataactaagtaaatggagaggctgtattcatggattggacgactcaacacaataaagatgtcaattttttctaaattgatttatatgtttactgtgatatctatagaaaatatcaacatgtttttattatagacatagacaaacttaatctaaaatttatatgaaaagacacagggactacaatagctaaaattattttgaaaaagtagaattaaatggatgaattgttctactcaatttcaagtcatgtgatatagctatagtaatcacaattgtgtggtattgtcagaggtacagacacacagatcaatagaacagagtagggaatccatcaacagacctacacaaatatgccaagtgatttttcaacaaagctataaaagcagttcaatgaaagaaagataaccatttcaacaaatggtgctagagcaactggaaatccagagtcaaaaaacaaaacaacctggaaagggcagtagcagggagaggagctggggaagtagagatggttaatgggtagacacatataattagaatgaataagatctagtatttgacaacacaacagagtaactacggtcaacaataatttactgtacattttaaagtcactaaaaaagaataattgcatcatttataacgcaaagaaagggtacatgcttgaggtgatggctacctcagttaccctgatgtgattattacccattgtatgcctgtatcaaattatcttctgaactccttaaatatatatatatatatatatatacctactatgtacatgcaaaaattaaaagtaaaaataaaacaaaagacaaaatcttaacctaaatctcacattttatttttaaaaaaatcttcaaaatgagtcactgacaaatgcaaaatataaaactataaaacaagttacaagttacagcctggggaatatttgcatactatatatccaacaaagattaatatcttgaatatataaagaactctcaaaactcaatgataaaacaaacccaaacaatccaatttgaaaatggcaaaaaaatacatgaataaacattttactgaaaaggatatacaaatggcaaataaacacacaaaaaggtgttagacatcattagccatttgggaaaagcaaattaaaaccacaatgaaataacactatatatccaccagaatggctaaaataaaaaaacagtaatgcctccaaataacagagagaatgcaaggaaactcaatcacttacatatcaccagcggaaacagaaaatggtacaggcactctagaagacagtttggcaattgctaaagaaacagaacatgcaactaacatacaacctggtaattgtgcttctgggcatttataccagggacacgaaaatttatgttcacacaaaacctcatatacccaatagccaaaactgtaaacagtgaagatatcctttaatgagtaagtagttaaataaactacagtacattcatgtcatcaaatgctaatgccagcaatgaaaaagaccgaactattgatacatgcaaaaatttgcatgcatccccagggaattatgctgagtaaaaaatgtcaatcccaaaaaattacatactttgtttccatttatacaacgttcttaaaatgacaaaattctagaactgaattgattagtgattgtaagaggttaagtagggggctggggtgggaatgagtttggctataaaagggcaatataaaatatcctatggtgatggaaaagttctgtatcttgattatgtaaatattaacatcctggatgggatattgtactatattttgcaagacattatcattggtagaaactgggtagtggatacatgaactttctctgtaatttttcttaaaactgcacgtgaatccacaattatctcaaaacaaaagtttaatttaaaaataaaatgtgataattatttagttactacttgggttaaaagggttatttatagttatttttattattatttattatataattattacttattatttataaacctgccaatattagatgttaaagttaaagcaaaataatacatttttgtatattatgagatccttaaatatgttctcagcttcagagactgcagtaactatatgtaaatttctctcagtcatcattgttcccaaaaatctggtaatggtatgtttccttttagagcttgccctttcaatttctagttagttttgataggatcaacaatcataatattcgccaaatctgtgccccacaactctgctggccatagagcagacaggcattctagttatgttaaaccaaattgttttcatttggaactagaattttgattaaagatgcacagatttataacttgtactcaataattctcgaaatatcctgtttctcatatttccggaaatagtctggctcttttcaaggcttagatgcttagatctgccgttaattatgttcattatccaatattcttcaaatacatttttttttcttatttgaactactcagatctgttttctgttgctttcttactctgtgccccctagtaagcaatagaaaatttatctggtccaatttactttaatgccttatgtccctatattaaggcgcaatatatattaatttacttaacaaatatctaaagagactatgtgtaaggccctggcctagatgctggaatcagaaaacaatcaacaaagcaaaccaagtcatacaatcctggagcttagtaggggagaagagaaataaacaaaaataaaagtatagtattatttacaaatataaagattgtgagaaacaataaaactggagattgggaaatgaaagtgatgataatactgggctttattttatagaaggtctatcaaatgctgtaatatttaatagagccctgaggggcaagggtgagtgatttgtcaaatgtctggggaaggattttccaagcagagggaatagaagtgtctgtgtgcagaactgataatatacttggcagggtggaataatcccaaaggaaagggtggggtgcttggaatggagtgggtgttggggagtggtaggaaatggaccagtgaggtaacaggatctgcagaccatgtagaaatttgaaggctattgtaaagacttggcctttttcaagtgagatgtaatgcaatcacagtgtttgagatgtagtggccttacaaaatgtattatagcaatgctgtcatgggattctttttatgataattttatcacaagtgttttgagtatctctgcaagtgtcaatctaaacacagtatcctattgttacaagggcttatgaaatcacatgggcctattttcaactgtcacaattctctcctttcttcttaatttccttacctttttatcattagtgttgccatggaaatttttactatttgtcatgtatcataattgtaaagacgtattttgcactaaaatataaattgatggagagtaatattagtattatatttatcttggtagtcaaccaaaggtataatggtatttttataccagtttacttaataatatcttattgaaatgaatgaataaagtccaaaacattgtatattacctggtttattaatttctgccttgttttgttcaatttagatttccattttctagattggtacatgacacagaggaggtacttaataaagatgtctttatggataaatgaatatcctcattttgcagatggcaaaaatgagtccctattttttccctatattgactgctgttggccacacaggcatagttagtgggagagaatccatgtgaaacagtttataatatattgtatttccactgaaataatttatctattaactctttcaataagcatttgttgagtacaaattaagtgcttaataccataacaccatgaccaaatattttatgaggagaaaagatgtttttatttctcagttaaagaacctgaaacatagcataaaatgtaaatatataatgtaaatatattaaggtttatttgaagtgaaattaaatatatattaacataactcaaaaatatattagagtatagaaaatgaagcccaaaagcaaaacagtgaatgcttattgtgtttcctcttgtcaaatatccaggaataaaaaaatgagtgtatactgtgtttgtcagcctcaatgtaaccacatgcttcatggggggtaggaagtgacactttaatatgagatcctgtctacatgtaatgtgaattgtgcccctggattttgcatttcattagcctggagaggtaataagagtatcagtgacacaacaatatgcatactctgatagatgaacacatcatttgatttacactctagctcaatatatcagagaatacacttttaaaagcctaactggaatatatgaacaatgaaaaatttaatatcaggattgggacctaatttgaataattcctaaaataaggtacattttattcaacatttggaagaaggcaaagaatatgcattaccaaagaaaaagaagaccttcaagggaaggtatgcaagccagaatgaacaaatttgagtgggtaaataataaatgtggctggaaaagaagatctggcactaaaaacatatattgcagccagctgactgatgtcattttatttatactggccatatacacgaaaacatatagtggtttttggtaatatgaaaatcttagaattataaagcattaggaatatgaaaaagattatgaagtctccagaaatactgaggtataaggaataaaaagtgttccttgctagttgataaaaataaattcatgtataataaaaatcagccagggccagaatctctgtgaatttaattaatgactaaattgggcatactttacttaaaaggtgatatgcacaactgagcacttgcactgtgtactactagaatgtttaactatgtcatggaactgaaatacaacatgcaacattatatattttatggccttagcagcctttaaatatgaattatttagtatgattaaaatcactccctaataaataaactaaggtttgcatatgctagcatttttccttacagagaaataaaaggaatattattggaaaagaagctttctatggttgttagctatttttttattttagtttatagcattttattgagttctgtaagagataatggggataaagaaatataagacatagactttgccctcaaaaactatatattgcataaaagttttcattgtctcattcttctatctggttgcaaaacttaaaacttactagttgactttgccacacttttcttctcagaacactctcttcttactttcaggatattatattctgtcggtctttctgatgtctctgcttttttatgatcttagtattttggatctctccattattgtaggtctttatgtacttcagcgcttttggatgtggttctgaactcgcttctcttcccagtccatatttcaaaagctcccctagatttcaactccagctgaaacactactgttctgttctcagctcaagatcaatataacttactctttttggtgtgagtaggtgtgtggaggggagagggttgtgtttactttgccacttggctgtcttaaaggtgtctctgtttcgcttccgtcattcctcatttcaatgaatggtccatttacccccacttgtgttctcttccttgataaggccttaccattcacacataacactcatgaataacaaatctttgttaattcccttcctaattatatctcaaactcagcacattattacctctccctctgatcactcttatccaagccactagtgtctcttgtttagaacactacatcacttcctcccagcccctagttccctgtattcttggtcatagaatctttaataatgcagttacaattcttatatataataccttacactcccactttctcaaactatttagtagttacccattgctcttaggataaatttaaaaaatctttaaaatgacttgcaatgcctgatgcatattctcatttctaaagagttttatatccatatcttccattccacagcctctcactattccaaatgtgccagatatttttaattcctcaaaaataccaaataattttcatcttatttttcatcacatctttattccatctgcttaaaatgctctctttatgaccctacctccctcctcacagccttttgccatgtcatctttatctatttactcttcaaattaaagtctgaaagtcatttccttcagttgccttccacaaccctgcggatcagttatatgctctcgtagaatactgtatcacttcctcatagctcttatgataaatgtaactgtatcttctgtgtaattattttatttatacttttatctgcttattctacacttcagtaagctccataaaggtacagaatattcctgttgtgttcacaactatatttccagagcctagtacagaaaaagtactcaacaaatagtggcttaaagaatgagcaatgaattaatacaaaaaacactaagcccaccctgatactatcaacttggcatggccctatgtggaaattttgacagagtacatatttaaacacctgtaaaacaaaacctgtaaacacctgtaaaacaaaacaaaccaagagttttgttggtttcttcatgcatgttacagtaatagattttaccttcataaaaataatccaaataattgtatatttataaaaaacagaactaaatataacactaagatctcaagtgaagcaacagtatttactttaattacagttttctaaagatttctacaggtataatcagtatatacatgtttatgcacacacatacatatatacatatatatgcacatatatacatatgtgaatatctgcaagagacaaaataagtaaacagtgtccggttaaatatgttgcaaaatcctgaaaatgtgtattttatggaatcaagatcaaaatcttctgaggagcaggtaaatatttcagtttaattgaatgacaaaatttaggaaagagaggcaaaattccaaaattttccattaaatttaaactcttaaaggggcattttatatttttattcatattatacaaacatctaggacacggaaaatgctcaccataactttgtagcctctgactgtattttgctttctcattattgccacagccaaattcctaacataggacatgtgatctggtctctgcatctgcatctttcagattcattgtcttccctcattatttttttacttactaatacagatatactatgcaatcacttattttctacttataaaattgcactgcttgtggaaaaattcaaaatctctgctcaagatattgttaatcaaattcaagaccttctttttgagatacaatgcattattttggtttccttgacatgtatgcaattccccacatttccaaagctttgagatattttttcagagaaattacttaaaaataaatctcaaagtctgactgtgcaatgtcaaccagacccaagtcttgtgattgtacatggtgtaatcccaaaatttacttttagctagtgaatgaaaaatggtatatttctctaaaatataatttaactatttataagggaggaaactcctttggtaataacttgagttttcacatatgctatccctcaaaggttcctagaatctccaaggtgtaacagctgtgaagccatctgtgagctgaatcaagttccaatagcaaatgcatgccatcaatacagaaattcagccaaaatttaggattgggtcagaattcattagtaaaacactgctactttcctaacaaataggtcaatctgcattaaatactctgaaaatcattatgtgagaaagatttttttttcaagcaacaaatattttcttaggacaattacaaaattaactagttgtgaggagattcattcattcaactaatatttagtggtggcactgtaataggcagcatatctatagtaacaaagaagacagaagtttcttcctctttagcatactctacagagatatacacttttgtataatccactccttgagtgtgagaagagcctgtgaatacaatggtatatcacttttgtgataatttttgtattttatggcaaaagggttttgtaggtgtaattatggttcctagtcaactgactttaaatttaggaaaaagattatccttggtgggcctgatctaatcaggtgaggtcttagaagtgatactatgcagcagcagatcctctactgttgaacttaaaaaagcaaactgccttgttaaggacagtgttaggtggcagaaataggtaggctaggatctgaaagcctcagtcttaagctataaggaaccgaattctgacaatcaataatcttggaagatgaaattgcagctgttgacaaaaccattcagcctggtggagaccctgagcagaggatccagctaacccatgcgcatattcctgacctacagacactatgagataatttttgcttttgtcttaagctgctatgtttgtagcattttgctatgcattaatagaaaatgaatatgggaaaggacaagattttcatgttttattcttaattgctaataaatacataacacattgtattaaatataatttattcattaccactatatgtattaatgccaataatttaagtgtcaggattgaacagatcaggccatgacaagtaaagaaggggaatagtattgtaaacaatttagaactgacatcgttctttcggttctatatctgtatttgtgacattagcttcttggatgagtataaaatctgaaataagcacagtccatagcaaaatcaaacattaaaaatgtgcagaaaatataggatttcataaaatcataatcagggaatttagcacataaaaattaaaagatatcttttgagagatcaaataatctcccattaatcaataaataaatatttaggataaaatgttagggatcttagtaaagtaagtcagttgaaaagtgaagttagtaggtgaaaaattccatatgttaataggttcaaagttatcacattgctctgtgattcactaacacaataccacattcacttttctgtttcagccaaatataatgcattagttctcatctttatgtgaaatactattatctattttctaatctttgtattgaatgttagccttcacatatattcattattactatcttaattgtattattgtgctaaaggttcatttgggaagccaatggaaactctttgagtcaatcattgcaattgttacattttaagacaaaacaccagaaatatacaaataatatgcacagcactgtattaaataataataacataatatgaaatattgagaataatataaacaataggaatgacaagaataatacaaacaaaaataatggcaagaataatataaacaataatctaaacaatattaatgacaatataaaatagcaagagacaacatatttgcttgattttaaaataacttcagcagaagtttctcttcagtagaggaatttagtcagttttataaccgacatattttgacagagtattgacaatagaatcaaacaatgttcttctacagacactttgatgtagtgagactacctacagagtcaagattatttaaaattgcagtttatttctgacattatcttatgatatgattttgagaaaaatgcctaacttctctgacacatattagaagttttgattatgcccggttttgtcaaaatataacaggaaattcaaagcattactggtggaaatataaccagatgtggccagtctgaagaacagctcagaaatagtcaaatctaaaatgcatttgtaactatgaccccacagtccttgagtacatttccagagtaacttttacatgggggtttttagagtatgaggcaatataggtgtccagcagtgggaccactatatgtgaaactacataacatggtggtacaaccgcctgaagagctttttaaaactagcttaatcctcagacactctgatccagtccacctgggaaggttttggggatactagatgtttcatccaagattgtgaaaccaagatggagcaagtagacaaaacttaaaatcacactactgagtaaacagtaagaaacagcaagagatctatagcataataccacttatgtaacttttaaaagcatataaacataaaatactctctatttcacgaagatacgtaaaaatcaaggatatggaacaaacacatttgagtggttccttatatggggagatgcatagaaatatggaatagggattcaagacaactcagtatacacatattcacacgtgaacacctgcatccgtatgtcttgtagtgctgcaaaaaaagtttggtgacaatgttccaggagtaagaaacatgattaacccaatcccttttaacctaagctttaaatagaattaacaacaatgatataaaattagtatatgggactagttaatctttaaagctcattctagtttatagcatgcatttttttctctaggtagcatttttcaaaatacactttgcctggttaaaaaaatttgacttttggctgtgtgcagtggctcatgtttgtaatcccagcactttgggaggccaattgagtggattgcttgaggccaggagtttgaaactagcctggccaacattgtgaaaccccatccctactaaaaatacaaaatttagctgggcatatgcctgtagttccagctactcaggaggctgaggcataagagtcatttgaacccaggaggcagaggttgcagtgagccgtgattgcaccactgcactccagcctggacgacagagtgagactctttcagaaaagaaaagaaaacaaaacaaaacaaaagaatacaaaaggaaaagaaaagaaaagagaaaagaaagaaaaaagaaaagaagagagaaaaaagaaaaaagaaagaaaaagaaagaaagaaagaaagaaagaaaagaaagaaagaaagaaagaaagagaaagaaggaaggaaggaaggaaggaaggaaggaaggaaggaaggaaagaaggaagggagggaaggaggaagggagggaaagagagaggtacggaaagagaaagaagaaagaaagaagagagaaagaaaggaaggaaggaaggaagggaatttgtctttgcatcactcacttccttttcagcctgaggcactttctttggttggaatctcatctattatgtgagaattcaatagataaagagtaatatgccaagatgcataattattataagaggcataattaagggaacaaacaatgattgctttggagtaggaaagacttgataatgggcagtgggactatgataaatgttttctaacatttgaaaagccttcatctgttacatgataaaaatatgacacttacattgtttggcaacaaatgattcagaggcaatctgaatcactagatggaatttaaaggaatttcagttcaacataagagagggtttctatttagagttgtccaaaaagtgaaagagttgccattaaaggttgtgaattcacagctgcataagtgttcaaaagtagtgggggtgcaacagaatttagtcaaatgttgatgctgctcatataatggttttttctcaaattgagttggatcaaagctattctcttttgactttctcctctacacacgtatttggagtccatggtaaaaaatgtatgccatttttttcttcaagattgtttatgttcataaatactgaattagatgatttacaagatttccgttaagcttgtgatggtatgagaagaaaaaaaacccatccagtgcatgagtcagttatcacactgattatattctgaaatagatatcaatttcaaaataagattaactacatcccaataaatggtaagtttggtgcacatatttaaattatatactttgatgccaattactctgtatagttcttttttatttggacctgtgttttcacgtaatttaaaaaattttatacagaacaaattttatgtacagagatgagtaagttatttactgcttttaagaggaaaattacctacaaaaccaaatacttacaaaccaaaacagtttaatagtagtgtaattattttttagtgggtgattatttatagaatgtctgaatgtgaccaacataaaaacattgcttgagaatgtcatcaatgttttggtcactgaaatttattaaagaaaaccgatggcatcaaaattggaattataagactgagatttatattcagaagacctgagtccaaatgcatcactatcacctaaaatgtgtgacctttgaaaacaatgtgttttttttaatctctgaaattcattttaactcaacaaatatttattgagtaactactatgggataagtcctgtgtacacagaatacaatcttagggagctcaaaatcttacagtagagctgcctatgtaaataaactcttgtattcagggcagtagaagaatgaatatagtgaataacagaagtaaacatattgcgcagttgctgcagaatgaaaagatgcatagtgcagagagtggataaaagaatggaatgctgaaacaacaatagctacttcagagctttggtaaaaggatgaaaagaggctaggcatgtttaaatattttgtatactgtatgtctttcccatttgatggagaaattttggaatgtgcaatatttgtcatatccttcttttctattccttctgctgccataactgttaagctcccgaacaattcacatgtgaacataagaaatataaatttgtctattttgtgtcctaatgatcaggacattttcctcagaaagttaaaataaatgtgcattttctttccttttaataaacaagctactttggggactggcagtgaagagaataacagaaaatgaaatataataaactatcttccaaatctttgcctgagaccaagcaagactgcaattaaagtaagaataaaaatttaatagttactgtaaagcaacaagtaaagagtgaaagctattactgaagtgtgaaaagaggctaccttttaaaggcagacagaaaatgattacaacctaagtgtcctgtaaaaatcgccctaatcaacaattctgttagtacttgatccaggaaccattctccagttccttaattgtaaataaggatgacttcacagggcaactgcaacaagagtccaatggactagcttccccaagtataacgcttgacatatacatagaaattcaataaaagttagctcatttcttggcctttatttttgtatttgctgaaataattattgcacatactcatggcagttttatgaaacaaagaataacataaattccaatagtaaaactattaagggtgggaagtgcaaaatatttgaagactttaagataccatcctgagggcaagaccacagggtcaagtattcaaggtaaagatcatagaacaaaagggggattgaagtagaagtacagttggaaaaacaaatctatatactgtgaatatatatttgaaattaatttcaacgaggtaatcctgagaacattataattttagatatcaaacagcttggttatgttggaaaaatgcataactaagatcatgttggttctgaaaataagttcgttcctaatatgtatggtagaaagtttaatacagatatattcagtatgtaactgatgaatactgagtgactaatagcaagatttaggcttctcagtcctccagctggcagagatatgcaggcaatataaaaactgttggaaggtggatacaggaagcctttcagctgctgtggttttctataatgattctgaaagtttctttgtttttttaattcctggaatcaagagttagagaatcaggattgtgggtggtcactcatttgctcaatttttttttcttttgttttccatcattaagtactttacagctgggagcaagacaaaaagcaacattttaagctgtgctgcctaaatatggcttagaatagaaaggtaagcaaaaatttctaggaaaggcacattactttattaaccttataagaatcagtgtgttattatctcactattcaggtgcctagtgtgccaaatagaaataggtggtaagttaaattggatacaactgcaatatctctacataagctatgatcatatggaataacttaatacttctctgacagcagacatttttaatagaaacatattttatagaatttttcctttatatcactcataatttgtaattatatgcttatttgaaaatatctgtcttctttaccagactattctcttcgtgataatatgaactatgttgttgttgctttatatatctgtatccccaatgcctagcatactaaaaaaaaattaatatattgttagaagttcttgtctactctttctctttttattactgtaatttcacaatgtctgctcctagaagtggactactctattctgaaggatgttagagagagaataggctaagcatagtggttcacgtctgcaatcccagcattttgggaggctgaggaaggtggatcacatgagccaaggagttggagaccagcttgggaaacatggcaaaatctcacctaaataaataaataaataaataaataaataaataaataaataaataaagttagccaggcctggtggcacatgcccatagtcctagatattcgggaggctgaggtgggaggatcactggaaccagggaggttgaggctgtaagtgagcctttatcgggccacttcagtccagcctgggtgacagaaagagattttgtctcaaaagagagagagagagagagagagacagagacagagagagagagatggtttgtttgtattgtatttaggtagggttaagagagtacctcaaacccattagtttactaacaaaaataaaaacaaaactgcaagtgttggtgaggatatagagaaattgcaaccctgctgaactgttggtaggaatataaaatggtgcagtcactatggaaaatggtgtgctagttcttcaaaaaattaaacatagagtattggggtttgctatgcttaggattcctcagctgtgacataaaccacacgtggtactttacgttgccttctggtactaaaagggcaacttgagcaagaagaactgctttgactataaagctcatgctgtttgctgtgctttgattaacaaagtcccttgtctctgacccaagagtctcatgtcttttgccagcttctatgacactgtggcaggctgacttctaagctgtcaagtagagcaaaatctcataacagtctcctttttcttttttctttttgatttcttcaaaggtaaatggaatacttctgtgtgctacaatatgttagtttttcatgtgatacagcttgccaaaataattaactttgaaacaacattatgtgttgttaacacttaaagttacttagatttttctttctttaaaaaatcactaaatccactggacattgatagagttgaagaaaacaatggtacattttatacgatttctatgtttgcatttcacatttcagaaatagctgctcaaaatgcagaggtagttaaattttcagaggatgagatatgtattataagcacagctctctctgaatacataacatccttatgctgaatttaaatctaattttgtgacagctgtaaaaatggctacctcgtcaagaagagcaaagaaatcaaatttatgctattttctgaaaagttacaatgctaaataaagcattgttctgaattttaaatcataacatttccgcctctagtgaggttcttgggaaaacgcgattctttaggatatacttataaatcacctttcatcatgaagaattttgaaatcatttcaaaatataagtaagtagaaaaagaagggtggaacttcacacagaaagtatttgttcaaaaatacccagaatagaaaaaaatatacattgctaccagcactaagtgtgctgaaaattctgattgaataagtcagatttgtactaaaactacattatgccaacagttccagaccaaaaaaaaaaaaaatgtaaagatgggaaaaagaaaacaaaacaagaagcagtcagcagagtccagcaggaagaaaggctgacatcactaacgctaccatgagtgtaggggcagcaaaaggagacagaaatatgaaccacatatatgataacggaaggtcctccatgcatgtatgataaggttcatgaagtacatgtatcataagggaagatcctccatgcaatatgtttggcttttgaattttacttttttcaagtgataaaatacaagataataaaataaaatagaataccatcacttgaattgactctgtcaaagttcataattttcaaattcagcttgcaagaatttctttcttggaacaaattgaaacagggagtgattattttctttcatcccttcaaaagttaaaatgcctatccctgaatataaatgcaagcctaaacttacagatctttttaactatccactttgggaacagtatgaaaatattatactatgaaaaggtacatgatcagaatacattttgtattctgattctgattttggtttatatatatttttgtatatgtgtatatatacagatatagatatagatagatgtacatgtatttataaatataaaattttaaatgtacaaacgatataaacaatacagatatttttatacatgaagtagcaatctttcttttgcaacatttagggggaaatgtgacggaaaaaataaacaagacggtgccaaatattttttgaaacctagaagggttttctaaacagtttttgttgacattactcaagcatctttgagatctcttagtgtactagtcaatattgatggttctttttaagataagaaaaggaaaggccttgttaggaattccagacaaaataatctgttccttaaagccatgtggtgagtataataaatgtttacaaatatttttgttcatcttctaggcttgtgttaggcttgtgacttctctacctttttgaagtaattacagtcgtgtgatttctgatttgtgcaataaaaatatgtataatatgtaaaaatatgtaagatatgtagaatatataattatatatatttttgtgatacatactttaagatgtttatagacatataaatatgtgtttgtgccaatattggccaataaaatatgtgtgtatactttctggcacttcctgaccaaaattcttaaaaagtagtgcctgattgccatttgtattttgttttctttttttctaaaatagcaattatgggaaaaaattcagagttgggccattacaaccctgagttctcctgtgactacagtaagtaaatctctcctgcccatctgcatttttctgaagcaattaagcaactaagtttgtcaggttattaccgtgtgacctcatatattctgataagccataattagtcaatatttacttattaaaatgaaaaagatattcaaggtttcttcatatgtacttctcaagctttattctttttcctaaagtcactttatctgaaacatctccatagaaatccattataatatctataggatttaacctgaatttaattaagaaaaatcagtgaaatagactgaatttctcattaaattattaaactactcctcaataataatttgtcctaatagttgatcagttgattaactctgtgggatataaattgattgcgttattattccaatgatgaaaaaacaatggaagtggcctctgttcactatccactctggctggcagccaagtcagaatatatatatatatatttccaccaactcccataagctaatcaaaacactggtgctcaggaaaagtaacactaaaaactcatatgtgaaagagtaaatagatgatggtaattgacacttttgtaaataacaataagtgagaaatatatcttacatttcctgaaaacacaaatttatagaaacaagagttttttaaagttatggaatcaaatgtttttgattgtttatatgtatgtatgactttgtaacaaattttaaaggagcataacttgtgaagtcataattcatattataataacaaaagaaataatcttattatttttcttctatattaacaacctagaaaagactcagcagttctttaaaattataatcaataatgatgttttaaatgcatggcttagatttagttacaagagtggaaatgatggtaatatatttttaagtgttgaattcaaaacgtctaacgtattcaaggtgttcagtcataaggcaatattttaggcatttttacactttattctactttttaaatgtttaattttatatttaactatttcctcatctatggattatatattgaagaacagcttaaactagaaagaattctaacttttgatagttggtagaatgtcattgtataaaacaaactgatttccccaggacctttgagtccacagcctataaataaaaataaaacataactcatggtattcattaatctaaaatcaaatttagttaaattttaaaagaacgcataaagataaattattcaaaaataactgaactgttccctttggggattatttgatattgcttaggaagcaaataataaatccgtcttccatgaatattctactccaacatgcctaataacattctttggtctctgaatattacctagaattcctctcattttgaaagaagtcatctgaaatatgatccaggaatcatatgtgctatattcaaggggacggatgttgaatcaaaatacaacatgccctgaaggtgctaaaatttatggggaagaaaagatagtcccagaaggaattaaatctggcctttggttacaatgtttgaggaccaactgcagcatgtttctaaattcatactagttactaaggtcaatataatagtcactacaatttttccttgataatgggaattttagtctattctctgagcatcttcacatgccaggagatgaatccggatttatctaagtcagtgatgatagattcacaccaaaggcaagtaattggtatagcattgcttcaatgaattcaaagcattttgtgtaagaagaattaccatcattggaaagttgcaaaggttctagaatatcagaaagctgttacagaaaatggttctggtttactaggttgtaatatctattccagtgtaaagtttggcaggtttttaaatctctactagctttagtctggatacaagaaaggatgaaaatcataatacctaattgataagtttttagaaatgtaaaataaggtcatttttgtgttatgcttaaaattatagtatataaacttaaatatatgacatgctattattattgttgaggtggcaaatagaaactttgctcaactgtcctccacttctaacataactttttgtggtctgccaaaatggagaacaaacctatatattgctggtgttctctctttttatgatagatacttttaccggaacagtatttgccattatgtcataagaacatatttactgtctctaaaaaaatcaaatacacttaatagtttacactagcttagaggataagttttagactcttttgtctgagtttccaaattgttcaaaatatctttgaaagatgcttgcaaccaatcttctcacttgaaattgtcacctcttttctctacatttatctttatcagccaaagtcaactcacttttagttaccccaaataaggtgttactttaccaaaattattaacacttatataactctacacgttatacatgactaaataacatttgttcctgaatcctagaaagtgatttttttttcaattttcacccattgaaacatcttgaaaggtcaagaaagtgttttatgaagagagaaaaagacaaggaaagattactattaataaatgttaaattgaattaaagtggagcagaaggacactggctcaagagtgtaggttgttataaaattaaaaatgtttgattgggtggttggtgggattttatttaaggaaaaatgttaagcctttatacaggcaaagattagagaaaaaatggaaagaggaagttgtataatcaagacaatgtgaaaagaagaataacaatagcggttaagaacttgtcactctaggccaggcgcggtagctcacgcctgtaatcccaggcgtgaggcaggtagatcacctgaggttgggagttcgagaccagcctgaccaacatggagaaaccctgtcgctactaaatacacaaaattagctgtgcatggtggcaggcacctgtaatcccagctacttgtgaggctgaggcaggagaatcccttgaacccaggaggcagaggttgcagtgagctgagatcacgccattgcactccagcctgggcaacaagagtgaaactccgtccccacatcaaaaaaaaaaaaaaaaaaaaaacttgtttactctaaccaaatttcttgaattccaatcctagatttaccttttattacttgtgtgatgttgcactttaaccttaacagtggctcagttttcccatttatataatggggatctgaataccatccactttatagcctgggtgcaaagactaaaagggttgttatacatagaatagttcaaaaatgtctctggtccacagagagtgcttattaaatgctagagataaaaagagagaggcaatacagtataaacatataagttattcttcaagtctctaacaagattaatactcttcacaccacgttaaaattttcagatgcctttgatcttccatggcattatatttgtatctttcttagaagatggagttttactccttactagtatgtaattatttatgtatgcttcccataagctataaaagctcctgaaaatcagcaatagctattgacctcttctccatcatcattcaatagatatttgttaaaataatacaaatataataaaactatgttatctctcctataatatgaaaatctgttgctataatattgatatcttattaacatttcagccatcggatgctgtgttttgaaaaaacatagagataaaacaatagaatgcccaataatttttttgaagttagtactttgtaatgtgatgatttttaaaatatgcaactgcattgtcaatgacctcatctccgttgtttagaaaaaaaaatttgatggaagatacaaggattcagcaacaaaagccattttagaaagagctgtgtgtgtgagaaatgcaatcatataacaacttcagaaaagcttgaaattaatgtctgatattatatttataactaaaaagttattagaaattagtgctaagtataaatttttttgttaactaaattaatattgaattttctatataaaatgtgaaaatatataaagaaacttattctagaaattaggcatccattaaatattaaactgtagaaaaaattaagataatattaatgcaaaaacattatgcttttgattctgttttcagatgactaacttgcagggcaaattccaaatgtatgaattaacaaagagattcaaactttgaaaatatataaaaattgggtcagaactaaatttagacagttgtgttatacatcactcatacttgaccagtgacattaggcatgtatgatttgattttactgactctgtgaatacaattctccaatgcagttctccatctacttttcaatacaaaggcattgtttatatgtcagtaaaaagaggtaatacaaacctgacctgagaagctaattttcctctcatattactaatattgtagataatgtagctccttaaattatactgtgccttctttgcgttgtttagctaaagaaatatttcattgtccagtaagtttggttttcatcagaaattattttcttttactttgtgagactataaactaatcgtgttttccagatttgtttagggtgtaagaaaaataaaagctaaatataatgctgattctaacaaagatacaagaattcagaacttgacttttgtaaattaaccttgctcttggtttcatcttactctcctgttattttcttttattatagtttgccttaattccactttatgttatttagctacatatatcatattttttgctgcatcaactgcttttttagagttagctataaattaaatattaatagataacaagtggccttaataatttagctttgaatactatagtaacttcaacaaatgtcgggagcagtaaatggaaattgccttggtcaaaatataaggaattagtgcaaaaaaaaaaagaaaaaaaaacaattcctccctgactccttaaatatttaatgtatttagacccagttttacatacataaaaattatggagtaaaaagaaaattatttattttcttttgaatcagatatgcaatggaaaaagcctaagaaaagtggttataaaaagcctttagatttcatgcacatttagaccaaaaattagagtttttgaaggcatccaagttccagaatttaaattctgttctctattattaatgatatgaaagaactttcatcactgaatggttcaaccacgtatatcttttacttaacttcctacgttagtgagtgatcaataatattacacaggaaaaaaaagagaacaagaccaaaagtgtacaaagtatccctccccagtgattgctgtaaaaatacctattactatgctttcttagcacaaaacacaaaggacttttcacatggaatgagtctactaaaatatgtgtcacatagcattaaatgtctttggtggctactattctccttcctccattggtttattctaattcattttgcttcgtctttagagtggtggctttgcaaagagcaaaagaataccagatggtcattgctgtggttcactgagtttatatcctagcaggaagttagatgattgcttttcaaggttcttatcatgcattgaacagtctatttcaccacaggggattctgaagctgtcaatatattcttggctaagcatgccccatcattttctctttaagacatgggcctatataatcatatgaatgctttgtggacgcaaagataatataacttgtctttccttctacatattgtggaatgtagatttgtgttagaaatgagtatttacttaatgtttataaaattctgttttaattttgggaacaacatcgttaaactatttgttatagcttcttcaaaaatgtaaactttccctaaacaatctggattttgcatttagaaaatttactttaaaattcttatttgtcaaaacaagtaaacaaaaaactccaagtaaacaaaagccttcccagaaacaaaagactcaaagttacacagaatttgtgtaagcaatgaagactcagttgcctcaaaaagagactgacgtttttctttgatttaaaaaatacacagctgacatttttctaggaattgcacagaaagagaatgaagttaaaatcattccatcgaagaaataaaaatctctaaatttacactatcgtaacatataatactaaaaaaatacacagatggtctctttatcgtcaaagaaaatggattagtttaaaataagaatgatagatgaaggaataaaaaacttgaacaatagagtaaaccaacaaaaatgttttagctattgcatacaagatgaggggaaaaagtaaatagttgtgtgaatgaaagaaaacacaactcacaaatgcaaaatggggaacataatgtaagtcaatgttaaatatatggctgactgttgccatggtggggtcaagggtgatggcaggataagaacaggaagctttgattttcttccttgatcataagaaacatacataaggccaacacatattgtttatataagaacaccagtggatctttttgcatgaaattagactatacacagttagacaataacccagatcacctttcaaatacaaaactcccatattcaaatacaaaactcaatagattgagtttcatgaggcctgtagctgtttcattaatcattatacttagaaatgtgacttgtgtgtagtgagtttttaaaatatatgagtttatggctgggtgcggtggctcacacctgtaatcccagcactttgggaggtcgaggcaaatggatcacttgaggtcaggagttcaaggccaggctgaccaatatagtgaaaccacatctctactaaaaatacaacaattagcttgatgtggtggtgcatacctataatcccagctacttggaaggataagccaggagaattgcttgaacccgggagatggaggttgcagtgagctgagattgcaccattgtactccagcttgggcgacaagagtgaaactctgtctcaaaaaataataatactaagtgaaaaataaagtaaaatatgtatgtgtttaattattgaatatacttcaaatgtgagaacttccagacatggataactcagaaatgctatgttaactttggaaaatatattttcaaaaacgatgtctaatacttgctgatccacacctaatttttagggtaatgtgaggcttaaagttccttttaatgctgaaaaaattaattctactgcctgtatgatcccagaacctagatacatccattctctggtacccttagtttttcagtacttcatacctcagtgttattatcatattcaaaaatataactttacaaatgactcttagtatgtttgtcctcttttggttgtgaacatgataaaaataacgtagttattactagttgttgaataccattgattaggtattttacatacattaactaatataatccttatcttaatactataagtaagacttgcccctagtatacaagtgagaaaactgaggtctaaaaaattaaatatataggttaaggttttatatcttctcagtggcagaatatgaagcaaaccaaggcttttattagtctagagtctactctttccagagttcttgactatcttagttttttaaatattctccactatttctgaacccaggcacatgtttaactgtcaatagatattttaaatacgataaatacaaacgtaacaagtgatagctattacttctataagatttttaaaataattgacttttatgtgtttggaactaattagatagttttgagcaccttctatgtgttaagcattaaataaatttttcaaaactatcatttaatctaatttctttaaccttcaccattctgaaataagtaaaaatactcagtttttgacataagaaataacacactcaggtaatacatggcagaaatataaatcaactcgtaggtcttctacccctaaagacaaatcatgttgcctttactccatcactttagatactactaaaacagtctaatcaggacatgtacgttattttataacacaaatgtacttttcaaaacaagattaaggtgcatgatagggctattgagtgttgatctgactgttgattgaatagcctgtattttccagggagtgttgaagcagcaccaagtgacctgtgacacttgtgaagttttccttgtggattgacatcactgcaattttgttagcaggctttgagctgataaaataattccattaccaaacaattcatgcttaacttgcttgttctttaaaagacatgcacaacatgttttcttcattagcatcaaatataactgctcacattaagaaactagatctctatgtgaaatgacagctaatgaaagctgaatgtgcccaaataatattgctcagatactggcaagtgtggtggtggaactcaaagtctgtgctaaaacattttctgaaataatatttaaaataatatgtttgaaaatgaactcagtcaaaccgtcaatgcttcaatcctcgaaaagaacttttaatacatggttcatgacatttttatattcaatagtgcatttgagtcctttcttctttggcgtaaaagaggttaccactgacgctactctctctgtgattcagagagttacaataacacattgtcttttctgggagtgggtttaagaaaaaaggagatgacagtttacaatggtttgtaataaaatgtttttaaaaactacagattttagactggacgtggtggctcacacctgtaatcccagcactcagggaggctaaggcgggcagatcacgaggtcaagagatcaagacctggccaacatggtcaaaccctgtctctactgaaaaaacaaaaattagctcagtgtggtggcacacgcctgttgtcccagctacttgggaggctgaggcaggagaatcgcttgaacctgggaggcagaggttgcagtaagccgggatcgtgccactgcactccagcctggtgacagagcaagactctgtctcaaaaaaaaaaaaaaaaaaaaaaaaaaaactacagattttagctacaaaaaatgctaaaaaataatctttacagtgaatagataaaactgggctttgttttgattgagtacataaaatcttaaaatatattttcattttggcgaagtacaatttattattatatttaagcactatatgggaatgaatagaaatatggcaccaaattatttttgtgtcttgtttcaatatagtacttttcagttttctttaagttagttttatcaataaccttatctattatttatttagtatcatatttctgatatcacatttcagcatttactcatatgtaattgggacttactatgcataaaataaatgacatttttgatttcctactgcctttgtgaggtaatttccagatacagagcagggaacaagcaaacataataaatatcctttcattaactaagtcactacttctttggaggaattttggtatataaaatttaaaaaattactaggctaaagcttcctacttctttcttctccaactattgtcttttattgctcagcccaattccatgttttggtattacattttgatccagaaaattgttgatcaaagttttttggcaggagaataatataatatggtgacaaatcaagctgctgttcttatttcatcagtcatttctctaacacattgtggaaaacagtcttccaagaataaaacttggaagatttatttttctttgtcaaaggcaacagtttcctcattagcccttttgcttagatgtactgtaaatatatggtttaggtcactcagcaataatttaccatacaacatctacatcactaacatccaagcttctccaaaaactatctcacctgtcagatcacagtaaactctgtcaacattttatagcatcacatccccttattgatcagtcctttccctgagccctcatatgcattccaagttctttctttttggccacaaatatactcaaatcatcaatacaatataccactcttttaaaattttctttggttaatctaaaattcacatttctaatttagccatatgtttcctatgactgccttcttaaatcttaatatgttaactcttccatcaaaagtatgtgtctcttttacatacaattctattagtttttcctggggtatgtgtattatattgccattctgaatgcaaaatataattatgaattttggaattgttaacataggaatagcataaccatttcacctcatctgccacttcatctgtgagaactgggttaagaaggattctaaagctacatcatgtgccccaggtattctcattcaagacttggcgcataggaattaggcttcactttgtacagaatgttgcttagcccagcagcaggcagttagttgacttttacaaatactaccagatggtgttgataaaattcatcctgcctgtgaacaaacacaaaacctttacaccataccctctaggttgatgtggaatacattttttcttaattaaactaccattgttaggaagcatcaaaagaactctctacaagcaaaggtttcatcaaggagagactctacgtaaactccagggaaagcaatgagtagatcattacagagtcatcagccccctgcaaagttataaatgctatcaagtggcaaagaaaagcagagggaaggcatgaactgagtagtctgccatcttttctttggaaatgaatgacaactacacacactgcatatacagtactccattctttaagttttaatgaaaaaaattggttagtgagagataaatcacaccttagaaagttagatcatgtgctctatgaagtatgacttagactctacctttagccagtgaatattagtaacacgtgagaactaattttgaggctggaaaggaaaatctgtactttctacatgaattattgtttcattcaaaatgttcttgctctatatagtttgtatttttagcaattatctgtaaaatcttctcttaaagcgttgtccctagctgaaattccttgcactcaatgggcgatattaataccttccttatcaagattcctagcttactctacagattctgctattaaagcaatcatcatacattactgcaattacttgattactgtctgccccactggaccacaggttcttaaaaacagaaaatgtgtcttaatcaatcttttgattctcagcacataacataatgctttgcagaaggaaggcccttaataaatacatacaaatcagtaaatttattcattagttttacagctgaggagaaaaaaaagtgacctgggtagactaaagttaatcaggtagcattttcaaaaatagtgggtgccaattttgatagattttaaaaaatcatagaagttagagtggtggtcaaatcttgctgggacctgggagtgaagagtagggaagtaaatactctggtagcagagtttaaccctgaaactaaaatggcaatagaaaaaaaaaaaagcaatagaagcattggttttagggttagatttgaacagaaggacatttgatattattccatttcaaatttgtctttgttgactgtatatcctttctttagggaggaaatagtaacaggtgctgaggaaaagttggatgatagagctaacataagtaataaattggtatgtaactgatgttttatgaatgctattacattaaactctaacaggtttatgattttggtatgtctgcctctctcttcatcccagtatagctaaaaaaaaaatagcttccaaaataattcaattattactctaagtccatagtcaataagtggcagaatcagtattcagaataaggcctttctgattccaaaggctattgtctgaattgagatgaaggaacctaacaacagagattcattttcaggcagtgttgagaatgctccattgaaatctcttcaaagtacttcttagttttaagtgtcttactacttggtttttaagaatgttaatatgtctctgatttagggagttttatggttttttttttaaagactgcatttctgctgatttccatataatattccatataatatccaattcctccaattataaagaaaagttcttaaacagagacacaaattattttggtgatgtatcaaaaaggtaacaagctcaggctttggaacctgagagaatatttcagaccttgcttctttaccacagcccatttgcttttgggagacatttctccattgaatgctcatgtttctgcatatcttgtgagcacaggtaccagttatcctgcttttttgtacctggttatccttctgtacagaaaatagccaaggagaatatagtgttttccaccagagcaaaggataactctgcttacagccttgagagacggagatagtgctccctccagaggaaagaatgggagggcctactgcccattataaaagagtcaggtttctaagctcatggttcatctcttataataccatttagtatgttgtgcaggtttctcacactcttcatgccattctatgagaattagggcttgggaaactggcacaaatcctgctattcttgctcctagtgctgctgtgagtaataaactatcctttatttctgactcaacagtcttgtgtttttcatcaacatccataaaactgtggcaaagagttttaacttgaaagtagagtaaaatgtcagaactcttcatagttcttgatgtttaccagctgagtaatctagagcaattatttttaaatatctgagcttcagtttcctattatagtgaaatttaagtgataatgcttataaatttcatagtatatttatagtgcttaaataaatgacagctaatagcagttattcaatattagtagcaacaccagcagtagcagtaatgatagcggtaattgtggtagccgtagtagttgaagcatacgcagcaacggaatctaacattgaaagaatgccaacatatagcagacatttttactaagcagccagtgtagcttatcttatttaatcctcacaagaaatggaacaggtgttttgtgttttgttttgttttcattagttaaatgaggtaaatgagactcaaattgttgaactgattttcctgaggtaactcacatggcaattgacaaagctgggataagaagcttgttgtgtctaattaccaggaggttgtggtgcatgtatttgcagtgacatgtttgggaggaagctacaaagtaatttagatgggcagttggacattcccacatcccagtcatggaggaattacagaagcatatgcttactaaggaaaaaaagaagcccagaggaaacacaatgttggcctccagaatttttgtaagaaaaatccatccatgtgcttagctaatgttgaacacgttctgtttcccaagctctgtattttgaacctttgtccacattattatattattgtgttttccccatgatacaaataatcttaatagtattgatagtaaacaaatgcagcataattaatttcgaaaatttccatgctgtcgtctatcagaaagatttagactcagtcaatatttcttaaagcaaaacaattttgacagcctaattaaatttctaatcataaactccatgttttaaatataaatatgaaagcatataaatacacaatgcatgcataactatgcatatagagatatataatttactacctaatttcacaagcaatgtgaaagagatactagtcaatactagaatttagtatttttctctccttttcatgtagtatatgagactatttatcctttaggtttttgttttgttttgttttttgagacagagtcttgctctgttgcctaggctggggtgcagtggcgcgatctcagctcactgcagcctccaccttctgggttcaagcaacactcctgcctcagcctcctgagtagctgggactacaggcgtccactaccacacatggccaatttttgtatttttagtaaagatggggcttcactatattggccaggctggtctcaaactcctgacctcaagtgatccactcacctcagcctcccaaagtgctgggattacaggcgtgagtcaccatgcctggcctctctatcctttagattccgtagaagaaacaggcaccaaacacatttttcaaatacactggctgataacaactctcatttttaaagtgttttcattttacctctacagataggaacaggaaaatcccacgaagctgtattaactgaattggctatgcaggtgagctgagggtggccatcaaggatgtatccagttacacagctgtagcggatcttgtccccgacgtcgaatcttgtgccatataatacacctttgggtggaacaccaggatttccacaagagctactctgcaattctattaaaaaggaggaaaaggagagtttacagttatttcaataagcagtttattgttttagatgtataaaattatatatgtagatatggatattcttatttctttggagaagagtcactgaaaggaactgtcttctattccaatacatgtgacagtgaatatgggaagaaaactaaaccttatcacagaggtattattggtcattctttatgctagaaagttttagatattatattacttagtcttcagagcattactcatatattaatatttactcagataagtaaaactgaggataatatcattcacatggctttttcaaagttacattctaataacatagtaataagcaaattcatttccttaatattatcttcagtccttcagtgcttaatcttaaaccatgaacctagataaaatacacatttttcatggaaacctttatttcatttaaatgagaaaaatacagtggagtagtaaatggacaatttttaaagttagggacggtgagctagaattccaactctattatttgttattaaccttgagtgtatactacgaatgataataataagtgcaaacagttgtaacattttaattagatcaataggcaaaatatatggaaaatgatatatcagaatgttttacctatcaccttcttattctattagttgatgctgaaaactaaacaagtatacaaacataagagttttttaaataatattcaattcagaaaaaatccaactttagattaaatgaaaaaatttttttgaaaatagcagaacttcaggattaaaaatattagaggttatttgttctcatattgttttctaaatttttattttattactgttatattacctttatactacaaataataataaaaacacaaacagtaattaatgaactaaaagatattccaatttgagtaaagtcagtagttaatagtattgtgcaaacattaatttcttagttttggccattttactgcagttccataagtagttatatcaagggaaactaattaagactatatgggaactactgttcttgcaaaataataagctgaaagtcatgttgcaataaaaagtaaaatattttcccattttgctttgatatttatttcatttgtgcagttactaaattctatataatattacaatgttaattcaaataattacaaaccattgtaataattaaaatatcgatgtcaatattaagcaaaaatattaaaatacaaaatggttcacaatatatagcttaattttgagagtgttttttaaactttcattaattttttgcctaaacttttcaaagcaagtaaaagaaaaatcacagattaatttccagtatgaggtcaatttaatcaagaaaaatgtattgagcacaggacatccatatattttagagaaaaaatatttactttgagttttaaaaatgtagttttaggtttcttaaaactagaaaagtgaagaaattggctaatatttactaaacataaatggtttcaatagacaattttcttaataatacattctaaacttaaatttgtaaaatatttagtgtcagtaatgaaagttatttctaattttttattttgttatttctccaagacattagctatatgtgaattttcagtaaaacaatacaactttattgtctgtgaattttgagcaacttttaaagaaacactttgaacagtagtttattttgaaatacttaattttttggaaaattatttgattaatagatgagatgtttgttccaagagacagtgaggttaataagttttgacaaaatgaataagaattcaatcctctgaatatagtaataacaaaggagatacttttaatgaaactaccacttttggccttagaattaatccactcctcttccttccaccctctaaaaaataattaaggtcaggacttcaattatcataaagttatatgtctaggagaaaagtggtttccaaattatgtcacaggaagcaactaggtgggggaataaaatgaaagagaagaaagctctgaatagtttttggactccaaattaactttgatttaaatgaacaaataaatgtatccagaataaagtacctaaagcaaaatggaaatcatgtcaggtgaagtagtgaatgaatagtaacattgaatggaatcttaatagattacctaatctcctgccttatcgcttaattacttctaaaactgataaaaatttaggttatttcaaaatgaaactcaaagaagacaattttaaagcatatctggacttcactttcaggaaagtcctgctgttgtttgtgcctgtttatcatcttcatatagagaaatatctacccatcatcctctgttaactgagtaattcataaagacagttaagatgttttacattcaggtttaatcaatcctgattctataaccactgctcatggattatatttttgtcttcttccaaccctttaattcaggacttctctctatgctgtctatgtgcattttcaaaggcaaagcaagtatgatgtgtcactaactgaagtacaaaacccaccatcaaaaaagattatgttctgattgaacattctcttcttactcttaatgttttaaaactaagtagtgctgcatatttaaacttttgaattaaatttacttttaagtaataaaaagttttagaaattgctaagatagactagattttagataatgtttctgccagccatccagagtttgaatttcagaacagaaaaccaaacaccacatattctcaattataagtgggagctgaaaaatgagaacacatggacacagggaggggaacaacaacactgggagggcgggggtggatagagtattagggaaaagagctaatgcatgctgggctcaatatctaggtgatgggttgttatgtgcagcaaaccatcatggcacacttttacctatgtaacaaacctgcacatcctggacatatacccaaacttaaaaaaaaaaataaagtatgtttaaaaaagaaaagaaaatgaattactcaaccatgttcaatatatcaaaatataaaataattattaaatatatgttgtaagtatttacagtaagtgatgatattgcttaaaatacataaaattacagattttatatatttaaatatatacagatttataagtgaagtgaagtgaaaaatacagatttataagtgaagaacttttttgtaattcatcagatgtacatgcaagctagacacattatacttgttatctcaatgtgttttgaagcaaataattatacctaaaagcagagttgcaaaatataaaataattattaaatgtatgttgtatttacagtaagtgatgatgttgcttaaaatatataaattaaggaaaacagatttataagtataatgaagaatttttttgtaattcatcagatgtacatgcaagctagacacattatacttgttatctcaatgtgtttttgaagcaaattattatacctgaaagcagagttgctgaaaagacttcagttatcttcttttaccagcagatgacagtaatatattgattaagaggtttaggtgactaacacaaaataattatagaatctgaaaaattgtcttctaacgtcccataatacaatgattaaaatgggattgcagtaggggaggcagtactttaaaaccaattacacaatattcttggttgagcacttagagcgggcaggttgatgaactgagatcactggaaaataaacctgaagaatttgtactcaaaatatgtctctgaaaatgtcagagactctttatgttaagtttactgctctaggcataacaaattatttagtctaattaaaatccatctggttttggctggaaatatgtatattttatttatcttctcttctcacagtattgagattatcagcaaatatgaagatattttgacaacatagactattctaaagtgtagaagatttttgatattgcaaaataattccttggaaaatatacaagataaacttttaaaattccagttgtgtttaaaggggtagagttcagtgacactcttctctattagttgaaagaaaagatcaattacttggtaagtgacactgacactattttattcatcagaagcttttaagagttaccactaacattgctctatgatatgtactagttaatactacagcatgtcccttgccttctgagttaacagtttgagaaagtcaaacttcattgttgagtatcagctttgataggcatttgggcattcttccacttaaatctcacaaaacactagacattatgggtataattctccccattgtgtagaaaggaaaactgagactcagaaagattaagtaactttccaaaggccacccactaataaatagcagacttgtggttcaaacctaggtttcctaactcaaaagccttagatcatttcacaattacatattgctatctacaaaaggcagatattcattccacaagtatttattaaacatctatcatcagcaatgctctggggatatagtctagcaaaaggtagacatggagtttatgatttggtggctaccaaaagtaataaatgagtaatttacagaatactaattgtattgcgacatgtggcagaaacgaaacatgtaagttatactaaaggcatataatggagaaatctgaattagtattgattaagaggagatctggaaaggatttcctgataaagaaaggctttaattgtgatctgaaaaggataaaaagttagtttttgtttgtttgtttccaagggcagtgaacaagtatatttgaaatagaaaagtataagaatcaaagtactgtaatagttattaggtttggcaatacaatgaagacaggtttcatggaaatggtagggtagtgtagaaactagattgcgaaaaaatatttcgaaaggcttgatcatagatggcttcacgcagtgatgtatatccttttcataggctcataaatatgaaggagaactatttcctcattaaatatttggtcgtggggtgctatctgctttttaaaagagtaattgagagtaaataattaaaatacattctataaatgtacaagtgagcagagattttcataagcatgcatgatataaagtgtgtaagtttactaatttaatactaattcaatgttgagtgggaaaattgtgataaaacggattatcaaaattaattttaaaaaaattagtagccaaaatgatgtatgcatattattttaatatgagaataccaattttataagactgttgatattattacataaaacagtatatgttagtcatgtatatttttagcaagcactcaatatgagacaaatattattaactcaataaattgcagttttattattattataaattgtgtatttgagacatcaaaattagatgtgattatattatgatcttctagaggttgtgtcataagtatcaaattttcattaaatgtaatgaagtatgttagatcattcttggtcttaaaaattaatttaaaaatagtaatttagtcaagggtaaaattcaattgctcctctccgaatcataaaggaaatccaaggtccaatcttaactttcagcagaaaatttgtataaacaaattcacagaaagtcccctataggtgtcattgatttcttcattcttttgtctattatttggtatcatatattaagcaccattccaagcacagtagttaccaaaagatatattcaatgaattgcaggctaaaaaatccagataattttcaaaaggaaaataagtaagtttaaaatgcaatttaaatcttgaaagagagcatatataaaggactataggagaacaaaatttttgttatggtttccttggataaatgaaataaaactctaccaagaaatttttaaaaaaaagtgtgtgattaatactaataaacatgttacaacagtctcattctttaaaaaaaatacccaatttgttgggagcacatgtatagttgcgaaaggcaaaatgttttacaaattatcaggaagaaaaccttaccttgaaaatgggaatgaaaaatttaaaaaagggataacagacatcttgactacagaattgcataattattcagtcaaatagatgaagcatgatcctgctgagatcaattaacaatgctttaaaacaatgcaaaattatatctactaagggaagtaaaatcaagttgtttgtacttcttagagaaaattaatctcagggtttatttcccagatgattaaaaataatttaggagagcataacatcaagctgaaacaaaacgttttgcacctagtacctctcatcctgagacttccaaacacttaacaaacaaatccattttccaaattttttagtgatacaaaatgttctttattacaaatattgaaccatttcattcacacaggacataaatggtatagtttggaatttacctggggacttcagtttgagcaaacattttatgagtgttttgaatcacctattgcatctataacgtcctcatggtcttttctttcagtacataaaactgaatgaaatttatttctatatacatttacttcctcaccagattttgagcatcttgagaagagggactctaattcatctttgtataccaagaatttagcacactgtgttgtccccaagcaaaaaagaattaaactaattgcattacctccttgagtagaaaaatttaaaagttaattatcacacagatctcatagaattaaatgtttaaatacaaaataatagagtggaatctgtagtatagaagagagttgcaggaatagcatgatttaaacttgttttaataagcactggatcacattgccaccatgtgattttgtatgagtcaaattacatagttatgtgattcaattctgtttctatgtgaaaatccattcacttctgtaagccatttcctttccataagcataatttctaagctggagtcatgtcacagacctcactgggatgctggagatgttgcaaacatgaggccgcatttgccgttttggaagtcatcctgaaacttcaaaaaggttcagagttgctaatcaaaaggacaactattatatgttatttgttattattattattatcattatttgttattattttaacttattgaaagggaacccaaataaattactggttgctagaaaagaaataagagcaagacagtactgtcttagctgggctgcctaagaggaaaatagattattggattgattttagggaggaatgaacactgattaaaatgtattataagcagtaggagaaaagtctattgtcattttaaaaaaatatttagataagtctcagggtaagatgcatatatttccaaggaaagaaagtatgaagcattggaaaagttagtgtaaaaccaaacacatacacatttatgctatgttggtaatgtcattctgttttcatattgtggatacagataaggtccactggcactacagaaaaatatttcagcatcagatgtagatttatggttaaatacaaggtagaaaatactttgcaccatatacaaggacaagtcattagttatgttgacccatgaataagaggtaatgcccattcaattggaaatatctgtgcccttttattggctaaataaattttatcacccaaaatgaatttacaaaaacgatattatatttttgttttgtaaactctataaccaccattgtgttaacatagttgggtgaaaggatcatgaaatataaaaagttatgattattcgaagctaactctgttgtacataactaccagaatattaccaaaaccaaagaaatacaaatacaaaaaggaggcatattagcagccatactcacattaaagtttctgaacatggaataatgttgcatttagcacagagtagcatttgatagattaattcagaataatagaaaaatatgaataggctctcctctgacagaattgggacaagtatctgtattaagacttttggataaaggtaatttaattctttaaaaagatgtgttaagccgatcatggataatttactggaattatatattcaacaaatatgaagactgagaaatgccactgtattttagcagttaatccatcaccaaataattattgaagcccgaggcacaaatgtcaaatgagtataaaatatggcatgacaccatttctatcttgttgaaacataactcaagttggaaaaataagacatacatggtaatgacctggaaattaaaaaataaaactgattccataagctgatttttaaaaaacaattttaactattatatacatatgctaaaggaagactattttatgaaatgagataagtaagtttttagttggagaggattcagaagagtcaaataaatcatatgactaagacccatagagaggaatgtccaagatgtagtcaagagcagtatatgcagaataagttgcttttaatacgttggtctgaataggttgatacatataaggaaacacagaatgtaacttcagaaaataatcttagggttgcactttggaaagacttgaaattagctgttttagggtcaatgctaagctgctgctgatgctgccaaaaaaaaaaacaaaacaacaaaaacaaaaaaacaacaaaaacaaaaacaaaaaaaactcacaacgaattgcttaaataagataccagttatttcccttcatgtgactctctcattgctctaggctaggagagactggactgtgccctcaggccatcagggactcagtttgttttccaacttgctactcaatcctcccctagggcattgcctttgtcctttgtctataaggagaagctgggttgctgcaaatattgaattagaggctactgagttgaatgagaagatgttaagggaaagaaacaacaacagcaacaaacttctctgggagatgcacagcagttttgttgttgctgttgttgttgttgttgttgttgttatcgtttttctatcaaggcccactatagttcctcatggaacagagacctggtggagcagaaaacagatggttacaatacataaccccatgtgggtaggcaaataaagaggaatattccacagttaaagagcatggccatgcatagatcctgccggacagagattctgaagcacttactgccctggcagaccctggtcctgttctctaggaggtgctcctttctcctgcatcctgtagtcccctggcattttcttctgaatagttctttcttgtccacattctctgtggtaaaatttgaagtgggtgttgaagagtaaactatctttaggagtgctttgagcttataccctacctctgctaatgcaggtttggtgcttgaaaattgacttggggattgacaaccagagttttgcagatgactcatataatttatttggctaaaaccacccctgaaaacttactaggaattaatttatttgattccaggttttttttggtgccaaggaacactcttcccaacccccaacttgttcaaaccatggcttacactgccttttcattggagctaccttgaggtgatctgaaacaataagcttggacggaaatgcaacattccttacctgatctttggccccaaggctgccttccatccttagactaagaaacttatatgagattctgataaaccttcttatcccctgctatacagaagcagttggtttctccaacccgtaagtccccagaatttagactctattcactctcttcttgaaaatggccaatttatgcctgagctcttctctgttttatatataatgtcttacttgtttacattttgggggtacatgtgatattttgatactatatacatgcagtgtgtaatgatcaaatcagggtaatgggttcttgtgtgtgtaaaagccaaatcaaactgtgtttttcctctactccgacactaaaacaatgggcacagaaaacttctctgaccacgaagcaagcaatcaatttttgcagtggacaacaattgggtgtcctccaattcaattctgacattgtctacctggcaatagtatcagatctcataggttgagggcttaatccccaagactgaccccccaggcaccaggcaaaagtctgggcctctggaacctttgcctgacaatcttccagtggagttttcactagggagactcacagaacttaaggattcacttgcttacgtttaccagtttattacagaagatattacacaggatacagatgaagagatgcataaggtgaggtatggaaagggttacagagctttcattccctccctggaagtgccacccttcaggaagctccagatgtttagctatctggaagcacttcatgccccattcttttgaggtgtttatggaggctttattaaagaggcatgactgatgaaaccaatagtcattggtaatcaacttaacctttagaccctctcccctccttgaaggccgaaaatctcaatcctctactcctgtcttggtcttttgggtggccagcctcaaccttgaagctttctagaacctgccaaccatcaatcaatttattagcatcactttggagtttctaaggattttaggagttgtatgccaaaaaaatgaggccaaagataaaatatatatttcacaatattggagtccaccccagtctttgaactcagatcccttacatcaaaaagacatacaactcaaaacgtatggccaaatcactagaactccagttcatcattaataaatagcttagtctatcatattgtatgaatgtctgctagactgaggccactcaggtgcaggctttcgttcaatcttatcagcttccgaaagcagatgtggtctccacaaacctatagcttcaccctgtcagacatctggcataattcagctaagaaacaatgtcttctctagctctgaatctccttcaaggtgttaactaatattaggtttttctcaatttacaacccattcatttattccataaccttccagttactctttctccttttttccatcaatgtccaaacttttttcacctttggaagggacgttagaatcatcactgtgctggtctagattgcaggcagcaacactagtgggtagcacgtgcttccccagcagttcattccaacacttacttagggtatggttacataggtcagaactatagggccatttttaacaccaggcaatataggctgcattcactgttaactcaaattttgccagattgtaaaggcacaacccacccccatcaggcacttaagaattatggcagaaggttcttttttgtgtgtttgttttttcttttagaaatcattcttgtttcgatcacttgtagttgcagtcctggtcctaggaccacttaccaagtaaggaaaggagaaaaaaaagttgaggtgatgtgggaagaaagaaaaggaaagaagcataatcgtataatcattatactggcttactcctcctttggcaataatcacatagtcataccagtatccttccccatccctctttcccagatcaaccagaaaaactgaggaaaatctagtgaggacactcctttagtcccactcatgttgagtattagcacacgtccatgaaggtgtgtaagccagcccttcatgctttcatctccccctgttttagacaaccaatgttttaatgtccattccacttttctattaaactttctctgaggaggatatatctttgcccattgttgaaaatgatgggctgtagagtatgtttcttggtctgaagaaatgaaagtcagatgtccaaatctgtatattttggtgtgtgtgtgtgcatgcatgtgtgcatgcgtgtgtgtgtgcatgtgcacgcgtgcgtgtatatgtgtgttgtaacagcactcggggcatttgtatctttcacaggacaagcaaaacccagtccataatcagtgtctattcctacaaagacccattcgtatcttcccagggattccagcatctgtctcacttgcaagctatgttcaggacttcccaccagggaatctgccccgtatctgtcagcaccctctgtctctcctgctggcacacaaaaccattcttattgacattatgtgcctgagaaggtataaaaggagcctgatcagattcagcactcctgtatccactcatttcatggaccaaattagccctcaggagagcactccgggatatttgcttgtcaattccagtcaccttccatgcatggaaaagggttctgcatggccatcaacatgttctacttaatgtgagctcaaatttccatagggctgtgccctatgtgggcatccttttaataagataggtttctattgccctcctccctgaccatatggccaggtcattggccactacccacaagtcagtaaaaactcacagagaaggttctaccaccattcaatttttccatcactgatggaaaaacaacatgtaattcagcccaccaagctgatttacttttaccttgtttagtcaaagtagcagcctttcaaacaggatgttgtacatttacctttgaaccaccgtctataaaccaagcaaccctttgttggtcaattgagagccgtttataggacgctttcccattgtcaatagaacccagcagctcctcacacagttccaggatcagctcttgtggaaaagaggctccctgctagtgattgtcccctccttgccttctccaggtagaacgaccctgtataaaccatttccattttattatggaactcttcggggcactgctacacaattagagtgttccctgacattacttagcacagtatttcaggtgtcaagatcattttacaccctgtggtcacatggatagctttatttaacgttccacagcaaggcaggaaatgcccctcaggtgaaaaatttctagtcccaagtcctcgtagttgttgctgggagaagttcatgagcttttgccatgagtccgagtaaacactctacagagggctagaaaatgaagaatttgtccctaccagcactccagcttctactctacaccatgcatgcttggacaatataactggttcccattggggattttcaattaatattggtggaagggtggatttacataccttctgtttagggggatatcagttatatacaatatttattctcatgaatatgagattctgtctgtgaggtgggcggggggctgttagcaggaacccctttcactttgctgggagtttttttttttcttcttcttcttcttcttcttttcctttttcacccagtaaattccattcccctcacctttcaatgtgtctgcattcctaatccttcttggtcatgtgatgcgaatccagttttagctgaactaaggagcaaatttctacatcaaggggactgctaccctgagatcaccactggagtaaagtttacatagagtcactgtcacctcatcaccaacctcagaacagtgaaaagagactggaaaaaaaatcacctaaaattgtaattcaaggatcaaggagttgtaacaagaggtgacaaatatgaccactctgttttattcacttaaagctggaaaatactggaaacttctgtagttaaattacaaccctgataatgaaaccaacaggcagagtcttcaggaaaattgtgtgcataaatttcgtgtttcatttttatatgagtgtacatgtttgattcacattgacaagagagtctcagaaatgtggttgagttttgccttttgtttttctctaacattttaaaaaagagaaagagagtgaaatggagattagtagaatttattcaatcaccccacctaatatgtaggtaactccccttcatcctatttcagtttaaaggttaactaccctttaaactgtcctacacaattcttctgtgtccataaaaggaagtccaatttctcacctgatgatcatgatcctacacaatcctacccctttatacttctccaaaattgccttacgcttgcctagccacatgctctatttctgtcaaatattcactgcttatcaatatgtttcatgtattcttgcttcacaggtttgcttacactatttgaaatatctccacattttttctttgcctatccagatatttccattcttcaagatctaaaccaattcccaccttctccataaagcctttccaaactcttcagtccacggtgattaccttcacacaggaagcaatagtttttattttctattatatttattgaccacttgctcaaaagtctttaaacatattattttgccttttattgtttctttgaattctacatgtttctttaatttgtaaatgctctgtctattcaattgacttgtgaccataatcaagtcagatattatacttttaatgcgcatctttaaaatggtcactcttcaactcagatatactaagctccagatatttatttggttaaagaattgttttaattcaaagaaaaattggggagataggaaaatatgagaaatctcaaattatttcaaatctctttggaaactcaatccccttgggggaataattgaattctggattgaagccaagtacaataatccttatacaagcagtaatagtgtgcaattgggaaccacggccataagagtttcttggatgacaaggagtacaataaatcttgattattttgcccttctagagtaatgctcaacctttcctccctacagggataattctaaaagtatgggagaaaattaaaaacaagtagaagggcttgttccagttggtttgccttgttgcagctgaccttaacattagacaatgaaatatagtgataaagcttccattaataaaatcaaataaacctgccttcgaatcctatctctgccatttaccataagcatgtggaagtgagactattgatacttcaatttctttttgagtaccatcatcattactgagatttatttgggttacttaaacaaattaataggaactcactgattttaactatgttgtgagtttcttaatatcatcacattctaatctttatttaatggtcactggttcatactgaaaaggtgatcatttgggcacagactcattttcctcagaaaatatgtatttatgaaccttgagtttattgaatatgtctgatttcattccattcaaaccacattacatttaacaatggcaaaggtttcccaacgaagcagttacattgttattcagttcatttatctttactgagatcttaacatttagaatgtattttacctttttaagcattatacctactaatcatgctaactagttttgttactggttgtagttcatgatacaatacaatgagaattgcttcaccaaagctataaaaacctaattgaaaccaattatgacaattatctctctgtttgattgcttgcattagactctttcctcattctatactgtcagactgcagacaatttttcctgatgtgacctatccaactgtatttcaggctttattcagtgagcaagcatacttctgattaaaattaataggaattttgcatggattgagtgagaactggagttattaggattgtaatatgaatttaagtgagaattaagtattactggactttcttatttcaattaagtatgaaaacactcttaatcaagcatataattaaatttaagaggaaatgtattgtgtgctaattgccattgattattaataatatgcttatttatgcatgcaaagtctataatggtatatatctccaaactgtttctgaatgacaataactgagttctgcataataaaactattaatgaaatggaatcttgcaagaaatgtcagaaaggaaaaatagctcatacttcagaactcttcttctctaacttttcctgttgaaaaatcagagcaagtcacatgaactcacacaggagaacatcaataattatagactgcttcctttttgcaatcatgttttgttttctgggataatatagtttggaaatattttattgaaatgtaaagaattcatgtgctttaaaaacataattaaatctttattttagcctttaaaataatatgtattcttttattttgccattataagcttttagaaatgactcttcatgtgttataaatttataatttttttttattcatttatttacttattaggttggtgcaaaagtaattgtactttctgacattgaaagtaatagcaaaaaacacaattacttttgcaccaaccaaataatactatctaatgttcacttatttattaaacacctactgaacgctaaaaattggtcttcaaagatacaacattgaacaatatatactccttttctcacagagcctgtgaggtaaacttgtgagcaggtggtggagaggaaacccagataataaatacaataatgcatgtaatatttaccactgtattattagataataataaatgttaaagagaaatataaagtaaggaagggtagtggaaagtctgagaaaacatttcaggaaacgagaactgcaaatgcaatgaccttgaagcacagaatgcatggagagttgatggaatggcaagagtccatttgggaatggaataactgagggaaagactgagatgaaatgaaaacagaatgccaaaacaaagccagagggttagactttgaagccattgtaagtatcttttcaacccttttaactgatctctacctctgcctcttaaaacatatgtctatgacgatgtttttagcattataaattatttccttatggtggaaaagaaagatttactctggttttttttttttatcatcccaaactttgatcccctgcgacttactcttcctatgatttttgttgaaacagtgaatgttaacatcacaactttgcgaatgctgttcttagcaaaggtattcattgttaggaatacttttgtttcctaaatgtttgttttccatgacattaacaatttcctgtcttttatttttcatttatttcatattgagtgtaaccacaactttaaactctgccaattgtttaaatctctttctaatacatttaaatgttttaggcatttaacttcaattccttaaagaaaaattttcagagcactttaatcttctccatctggacatttgtttctattactagaaagtgttcttgatattagattcaactttcttcttagttggatattttcttttctgtatctttcaatgttctctttctttgttacagagaaacaccaggaacttccagagaatggatgtttaagagataaataatgcacgtgggcatacatgttcataccattctcaaattccatgatagtttctatgggtatagaaatgtttttcaacttttatgctggattcagagggtaaatgtgcaggtttgttacacgggcatattgtgtgatactgctgtttgaggtacaacgattctatcacccaggtactgacacaatacccaataggcagtttttcggcccacatcttccctctttccttcccaggtccagaagtcccccgtgtctattatttccatctttatatccacgtctattcagtgtttggctcccaattataagtgagaacatgtgatgtttggttttctgttcccatgttaatttgcttaggataatggcctccagcttcatctccatgttgttgccaaaaaaaaaacaaaacaaaacatgatttcattaattttatgactgcatagtagtccttggtgtctatgtatcacattttctttatccggtctggtgttgatgggcacctaggctgattccatgtctttcctattgtgaatagtgctgcaatgaacatgtgagtgcatgtgttttttggtatactgatttattttcctttgggtatatacccagtaataagattgctgggtcaaatggtagttctaagttctttgagaactctccaaaatactttccacagtggctgagctagtttgcattccctccaatgcatgtgttccctttttctccacagccttgccagcatctgttatttcttgactttttaataattgtcattctgactggtgtaagatggtatctcattgtggttttgatttgcatttctttgatgattagtgataatgagcattttttcatgtttgtttgccacttctctatcttcttttgagaagtgtctgtgtcttttgcctattttaattggattgtttttttgcttgttgatgtgtttaacttcctgagagatttggatattcaatttttttcagattcatagtttggaaaccatgtacattaggatttggaaggcaaggccctgtgctaatgttgatgttttgaaaaccaaagccattctgaattctggcactttgaatttgagctacttatttctgttgctaaaaatctatgtatcttcttacagttcacagttgttgttttttttatatttgacaatgaaggcattattttcctaaattgttctagatgcttgctgggtctagcaccctttcaattttctttcgatatggaatttcctttcagtatggaaattcttgtcctctgctttataaaaaagctatttgtttagctaatttctccccttaatgttactaatttacctttcaaaaatgcctattatttgaacacttttctggacttaaatgactactgctgctgctaccactttttctcttatttctatttcctatatctctgacttttttctctcccttatggaagttttctttaatgttacatttaaaccctatcgagtatttcatatacatatattttttatagccaagagctttcttttgttcttatttctatagaaaatcatgttcaagttttatatattttagagaacagttacattaggtttgtttgttcattttagaagttttcttctgttcttatagtcctcctttttctttcaaatttttcgattctgtttgttttggactttagcttctatgctagagaacttcttcagaaatcagatgatttttgtttgctatttctaagtagttaagtaaaacgctgaataaatgttctgagtacaagtgtggcatttgatacatttgtactttactgtgtagtgattgtcttgattgctttgttaagagacccattataacagcatttctttcctattgaactgcttatactcaaagtaaaagaattctccatcacctgcttagggaatacagacctagctgcagctttctgagttaagtagtgaaaaatgtgtgtggagcatgtgtcaatattttgcatggaaacactcacttattccatctcgtattcgtattgtgcctctcttttcaattgtatctgagacctactattcagagactgttttaccacattcagagacaagacctccaatatttagctgaggtagaaaatgggaagatgcctagttgcatgtttttggtcctcttattgcttcttaattgaattttcaagcaatcttcctgctttaagcatgactttcactgcctcttttagaggttcttaatgccaccaattcattagacttccaggaattctgagatataaactagattgcttcttagcttttcctactagtgacttaagattcaaccttctaatgacttctctctgttactactgcttcatctgattaccagcttccaaagtactgtttgattttaattatctcccattatctatattcttatgcattcataccatttaaaaacaatttaatgtttgagatgggtttcaggagagagtaatagaccacgtgtttcctcttttatctaaacacaaaattccacatctatgacttacacattcattggaaattgcataaataaactatgatgtggacatcacattaagtatactgtgcagtaggttaccgactttaaaacctctatgtaatcttaaatctaaaagaattatttcttgtgacatatgcaatcttgtttatgaataagtatgaaatatttataaatgtgtacatagacaatattttagaagatttggagttattatttagcaaatgtattgaatatgcctgcaaataagactcatttttatttaaatttacttcagtgtacacactatgtgtctaaacaataaaaagcaacatgaatattgtagaattgaaggacttaatttccataaatggaaaaaatataaaactttgttgaatcaggaaccaattttctttgggggaaaaaaacctataccaaaatataacattattttaaacatgttcacatctgcaggtgtttaacgtgataaaacagtaggggacactgccatgctgcctttaagttattatactaaaaacttaattactctgtaattatagacaaaactacatagtgaaatatacaagatgcattgctataatatgtaactaaatgtagttgtcagtaataccatgtatttctgaaatgattgatcaattgatttgtttcaattgttaatataacacacagagtgtactcaacaaacaaataagtgaagttaaaaaagagaggagaaaggaatgaatagctagagcacagaggatttttagaccagtaaaacctattttataggaaactatgatggtagatatatattgtacatttgtcaaaagctggagaatgtatgacaccaagagtaaactctaaggtaatctataggctttgaatgataatgatttgtcaatataaatttattgatagtaacaaatgtatcattctgatacagaatgctaatcctgggggaacacgtgagtgtgtaggcgaaggagatgaaaactttctgtattttctgctcaattttgctatgaaacaaaaattgacctaaaaagtaaagttttttaaatttttcgaaaaaacccctcaaacataatagttaatattgatgcagtaaattttaataggcctccataatcttaatcctgctataatctttcacagtggcctatacctagcttacaaacaagtagctttcacattgtttaactgagccaagaaagatatttactatgtatttcgttaaagtcttggcaacttactacatatttcattaaagtgttggcataggttacagaaccttcctccatcttcaattgcccctgatctcttccatctacttctcttacactgttctagtccccacactcaattacaggtcattcattgtgcctctacttcactgacatcaagagatcaaagacatttaatggttgtccttatattgtcttttatattatatctgcaaaagcaagtgattgagctatttttttcctttctttcttacaaaaaacactcactactgaaaacgatttcccatgacactgcccattaccctattccaagctttttttttttttttcaagcttcaggtgcttgttaacgacctttgtatttcaggaaatacatgtgatgttgaagtctctggaacagaagcagactattgaaagagctgagatctagaacccttggtattacaagtcagaaaaaaggtgttttgaaactgagccttcaaatggaattggtaggctaggaaaaataatcatctctgtgatgattatgattttctttattgagtaggaatgccagagaaaatacaagtccagttaaacatgaatttcagataagtaaatatttaatataagtatatctcaagtattgcaggaatgctctgtatttttatttgctaaatctgttaactctaattttggggattctggataaatgaaagaggaggattctctaatgtacaacagactgcatttcccaccatcatgatgagaaagaacctaatggtgcgtaaaagttacataaatatatagataggtatttactattcatatctataactatatctctatctatttaacttttacttggatacatatatataatattcatatcctatattttatatatatatatatatatatatacacacacacacacacacacacacacccccacacacacatgcatatatagtgctcagtgttaagggtttgggaacaaatccatatccacctttttgccttcacttcctctcagaggataagttgtacatccttctcatacagatattagaggacaacttatggtatgaggaaaggtgtcatccttgccaaatgccttcagttaatttattaggaaatgtcattctctaataaatattgggcggaaacttcagtccctttctcactccacgagatacttatctaatttttctcttgcatgatagcttctttttgtcttttctctcttaagctattagctatttgtctgcaaatgttttttgtactcctcttatttttttctttttatagagtcatggggccacaagaaaaagaaaaaaagtcattctactggaaaactgaaaaaatatatttgatttggctcttcaattatgcataaaaactcactgggtaaagatggaatgaaagactattcagaagaagggacattttgcaaagccagaggtatgaatacacatgacttatttgggaaaggtgggcagattggggtgaatagactttagaagatactgttatatagacaaatggacacaaagctttaaagacattttggggccagattgtaaagaaccttgtaaacattgttgattaccttagattttagcccacagtcagaacagcacatgaaacactttcacaaaagttaaagagcatgacgaggattttattttttaaatgtaattatgaaaagagaatcaaggctgaattggaacagagagcaggagaagactagagacgacagaaggagacttcttcaactagagaaaaaaaagtcttgaacaagtggtaaactaattatttcctatcagtcaattaaagtacctttcacacttagaaatttatcatggcgttttatttcccattgcagaaagactgaaatcttcctggcattaatgacacctatgatttaaattcacttttctcatataattatttcttactctactggtttgtctaagcgtgttcttaaaacttgtagtaaagtgattttaaaagtatctcaagccctgacattctgtttgtgcaatctcaggtaagtacttaacccctctgtggaacaattttcttacttgttttattaaggcatggtctatgtctactttgtccatttttgtattttagcccagagtacaggacataaaaagtgttcaataaacattcactgattaaatagagtgataataatatctacctcatatacaggctgagcattactaatccaaaaacctgaaattcaaaattcttcaaaacccaggatattgtgagtgtagacaagatgctacaagtgggacattctatgtctgacttcatgtgatatgtcacagtcaaaactttgtttcatgtacaaaattattgaaaatactgtatagaattgccttcagcctatatatatatataacacacatataaaaacataaatttcatgtttagacttgggccacatcaccaagacatttcattatgttatgcaaatactccaaaaaaaaatccaaaacagttctgtactagacagtggtcccatggggatccaatcaacaaatgcaggggataaacatttgtgaagagttaagccatgttaaaaagttagtttggttattatttggtgccaaatcttatatgtatatattattattactgtaatgatgttgagtccacttataaaagtaatgtatatttactgtagaaaaactttataataaattatgaacaagtgaacattattatgccatgcagagataattagcaggatgtgcttatctccaagcttttctatagaaaatacacattttaaaacgatcttatagtacagaatattttatacatcatttttctgtcaataataattgtaaacatcatataatcattttatgacaatcttaatagttcaatataatttattttatatattcaacaatgtctttaattatctgtttattagatagcacaacattgttctaggtggacagaactaaatggagagaatgttttatataaaatgcttaccataagaggattcagcactggtgtcatgtaactaactatatttgagaagcatatacaatctttataaatgtagttgttcctattgtataaaaatagtaaaaataaaccaattaatgttgggataatcatacatgaatacctatttatttctgtaatacatctaaaaagattaatgcaaacttcaagttattgtgcagtggttacccatgtggaattcaagttggtaccaaaattgatttctattctagctttgctttttattagcttggctgaccttcagcaagatccttcatgttcatcagctccaacttttgtatatgtaaactggagataataacttccacacgtggattacttcatatcataatcactgcacatatgccatcatcctgttaaatttagtatgtgtatgttgtatatacatactatatatgtgatgtattatccatgtggaattggagttgagaccaaaattgattcatattccagctttgctatttattagctgggtgaccttcagcaagatttttaatgtttatcagctccaatttttggagctgataaacatacacatactaaattgacaaagaaagtgactaaccaccattttaaaatatcctttcttttccttccacttcatacactaactcagaagggttgtgtttgtttttgtttttgtttttttttaaaaagaagtccataattacattttaacttagtattaaaattttttttggacagactaaatgattatttattttgcaatgttagatattaatatgacttaatcattactcccttaaagaagtagaggaagtgttaatagtaaccttactgaagctctctactgaccattttggaaactgcagcccatttttctattctccatttaatataattaataccttgttttcatttggaaaatgtgcgggattatcaaaatccccaaaagaattaaacagagccaacgttagagatattgtaatctgaaattacttaaaaaagcaatcaaatatttaatttcctgcttgaaataaattatttctttctaatttcaatttccaatagatgttgagtattaattatgactctcattatgctaattggaaacaaatgtactttcatgatggtattagcttaaattatatatatttaaaattaaacatatatttaactatatataatttcaaatatatatagtatatatttgcaactgaaaacaacagcacattgaagacggttcatttatattttctttatctgaatagcttcttaacaaaatgtcaatgactaaaagacaggaacttataaataagttatattttagacaattctcaaggtcaacaattgtgtacaagcctgtgtaaaatttagatttcaatttcttaagcaaaaattattatcagagtgatatggttaacagacaaaacattgaaacagcctttattcatcattgagaataactggtaccaagtagattactgttgatctgtctgcatttttggattggcatgactatttttaaataagatggtttctagtatacaatatgatctgggtgggataatattataagctctatttaataacaccttaaatttaaaaactgccttattatttttttaactaatacattttatgctggatttttccaacacaaaatgtgcacacatctactctataggttgaaagggcatttttagctgcccattttcatggaggatgggaaaatagaggcccaaagacattgagcagcctgctgaaagccacaacattaataaataatggatgtatatttttatgtgaggtgaatgattttttcccattacactatgctgcatttcatcactatggaaattataatttccatagctatccaaagttcttgggaaatggaatacattaaaaaaatgacttattaaaggttaggaaaaaggacagaagtatctggagctgaagatgctgcttcccattgctggagctgctcttccaggtgcagggccttgattattaacatgagtaatgagaatagtgtttgattttatgctgataactctcacaattatctccagtccaaatctcctctgtgcttcagatttatatacccaaatgcctgttgaacatctccatttagatgcctcatgggaatctcaaatttcacgtatccaaaatgggcttcatgcttttcttcccagtttttgccatcttaataaccggcagcattttaccaattgttgaaaggagaaagttgggaattgtccttatttctgtgactcctcttattctttttttttcctgattcatctgtggattataccatatctacccccaaactatactgcacatttgcgcccttctttcaatctccattgctaccaccttatttcaaaccaaccaagtctctcactaggatgctgcaatatgcccctacttggaatacctatttccatttttgcctccttgtaatccattagtctacatagcaagagtgataatcttaaaaggtaaatcataacatgtcactcccagtttaaatgtttcaactgactctcattttgtttataatatcatccatgtcctaaaatgtctaggtgtcctggcttagtgcacactatactacagctaaagaggcttcttttcagttccttgaaacaaagcaaatctatttcttttatttatttattatttttattatactttaagttctgggttacacgtgcagaacgagctagaagaagggagtaagtgtagaaatagatttgcttcataacgaaatgaagatgaagcaaatctatttctacacttgctcccttcttccagtcttacgttaaatgtcacagcctcaaacagccttttattttttaatctccagtttttaatagcgtttatgcaaaataattactgaacaggatatttgcttctttattatttatgaagaacaaaaatttcttctgtatagaggttataactatttgttcattaatggttcctagtgtattgtgcaatctgtagcatctagaaagtgctgagtaagtgctagttgaattaattaattaggttgaagtagaaaactcaccaggaagcaagatccaattgaaagggcctctccagactatttgcatctctctcagaaccctttgtagagacaacttcatgtgaaagatctccttgtattattttaaactagatctcattgcataggtttacccatggattaaaatcttttcctatggtcatagctctgctaaaaggattctaaaatgctaaaaacaattcctcatttcaaagctgggttttgcagatatttattgtctgaaccactgctagcatcatttcaacacagcaatgaaattcattgagagtgtggttccctgtattttataatatatgtcctcatatattataaaagttcaaaatcctcatgggcttacagtcaaaggttaattgaaattagtcataacaaatttcaaaattatgattggagctctactccaccagtctcttccactccttatgtgagtcagaatgacacaaatcaacattaaaacttgagttaaagaataaattgacagctgtttattagatttttgtttttgataaggatactatatattatcagggaatccatcataaaatacaaaacttgtgcattcttcacttaatctaaaaacaatgaaacttgaatttttaatgaattacatgatatgataatgttttaaaggtagccctgcttttcaactttggctattactacaaccagagcattgtgcagagacagcatgtgacttttgaaataaaaatcgtatgctgatttttaaaaaaacctttagagcaggaagtttatttctaatttatcccatgtaaatcagagtattgcatgattcgttcaatttatgaatgcatttaatagttgtataatatttatggaaaatcaaatatgcaatttttcatttatttttctctccagttgagtaggattgcttttattttataaaagaaatttcaacatagatgttttggtattacacaccctatagctataacccaaactgccacagctagtatgccacatgttctgttactaaaacagagccacaaagctggagaaaagtaaagtaaagcaaaaacaatactctattgatggcgctttcacaaaattgtaaatttactggaagcatgccaaatcgtaacacttgacttcatattcattctattgctataaaccagggctagcataaagcaactttcactgcacaatggctgcagtttttgcttaaaattaattgcacatgtgtttaattatatagcagctcttggaagtgattatataaaatgttatttcttcttagtcttgcttggatctctcaaattatagttctctaactctgaaagcaacaatgaattttaataaagggcagggcttgcaaattactgttgcctggctgctgctgccagtgactgaagagcctcttttaaaaactgaatgaggttctattgtctttgtttacttgcaagtgagaaggaactacaattacttgattaggcctccagggggcactctgaaaaagactagatgatactcctttgaagtatttctggagatgccaccatcttggaaatgccattgacatatgattgttcaaaggctttctttgatatttccttttattctgaaaaatttccaaaaagcaatattatctgcattctcaaagaacttggtaagcacttatgtcaaggttgcctagtttttccatcattcttagaaccttatgtagttcaggcacactgaaatagatgaattatctttggttcaaactgccaaatctagctgtattcaatttggacgcaatgtaaaatagcaacttatctgtaggtatagactttatactaacatatagtataggtttgaatatatagctctacaatgaagctgaaaggagaacgtacacttgaatcaatttcaaaatcaatacatttttcacctgagcaattgtccaagtatttggcactttgttagaacaaacctagtatttggcaatttatggaattacagaagaataagatttcgctggtgactcagtttacagagaaacccatattttttcaactgaattgaaaaataagttctagagttctgtactactgtaagatgactgtacttaacaataatacagtatagtttctagtaaatagccagaaggaggatactgaacattctcatcccccgaaaatgataaatgtttgaaatgatatatatgctaatgacctgacctgatcactatgaattatatgtattgaaacatcactatgtagcccatgaatatgtacaaatatttgtcaattttttaaatttttaaaatgtgtttttataattatctattttatttatttacttatttcctgagacagagtctctgctctgttgcctgggctggagttcaatggtacaatcatggctcactgcagcctccaccatggacctcttgggctcaaatgaccctcttgcctgagccaccatgaccatctaatttttttttttagagatggagcctcactttgttgtctaggctggtctcaaattcctgggctcaagtgatctttctgcctctgccttccaaagtgtgtgagtcactgcacctggtcaaatgctctctatatatgttaatttttatccaatataattaaatatataattaaaatatcatataccactgaagcgtttatagtgaaaatttagttcttaaattcaaacctttctacttcctcagtccagctccatcaagacaaaatcttttaacattttttgacttttttattccaatggtagttaaactaaacatttgtagataacatgtacagacttctcttccttgttttatctacttttaaacatgtactattaaatttttcttatataggtgagagtttcactctttaacaatgtactatctcctcctcctgtcctcttttcataagtatgcatctatttttagttaaatcaatgatgggtgtttatgaattggctccttcactggagattcaacttgtcaacaaatatatatatttcctctgtggagtaaacctctatttcccccctatactcacacttattaatcacctcttttttcacttgcataattttctgtcgtaatattttttcccaaatgctctgccaatttcatcatgaagaggtaggtatcttagatttatgtttttccctggaaatctcctttccaaaatttttaactctgccccaagcttttccagtttatcttaaattgtcctattttattagaggaaattagtgccctagataaaaagacttcactgacacatttcacaggctaaggaagagccagagagcttcatggtatttccctatatcacagaactcacatatcacaaatgtaatcttgggtttttggctcttaccccaggtactgttcattttttaacaaaataaggtacatatgttttctatttgaaatcatagaaacattctttatcacaaaacaaaaagctttacaaattaagcttataaagtaaaaaagttatactaaaataatattaatttattattgaagtaagaacaatttttaaataaatttagtatgcctaaatgtactggattttaaagttctcagtagtgtacactaatggactaggttttcacattcactcagactcattcagtgactcagccagaggaactttcagtcctacaagctccattcatggtaagtgccctctacaggtgtcctattttaaaaaatatttcatatggtatttttactatacattttctatgtttagatgtacatgtacttaccattctgttaccatcatctgcagtattcagtatggtaacatgctgtattagtccattttcacactgctaataaagatatacccgagactgggcactttacaaaagaaagacgtttaattggacttacacagttccacatggctagagaagcctcacattcatggcagaaggcaaggaggaggaagtcatgtcttacatgaatggcagcaggcaaaaagagagagagcttgtgcaggggaactccttttttttttttggagacaaagtctcactctctggctcaggctggagtgcagtggcgtgatttcggctcactgcaacctccacctctcgggttcaagagattctcatgcctcagcctcccaagtagctaggattacatacacccgtcaccctgcccggctaatttttgtattttagtagagacggggtttcaccatgttggccaggctggtctctaactcctgacctcaggtgatccacgtgcctgggccatccaaagtgttgggattacaggcatgagccaccgtggccggcagggaactcctccttttaataccatcagatctcatgagagttattatcatgagaacaacacaagaaaagcttatccccatgatgcagttacctcccactgggtccctcctacaacacgtgggaattcaagatgagatgtgggtggggaccagccaaaccatatcacatgctatacagatttgtagactaggagcaataggctatatcatacagcctaggtgtgtagtaggcgataccatctaggtttgtgtatgtacactctatgatgttctcatagcaatgaaatagcctaatggtgaatttcttgggacatattcccatcattaagcaatgcatgacttaacagaatgtgcagacagaagcagcaaaagaataaaacaaccttttctctctagtgactataattgtaatcaaaatagacagaaaaaaatgtcatttttattctataacctccctcctgtaaggaaacacagatgaaacaactacatacattaatttaggaaagtagtgatatactaaaacataaaacataagtaatgatatactattttgcattagaattgcagtttacaagtagactttactctcacttgctttcatcacgtttgttcaggttagatgtggacagttataatcatcttttttttttgtcagtgtagaatagaagctgaaaatattgctctcccaccaaatatggcctgatgccctttgtatttaaaattgcattggaccacagctaagctcctttgtttatatgttatcaacagctgtttttgcactacaagggtagagctggtaagttgtaatggatggaaactatgtgccctccaaagcataataaatgttctgtctggctctttgttgaaaatgtttgctgacccccaagaacgagactacaaaattgcacatgtccccctatattttgatttctttatagttatgcagcaaatttcacaatgatacacaaatatatatgtatgtgctttggatgacagtcatttcacttacaagtggctttactaccattgccatccatcaaaattctatactctttttccatttaattttcaatgtttcattattttgcaatcaatgatgaagtaaccaataatcctaagagtgaaacaatgttaccttatcacatcctgttcctgtccatgtgcatattctattttttctatttgtaataggcagaaatttatattcttcatttttctgtctcgatgattccttaattggatgtagtttttaatttttttctgtatattcttctctattctccagtaccccgaaacccctcaatccatgttaattgcctagtttttacacccttcaaccttttcctcagccttgtacaattacatagattcaaatgcacatgtatagaagttcttatcattttctcatgtaactgtacaccttgggagtctaactagattagtttataaatatctggtcaaatttttaatgattgccttatatacatgaatggaaaaaaatgtattcaattatttctctattgatggctattcagggcattatcaattccacaccttttcttttcactaaacattacatttagtacaattcttgtacaaatattcttacatactatcaagtttgtttctacacaatagtttctgctgatgttaatattttccttatctttaaaccagtgtttctcaagtatgaaatttcggcatctagttgggcacggtaaaaatgcaggctactgtgttctccaaacagatatactaacttactaggcatgggatgggatgtggtccatgtatctgcatgttggtaagttccctatgtgatgataatgtacactaaaccactaattcattgctctaactttatctaaaagaattcttcttatctttcttcattgaaaactttcatctggatgtaagattttcctccttggaatgaacatggtggtggctaccttgggacctttatttttcttattcatatttttattttaatcaagccaaagctgtctattacaatttattaaaaaattattttcaacaagaattttttcccaaacttctgatctttttttctcccgaaatataataaacatcaattatttttctttttttttttttttagatggatcctcgctctgtcacccaggctggagtgcagcagcgcgatctcggctcactgcaaaactcagcctcccaggttcaagtgattctgctgcctcagcctcccaagtagctgggattacaggcatgcaccaccacatcaggctaatttttgtatttttagtagagatgggatttcaccatattggccaggctggtctcaaactcctgacctcagatgatttgcctgcctcggtctcccaaagtgctgggattacaggtgtgagccaccctgcctagcgaatattaaatttttttaagaagatattgacagtgtcaactaggatctggtgttttgaagtaaaaagaaagatatatacttgatatttactgaacttaagagtatagggaggatccaggcaaagataaacaacaaaagaaaacaagtatggaagtaattaaaagataatataacgatttttaaatcattaggacacctgctacttaacaatatacctcacaacgtgacatcatttccctgtctgatttcagaatggggtttggcatacggccaatgattagctctctgcatatatttctgcacaatactgatgaaattttagaggccgatggtagaatgctttatcaagtctgcagaattaggttcagtgatacccaacagcaataactgcattttaacagttttaaaacttctttttctttggaaacgttattttaaccaaaataatataattgaatgaatgaatgaaaccttacaggaaaattctgtgcatttcttacagcatattaagtccccattaatgttgaagattcctgaatctttattacatggtgtagtgtatttagcaatgtgggatggatggtggtcagaaaccgggaccagagaatcagactttctggaattgggttcaggctggaccagttacaggcaatgtgacccaaggcaagtttcttctcactgcatttcagtatcctcttccatacaatatggacaaaaagcacctactctgtagattggatgtacagagtaagtgagataaattatagaaaagtattttgagaactatctggtacataataaccaattaataaatgttagaattatctccataataataatgtattcccacaatgtttcttttctgtccacaatataatatcatatataaaagatatctttattttgatcatttcgcacagataactttgaaatgttatcttgaagtttgtcattacaaactatggagtgcatatcacataaataaagatgaaaaaaggtaattaacataagtacatgaagaaaaatttcattaatcttttttaatgcagcaacattaatttataagtgtatatatattttgtcaaataccttatatatacagacatatatgaagtatgtaagggtacatgtagtgaatatgtgtgtatatgtatatttctgtgtttatacacttaagttgatttccctctctttaaataaatgtagatattgaaaatatcaatgagagcaaaatattttttcattttctaaattaaaacacccatttgaaatgtctttctagagaaatgtgaattttaatctatgttcttttacaaaatgttataaaagatcatgaataagcatctaccataaaagcttgtgtaggttctttgaaagaaaaataacattgtttctcagagttgacacattataatggttgatgttattaaaagtttagtaatatttcaaaggaacaaagataggaaaggatctgcagaaattcattatgtgtgacactgttttatgtactcttttcataaaaatgtgtcacctacactgaagcaggcaatgtgctttttactcatgatacagtgggaacagataactttggtctttggcctctaaaaggttgtaatctaatgaagggcatttataaataatttagtaattatactatggtacatgacttattttaaaggtatgagtcattccattatatctaaggcacaagatatttcaagaattcatctattgtaagttccataagagtgtaacaagtgttgctagtgccgtgctaaagaaaaacacctcgcctagtcttagggattcaaggaagtcttacggtgttaatgtgaaatctatattaaaagtatgaattggtctaaaaaataaatgtaacataattcttactaaagtaactctaaattaatctgagctatgagtaaaggattagctggagtggggagaaaacgaaatacgtgagatttccggtatttcataattatgtcttccttattgatgaagcagaaaacacaaaggatataaatgcttgacaaaatttaattttctctaattttattcagttatttaaaaaattaataaggagtcaagcaaaggtaattaatatttaagaaaatgcaatttttatccaaaatgagtttgtgtacagaatattaagtttagctaatcatggttacattcatttattatgttatttttgtttctatacttgcttttaaaaaacccaaactttaaaaatgcctgtattttctctcttttctttacccttttaaaacaattgactctgtttatgaaactaacccgttttacttctcctaaaaggtgtgtgtgtgtgtgtgtgtgtgtgtgtgtgtgtgtgtgtgtgatacacagtgttttctaattttaaactacatccttattttatgctcttggattttgaaaggttaggttcagctactggaagtatcatattttgcttttcaccaataatcaacatttcaaaaaaatcctctctctgacttttgtaaatatccatttcattttacacctgatttcctaaactagaaatttcagcgtgatcctgaagccttcgatgaaattacacagattcatggagtatgagcactggaatatcataatttgtgccacacaattttaggctgcttcaatcagaagatttaggtcacagaattgattcttaatttattaaaataataattctcttcacaaactaaatttagaatacatatagaatctatttctcattcctcaaacaacattaaatacgaaaaatatcaataataataatagcaactttcacaagtaaaaatgtacatattttatatattcgaatcaaattatcattagattcatccaaaataaaaatttctacttttactctatataggagaaaattgaatcttagaaaggctgtggggcgcagtggcttagacctgtaatcacagcactttgggaggctgaggtgggccggtcacctgaggtcaggagttcgagaccagcctggccaacatggtgaaaccccgtccctactgaaaatacaaaattagctgggcatggtagcagggacctgtaatcccagttacttgggaggctgaggcaggagaatcacttggacccaggagacagcagaggctgcagtaagccaagagcaccgctgcactctagccaggggcaacagagcaagactcattctcaaaaaaaaaaaagaatcttagaaaggttgaataacttgaccaagactacacatgcagtcaagggcaaaccctggatttgagtccacatttcactgcctcccatgtccatgttctctttgttccaccaccttccagtctagctatcataatgctcagataccctgatgatgtgctatgttaaattatacgtatttttctacatcttaaacttcttctagaagtccctcgcaatgactggaaattgactcaggcgtcatgacaaatatactcaaatataaaaagacacaaaattatatgtaaatttttattgagaaatttatttaaatacataatagagaataattttctccttttaataattttagtgtgtgtagtagaggttcctttctttcctcagtttctaactatacaatggctagttcaatttccatttaaatattttaagtatcagagatacaaatctggcctttggaaaatcactgaaggtcactaaataatttgtttgtaaaacaaggaccgtaatacctaattcacagggtcttagtgagatgtaaatgaacaagctatataaagcacccaacaaaatggatcacttgaggtcaagagtttgagaccagcctggccaacatggtgaaaccctgtctattctaaaaatacaaaaatagccaggcatcatggcgtgtgcttgtaatcccagctactggggaggctgaggcaggagaaccgcttgaacccaggagacggaggttgcagtgagccgagatcgcaccactgcactccagcctggatgacagaggaagactccgtctcaaaaaataaataaataaataaataataaaagcatgcaaagttctcatttaagtgaaccaaaacctgaataacttgatcccaaagtcagctctgaatagccatggcatatatgccacctcaatagaagatttcacatgctacttctctatgctaagtaattgagaaggtctaatgtattagattttgatgtaggctatctctaactttcaggttctcacaacaaagtgccatgtatgaaaaaagaagatttaaatgttgtctttctgaataaaacttattgggcaaatttccaaatatatctaaaagtaaagtaggaattactttatattaataaatgactaaaaattgaagtattacttcagaaagctaggcatttatacctttgtatattataagactagatcaaaagagacccaatatttaaaagtttatggagctgctggagtaagataaagattctatatgcagaatttattatgttcatggcatgaataagaaaagcacattataggcagattggttcattattggttatcaaagacaatagattaataattttaagtgaatataataaaatctgctgtggtgaggataaccatattcacataaagaatgaggtatatattgatatctcttcagtagcaaaagaaaactcactgatggaaaatatacaataagtacaagtttaattcatttgcaaataattcacatcttcccaaagttgtctttgttatttctattggtttcttattaccttactctagccatggatgtggctacagactggatacatactgaactacagcttttctttcatgctatattaaatactaatgtggcacatatacaccatagaatactatgcaatcataaaaaatgatgaattcacgtcctttgtagggacatggatgaagctggaaaccatcattctcagcaaactatcacaaggacaaaaaaccaaacaccgcatgttctcactcataggtgggaattgaacaatgagaacacttggacacaggaaggggaacctcacacaccagggcctgttgtggggtgggggaaggggggagggatagcattaggagatatacctaatgtaaatgaggagttaatgggtgcagcacaccaatatggcacatgtatacatatgtaactaacctgcacattatgcacatgcaccctagaacttaaagtataataaaaaatatatatatatattaaaaaaaaaaaaagaaaatcaagttagatgtacctaacctgggaagtgactataacaatttctaaattcaggggacagagtgctcaccattaccccatggaaccagctgttgactataacaatttcttatcgcatttatatatcccatagatttatacaggatctgaatattattttatatataaaatgcttttcataaatgttaactaagaaaattttatgaaaaccaagatagattttagaaatgcaaatggaatctacaaatctacctcttttcctagaatgtgggatttcatgtgcactttccctcaaaagacttcacaaatatcaactgttctcaagtaattcatcccatgaatcaggtgtaggcagggcataaaagatcagagagaagcctttaaatttctgtgacatgccagcatgaacacagtgtaatttgtacctttactggcagaaaatcaggaatcatggacatatcacacctacttgatgtttggctttaatcagtagttcaaactgaactcttcttaacactgttacctttgccacagaggacaaccgtacccaaataaaaacttcacagaaattattattcttttgtgtgttttttttttagtccaaattgaaatgtttaagtcattagtgaaatctacacagctctttaattttggatcagagaataaactcttcagtcagtttagatttaatatgattattttctttgagtataatctgaagattaagtctaagtatacaattatgaagcccatacagcaactttaaaaaaactattacaatgattttataatttcaaaaaacacattcaaaaggaaaacttgatttgcttatagttctctatacttacttggcatttagtttccctattttattaattcccttcatgtatccattttcatttcttcattttaaaatagataattagtctttcttttattcatttgtgaaagttctttatacaatatggatgtcatatattcttctataaactaatctttattcagcatgcactgtgagatacatagatgctggaggtacagtgacaataaaaatccctcccctcacaagcatacaaggaaatctaaactgtgtacataagttactaacaaatgctgtgaagataaatggttaaaaagcattaagtgacaggataaaaatggcagttagaaaagcctggagaggctactacttcagtagaaaccagaaaaaagtgaggcttccacttcctactattcttgggggattcttttctgttcatgtgttgctatgtcattgtgtatatttaattttatttttatgttattttgttgttttttaaatttttatttgtgcagatttatgaggtgcatgtgaagcttttacctgtcttccatgtgtgtttaaagaggatataattgtggtgtgtataattgaggagcagatataggttattgggttcattcatgctaactttttgaccaaaccttagtaaacttgtaatgcatgttcggttatttgagtatgatactggcatcagtattacacatttatgaagaatctataaggatcacaatttctattctgggtacagtgtataacaaggatatatcttctggtcttttgagttatctgtcttccaatcaagaaaacagttctaggaagattcattgtttctttccttcactatcttcaaacttttacattcagtagcactttctacaaatatctacaatatcatcattttactctttcagtcctatgaaacaacttgactctgaaaaatttagaggaatgcctaaaaatactatggagaatggataatttaataaagatatactcacactaatttggttgtttttatatattaatgtgtcaaatacagagaacaataaaatgttattcaaccaaaattataaagatatcttgagtctagagcacagagtagattaaatatatggtgtttcaggtattttaaaattaagattctgagtacccatagctttgaaatattatcgaattctatatataacaaggtgatatcaacatgatatgaaactaaaacgaaattctatgaatcagatattttaaaacaatgatagtgtaaagagacatattgtaaatatttcatagaaacatgctatcgtatacagagccacatatagagaggacaatctcatatattcgtaataaaatatcatttttatggctttaaagataaataggagaagctcactgatctttacttactgatatatttgctttgcttataattttgaccacaaaatttaaattctcccttttgagctttgaggcagaggcaaaattctgacatggtttggttgatcaatttcaaaattaagccaaggcagtggtcaacataggcttcaagagtttctacttactactttcttgtcttatgaaaaatacacaaaaggaaagataaaaaattaataaaagagactcaaagtgttccttggaatttaatagatttgtagatttaacctttcttaggctggtggaccattggttgttaatgatgtcagtgaaattgctaatcaaactggaagtgccttcaaattaattgtaggtgaccttgggaaaaatcattatcttctaaatggatattcaaccaaaggtaaaataatttcagacagactttggatcattaacttgtgactgcaaatcctcttttctaaaagttgtttactctcaagtaaatatgccaatgaatcaatttcacactaaaattaagtttccattaaatttgataatgcaagcacacataaaacaaaaacatatagccttgataaatcttatatgcacttttctcttctgtattacacatttttgtggcttcagtatatattaaactaatctatgtaacctttcaaatgttctcattcatctttaggacactctatacctttttctttttaaaaaaaaattcactgtacttgaaaccaccttttattttatatcagtcaagcttggcttttgtgaatacttttttaaaaaaaatttggtaggaaaaagatatattaaacttccaaatatcttttggcaaaaaggcagggagaacagcattcttatacatggttgaggggagaaaattgcttccaaactgtaatctggaaatatattaaaatgtattttaccctttgacccagcagtcctacatagaggaacccaacacacagagaaaagcaacaagaacaagttgtttgctgaatatgttttgtgatttcaaaaatctaaaaaaaatccataagaaataattacattaattattgctcagtcatacaattaaattgatctataagtgttgtctaacaatgatgcaaattatatcttgattagtgataaaaagccatctatctgttatgtacgcactgagcttatatctttaaaagacaaaaaagataaatccttatctaattgtgtttattttcatatgggcattgagatatagtaagcagagttccattctataccattgatattggtgaatttgaacaaggtatgaggtatgagtgatgttgtcaagagttctagtaattctatttcattgtattttctcagttgtgacaataaacacatttttttaaaatttcaaaattaaacaagcttcaaaaaatgttaaatatgaaaaggtaaatggtaccaaacatattctcccaccagaaacaatttaaaagtggacaaacaatataagtcaaggttttcaggattgaatgacaaagtatgtaaaattacaatccttgaaggaagaaaatcacaaaaagtgatacctacttttatcaaagctttcgttggcatatggagatggtgcccatgcagagtatctggctccttttgacctgagaagctttagactgaaatgtgggtttgaggatgtagctggaattgtggacagggtactgaaaagaagagaaatgctagaagggaggaggaagtcaagaagggggtcttgagtgtttgcatggggatttccctgggaaattagtcaaagcctaagatccatatgtgcagggaaagcgtacacaaagcctctcaataaatggcaactgaggaacaaaaaacaataaaacttccagagaccatgcaattgttggagttcaaatccagtcgtaataaataaacttcaccgattcttttaggaaattggtagagatccaagtaagaacaaaacttaaaagtcagaaccaagccataacatttctcttggaaataaagagaaaagaaaaatagaaataactaagaacaaagcagtctgaagaggtgtaaattatgccagtaaagtttctgatgtaaaaaaactcaaaaatctttttttttaaaagacaacataatacaaacccactacaacatattatccataaagcccaccataaaaacaaaacaaaactaccaaaaccttgacatacaaagaagcagaaaaatgtgacccgtgatcagacaaaataggattcaacagaaacaaaccaagaaatgacacaagtattggaattaatagataagaattttaaaagcctagttataaacatgttaaaggacttaaaggcacagataaacataattagttaacaaataatgaaatttcagtagagaaattaaagctataaaaacattagaaatcttagaattaaaattaactatctgaaatgaataatttattaagagaatttaacagcgtattcaaaattgtaggaaaaatataagtgaatctgaaaacaaaagaacaggaatcatttaacctgaagaacagagagaaacaaagtgtttttaattagcaaaggcttagtgatatgtagaggaatatcaagaggtctaatacacgcacaactggagtctaagaagaagagaagcaataaaatggaatgaaaaaacatatataagatatgatggcccaaatactactaaatttgtttaaaataatcaatctacagattcaaaaagtttagtaaacctccaataggatgaaaaaaacacccataggcacatcataggaaagctgtaaagaatcaaaaatgaaaaaaaagtaaactcagctagaaaacaaaacaaaatacattcataaacgtataataatgtaactgctaaatttttaacagaagcactgaaggtatatatatgtttcaatatagcactctgagttcacaggatgccttcctatctttcagcactttaaatatgctattcatatatatatatatattttaatattggggacgatataaagcatattcaagtaagctctaagtgaatttttttttttgttttttgacatgaggcacaaaactatagggaatattaaagaaagtccctcaggcctaagaaaagtaatactcaatgtaaactcagatgtaactgaaggaattaaggacaatagaactgggaaatatgtgtgaactactattttagttctattaaattatttcatcctgtactattgttgtagtacattttacatctaaaaatatctgaaaccacacagtacaaagcaattatttttgttcagttaattatttttcataatcttttaaaaaatcagtaaagtgctacaaaaaaaaaaaaaaagaatactatgtcatgaccaattgaacttatcccaggaatagaaggttggtttgagattttaaaagacaacctgtaatttgctacattgaagaaaaaataaacagaaaaacatgagcactcaatagatgcagaaaaacatttgacaagtactaatacattttcacaatgagaaaaagttaataactagtaatggaaggaaaatttctcagtctgataaaggaaatctacataaaaatttatatttaacataacatgcattactgaaatacaggttgagtaacctttatccaaaatgcttggggccagaaatgcttcatatttcaattttttttcagatttggaaacatttgcatataaataatgagatatcttggggatgggatccaagtctaaacacaaaattcatttatgatttctatataccttatacatacacataggctgaagggagctacaattcaagatgagatttggacagggaaacagccaaaccatatcacatatttatctcagtagatgctcaaagatgatttgacaaaacccaacactcagtttaaaaactcttggaaaaacaggaatggatggatatttccttaatgtaatattgtataaatacatcaatctaaaatcaatatcttatttaaaggaggaaattaaaggagaaagagcaatttccactagggtcagaaacagggcatgggtatctaccatttttgccactatttaacatcattgtagagctaccagtcaattcaatcaggaaaaggaaactgaagaaatatgacaatagagaagagaagtaaaactatacctatccgcaaatgacatagtagtttacctggaaaactttagagaagcaatgataaacctaattcaaaaaataagaattctgcaaattagcaaatagaacactaaatgcaaaaaaaaatacaggcacaaatgataatcagttagaagaagatataaacactgagaaatctcataccaaagtaacaaaaaaatgttcagaaatatacccaagtatataaaagatccaatacatgataaaagtggtatctcaaattactaggacaaatgcgatctttttaatagattgtgttagagaagatggatagctatttagaaaaaggtaaaatcattttctgttcttcaaacaatacatcagaataaaccacaagtagatcaaagatacataaaatgtaaagctatataataactgaagaaaaatttattaaattcctctatactgggtataggaaaagctatcaaaatatgcctaaaaatccagctacaataaaatatgtatacatttgaccacataataacaacaggaagctttcaaaggaaaatacataataagccaatgatgtgacagtctggaaaaatgtttgaaatatattacaaacaaagtgttcatattctgatttatgaagaacttttgacatttgaggagaaaatgattacaaattctttagaaaattgggcaaaatcataaacacacaattcaatatataaaatagccttaaacacgtgaaaagatgtttcattttgctcatggtaatagacacacaaatttgactgtactgagatgccatttctcaacagtttgaaaaaattggaaagcttaataaaatactctgttagtgaggttgtaggaaacaggcactcttacaaactgcaggtgaagattacagaagtcatagatccgtttgatgaaagagcccagccacagaggcaccctcacagaaatgagcacaactagtgactaaaatttattctcttaacattttctagggaaagaaacgagggctccttggagaaatggctgattctagaactaggacaggccaggaataagatcctggaatgtcttgttatgctaggaagttatgaagtttagttaagacagtcacaagcatacaggagcttgaatgggaacccactgggctaaatccacggcaaccttagcaccaaaatattaaatgtattaagcatcaagataactagtaaagtaataatcataataaaattgaaaaaattaatgcaaaggcctatacatataaaatgatcatttataaataacaacgaagagaggcagttctcttgcttatactagaaagtcaaatattggctggttgatgtggtaataaatctataatacataatcaagattggatcagccaaaaattatcagtggattggaaatctaggagctttttaagagcagtgagatatttgcatggcctgaaaatgttttttagcagacagtttattaattgcaaagggggaagtaactatacagtggggaaaattgacctgttcaagtaattaaaaggaacattgccactaagggatctatgtacactatatgccttctgatgcggaacacttataaggaccaaacattacctgtgtagtattccagctgagaattcataacttctttctaattatgagaaacaacagacaaaccccaaataataaaagttatattcttttaaaagagcaaggaataagagaagtatgttcttcagaaatatcaatgtcataaactagaaagcctatgtaaatatttcagatgaaaggaagctaaaatgttatggcggctaaatgcaatacccaaattttgttggatcttgtactggagatttaaaaaatgcaaagaagggcattattgtgtcaatttgcaaaattgaaataaaaatagatgatagtattgtattgatattaaatccactgaaattgaaaactgtactctgataatgtacgaaaatgtccctaagaaaattcatcttgaagaataggagtaaagagctgcaatgtttgtaattcattctcaaatgacttaggagaaaatacacacagacacagttacacacacacacacacacacacacacacacggaggtaaggaggccaggacaaataaagcaaatggtgtaaaatgtagataataggtcaatctgagtaaaggctacatggttatttttttcatgtttttatttttgccatttttctgtaagtttgaatttatttttaaaaatttaatataaagcaaagtaaagagaccccaggttatcttgcaactgatttctaagcgcttaatctgttttggttctttttactactttattctaccatgcaggtctccttgctgttttgctgagttttagcaagcaaaatactcacctgagggcctttacacctgctctctcttccttacatattttgccccttatttcattcagttctgtactaaaagattgtcttatcagagagacatatccttattagctcttccaaaatggcactcaccttcatccattaatatcccttaaactgatttattttcctcaaagcacttgctattacttaacatgttatatgtttgctgtttactttttatctccccttagtagaacactagtcaataagagcagggactttgttttattccctactacaaccctggaacataaacagttcccggaacaacgcagacactcaatgcgcatttgttgacaaagcagtaaatgctttgaaggttaagtaaatgcatgaaggttaaataagaaatatgaatttatgaaattcaaataaataatgtagatgatgacaaaaggattactgttcctaaagatttttaaacagttttctaatttacaaaggctttggaaattaggtagacataattctaaaaattcttattttctataatgttttattaaaatctgttatttttcctaataaatacttaaatttaaccaaaaattttcattggaaatcctaaaaattatattcactaatcagtaaaaacagggaagatctctcttcttcttttaatctttaaatttagaaaacctgtataaaaaagaagagtctttgtaagtgcctttggaatatttcaatatctattgatatgtatgggcaataatcatgaaatataatgaatatgtcatttcaagaaaccaagttctgctataaaacattattttcataaatataaagaataagattttaaaaacgtaacacattttcaaagtactgtatgagtccaaagaattttacgaggagaaataactatcatttctcatcaccatgtagataaaaattgtacatggttatcttatatgcttgagttattttcagacaaattatgtattataaatcactaaatgtactctgtatatttgcactttcaaattaaggttgctttcatatcattttccctaatgaaaacatttcaaaacaactcatattgacctttttattttaatcaagcataagagttgtgattgtgatttttataatgattcccatggctttatagacaatttgacatactttcaaagaaattggaatttttgttcgatgttaattccttttgcatttctgaattttcacatgatatttcggcttattttgttttttgcaagtttgtgcaaattgtttgaaattagctcacattcaggtggttatttaaaaaatgaactatttttgagatcatgttcctcttgtttattacttcctgagatatacttcattttgcttattcctaaaaagagtattaaatattatttatttatttctatttttccaacaacttcctttactaaacaggtcattttaatatttactcaaaagtataactccatattaattaataaattaatattatttttgaatgaattaatatttactcaaaatatagctcattttaatatttactaatattactaattgctgcttttttaaagcaagtcagattttattgttagctcaatgaaatttactataaattaattttaatctagcataatttttaagatttttgtgttctgatataaaataatatgtcaccaagtgcaagctctatgacttccttgttttgtgaccttgggactttttgaaattcttcgtttcctagtttctttatttgtaacatgagtatggcattagtacctgctcagtatggttgcaacaaacagaaaaggattaatgattgtaaaacactttgaagaggacatggttcattgcaataatatatattagcctttattatttatatatatttttacaacacatgctgacatggagaagtttcaaaacatttttgacaattttcaacttgtcaagtatacatatatatatatatatttatcttaaaattattgaacatttagtgtctgtggttttattctttcattatttcatcaaatatatatcaggcactttttaaggcaaaatcctactttaagctgtgtgtgtttatgtgtgtgtatgtgtgtgtgtgtgtgtgtgtcggtaaagtattcatgtatctgtgtgttgtatataaggaaaaaaaaacatgtttctgctactaaaatacatataatattatttccagctactaatcggtaatggcaggcaagtatacaagtaattccaaggaaaaaaagaaacttaagaaagaattaaaatcctgaatgtgggctgaaaatgaaaatgatcatccacattttttctagcatgttcctacaacatctaatcttcagttaagacaaatgaacaataataccatggatttcccatcagatagaccagatagatgtcctacaatttcacaccttcaaagacctacacaaaaatttcccaagaagtctaggtgctattcgtttttggttaaatagtatattttctttgtattctgtgcttaatattgttttaggttctgctttttaaaacctcaacattttaatctaactttgggttttatactaattcctctttggttgatttttattttgtatttgcccattactgaaactggtcctcctgtctctattttgcttcaataaaccccattcatctatagacatctacaatcgaggctttacattctctgaaaacaacaaacatattttgtgaaaatattaatggaattatataatgaattactatccctaacaaacatccatttatgtcaattattattctcaaactgtgtcacctatataaataaatgacatttgtattttcatttaatctaccttctaattatatataacatctgtttgtagcaatatatttttaacttagaatttttgtgaacagtaaatacattagaggcaactaaaatatgttattacatggatatcacactgcaataataatttacctaaataatatttatatagtgggtccttaaaaatagaacattataattactataaaatttgtgtgtgtattaaccacctgtgtcttccaacattcacagaggagaggcaatagatgtgtcttgtacaatgattaaattctggctcttgtgtaaatttttttttttaatttttctccttatcttctcatttacctttgattattaagttcatctaagaggtatgaaatgcattgtgaaatggggattcatttgcttattgaaatagaatttcagcatctgtgtgcaattactaaaaatttagcttgaaaggtaaaattttctatctcagcaatttagagctaaataaatatatgtattactgttttcttctcttaatcttaatatgaatctgatcattttgagaagtatgaaggagattatttcagaggtcctgcccattaaatgccatgctcttttccattactgagttaaaggtgtttatattaattgcaaagaaaacatggaaaggcagtgttgttacctaacgtcctaggattatcaaatttgattaataattagggaaagcagaggagtgactaattccattgaagtatcattttggtgcattaatggcaaaaattgtaattatttctgcaccgtcctgaaaatatccagaaagaacattcagaaaaagttctctgttcttctcttgtccactagtgttaccttttagtttaatttattgtttctgctctcctttctactagtcagatgtcccatttcttttatctcatcagtgagaatttatctgaatatgttaagaagccagagcagtttagcttttaaggaactggaagccattatccttagcaaattaacacaggaacagaaaatcaaataccacatgttcttacttataagtgggggctaaatgacgagagaaaaaaaattctactcttctttacttattggtacactgactaaacaaatgtgctacattgacaagatattgttaattacatagacaaatttctttgagcgcactctgccaagaacagttggtatgaatgtcagatgagtaacatacaattcagggggaaaaaagctagataatgaaaggaaattttgagttagagctgtacctgcgagtctccagagaatttctttctttaatcaggttagtgtttgatatggtctggttctatgtccccacccaaatctcatactgaattgtaatccgaattgtaatccccacttgttgaagaacggacctcatgggaagtgagtagatcatgaaggctgttcccccctgctgtcctcatgatagtgagtgacttctcacgagatctgatggttttataaagggctttttcccccttcccactgcacttctccttcctgctgccacgtaaagaaggatgtgtttgcttcctcttccaccatgactgtaagtttcctgagttctccccaggcctgtgaatctgtgaatcaatcaaacctcttttctttataaattacccagccttgggcagttcttcgtagcagcggtgagaatggactaatacagtgttataatgttattatagtggctcacagtttttcatagttcttagtattttcctcataagaaggaggaatgtgatgtaaataaatcttcatattaaaaatattacatggataccaactaatgtgcccaaaccacaaatattaaaatctgctatgactaattaatatggctacaacatggtttatacaactttacataaatgtatgtaactacattatatagatatactgcaatcctatccttgcaagtcaaaaagcagttccacagatggcatgtatgagtatgtctgaaaaagcagatgtttgacctggagtcatttctatcatgcatatggtccatcccttggttcgtttttctggccattgttgaatgacttgtccagccagtgttctgcaatgccttagtggaaattaactcatgcactactggttgttagaaacgatgaagttagtgttgcttcttgattgtcaacacatattccactatttaaaatatgaattctagatcctcagaagaaagcagtgcacgggactaggattaaaagccttaaaactcttttcctgcccctgaagcaggcttccttgaagctgttgcggaagtaatttacctttctgcaactgcttccttatatgaacaataggtataacaattgtctttcatatcccataaagatataataaagataaaatttgatatgttttgaaacaatttgacaattgtaccatgatacaggatattgatattactgactttctgggattgcttctgcctaatattatctacatttaccactcacaaaatcagatactttactaggattattctattttacatagaaatggaaatatagtacagattgggttttaaaataagcaaaaggacttgctcttgttctcttccttttgtacacactttccacaacaatattcttttacatcattatttttattcatttatcaaaaaatggaaaaaaggagaaaatgagaacaaataaaaattagagaaataacagaagccttgtagaggagaagctggaaaacttttatagtaatttctcctgtaaaataatgttaatagcaaattctgatgtcaataaagaaaggttgtggggtctgtccattctaggacatgtgccttacttcatcaatagccagagtagaatggattaaaagagaatgattggctctgatctaactcaaaagaaattaagatattgaatctcttaaatctcttaggaaacaaatttactaattaaaaagaaatataactttataaggatcaggcatgaatatcatacatgatatggtttgagtctttttccccactcaaatctcacctagaattgtaatccccatgtgtcaggggaggtacctggtgggaggtgattggatcatggaagtggttttccccagagttttctcgcgatagtgagttctcatgagatctgattgtttaaaagtgtttggcagttcctgcctctcttgtgctctctcctgccaccttgtgaagaagatgcttgcttttccttcacgttccaccataattatgttttctgaggccaccccagtcatgtggaactgtgagtcaattaaacttcctttatttataaattaccccatcgcaggttctttgtagaagtgtgaaaatgcaccgatacaatacacagtctctctagaaacactcatagagtgctagtttaataattacagtaaatcaagagcttaatgaaaatctctccaaaatttgtctatcaagatgactaaagatcaagccacctaagtcaaaattagaagtcacataatctgtgttcttaggtcatttttttaaatttcacctctcttacaacaataaattggggttatcatgttatattttgccttgttttttggtatatttttatgttggttgttaacataataatataatgtaataacataataatataagctatagcttatggtcttcatgtttttaaataaagaaggttttcctgtcttcttaaaaacttgaaacattttgattttgccatcatatatttaatttgtttacacaccatatttcaggtccaccttcccctatctctgcctaattataggagtaaggtaaagataataaaagtaacaaaaggaaacctgaattatgattacatagtgctttgtatttcaaaatttatttcattgtattatctggacattgggctcaaaatgtgtaaactctaatagttctatgtttataaggcacctactcttagtctcagataaaaaattcactggagctgtacaaaaatttgggtattgtacattccctatactggaaaagatatcatactcacagaatgccatgaaaagggatttgaacttccccttttaaatacatttcattgagcactttaaaaaaaaaacagggccaaacatatggatggttccatatttatataaacatcctcctccttctaatcctcccacctcccacatattctgttggttgatacactaaactctgccttctgatctctcaaggatagcgaaagagtgtgaaaatatgaaaggaacccctgctaagtatttcatacttaatgatattcagatgtcattttggaaaaactacatccaaacagcataacaaagggtaggtaaattacttgatacttgctctagtgaggctgtagaaataactgacgtgtataaggcctcaaagcattttcttcctactccatataatttagtgcccatccatgcaaaagtataagaagattctcccaccacttaaatatctaagtacataattcaccacgttcaagttcttaatcatacctattctcatcatacatggttctatctgcattattaatcatgtatctccttactttagtcttgcatggggtatctttgaagtgatgaaatgggaattataatagagaatctacaatttgacagacatatcaacaatttttctgtttcaataatgtatgtgaaattatattgggcattatagttacatatgaaaagccacagatactcagtacagtgtaaaattatgtggtgctgtgaaactatcctttaagtgtgtatatctcacatgttgtttataacgaacattttgttcaaagatatgttgaagggatatttcttgttggttactttttaatgttcacatatattgtgaattgtggttctttttgaaagatcagtcactttgcttaaataaacaagtttcaaattagttcctttccattaatgagtagagtccaattaaagagaactttaaaaaacttaagtctctttcacacctttgccagcaaaaaaaaaaaaaattatattcagtacttggtattcattcacttaggagccccactatcctagagacttgggcatattgccaaagagtaaggcagatgtaacctgagctcacagtttataaaatcgtgaattaaggaaatagtagccacaacttggcaaagtcactgaaattatatacaaatataatgctgacatagatttccctctctaaaaccttgaaggctttgtaaacttgaagtatattacctatgccaacagcccaattgttctgaaatgacaccacccatgttttctcggcctaaaattttctgcttcctccttactcccagtctcagataggttacttgccctcatcacatactctctagtgtcatataatttgacctggtaatgcttattttacttataattactctctctatacctgtattttggccatttgtctagaccccataccacgtgaagaaagggcttgtgactgctgtgtttaccactgtgtttaccatgtccagtatggaacctgccagaaagaaaaatcatcaagagattgttaaatagagttaactgtctccattatagcatgtctgaaagatgctgagataataggttctgggtactttggtttctgatgttttaagttaatacatggatagaaattaaggactagcaagattgctagtgaagacctccattaaatagtttatctcaattgccagatgttttaaaattgccttatgcaggtgctggatagacaacataacatctgttgatttaattagaataagtttaacatctttgaacttcagttttttttccttgtagaattatgggattgattgaaacactaagtaaatttcctttcagttttagaattctgtaataatttttatgttgcctttctgtacataattaaatattcttgtataatactcaaatttttgtacagctccagtgagctcttgtctaagcatagatgtcatcagaaccagagaactattagagtttacatacttagagcccaatgtccagagaattgaattaaggaatctttgaaagtaaaagtataaataggtgatccaaagaccattataccctcccacttacagagtacttactgtttcagttcattacatattctaaagacagattttatttaaatgtttaacattacaccaagcatcccctgttattaatgtcttaacactgactctcagcaagtttgtttctaattttgctctttagtctacttctaaacccttttcccatgttggttttttatgtttgaaaatggatatcagattatcatattttctataaaatcttcacttatgtcctccagaataaaatttctcatgtaataatacttttttatatggacataatttataataatactaattgtgtccttcagcttacaaatatgcccatcacacttgccatttctgttcattttcaacaatatataaatgtcatttaaaaacttgaaactaacaaatttacatgtatctcctttgttctatctcaattttttttcttttgaatacccacatatacacatacttgcatgcatatatgttcagaattcatgcaatacttctgtattcttcccttttgattaacattattttaaaaatacttcctagattacttataactatatttttcccataaattagacttgatcagtatgtaagctatatattatttaactatttttctttatagttataccttggttgtcagtttgtgtttttgttatacagaaacagatacttctgtttcataatttgttttcttgtatcaaataattaactactcaaggatatttcctactagatgaaaatgttgggtcatggatatatatctttctaaaagcataacgtaaattcagaagataataatataggcataaagtgcactttactaaaatgtaggggcatttaagggctcactaatactgttgcaaaatagtagctcaagtacacttttgtggaaatattttttaaaaaacaaactaaatgaattttaattttgttggtttcaaccaatgctataatttattgtgatcaattttaattttgagtgcattgttaaaaaaattatttgtagagaaattttcttcattcaactaatatttactgataatctaagtcctagagttacagtacaaaaaatacaaaaatacttttcttcatatattgtactttctgacaggcagagatagatattaacacattttatggatagcaaaaagcagttagagagtaattctcaaaaaatattagataaataccttttccctaaaaacaggagtgatattagaacaactggtataacatgaaaagtgaatgatcatttagtcataggctattaacagtgtttaccagttgactataagctctgcctgtatatatttacaaatatgcattttaagagtcattagaagtaattttttccccaaaaaatgagtaaaaatacaacacagggatcaaataactctttataagactttttttcatcataaattatatacaatgcaatttaaaccactacttgcatcgcaattcacaaagaatttatacccttgaaattttatctcattactgaaaagttttgagagggataaggttaaggtgtggaagtaaatgtattgctgggtaccttccatgtacttttctcagtattggctatttacttgtaaaataatgtatatttcacaaaattgcttctataaaacttcctgaaaaatattaaaggacaaaataataatcaccacattttcacaacagatttaggaaaaataagttttcaaaaatttttattttgtaatttgatgaatgttaaaaatgcattcctcttattttctctcttttccactgtttggagatgtctttgacttattcagaccaatatttctcatattttaacgtgcacgaaaatacatttgggattgtattaaaatgtgtaatctcactctgtaattctaaggggaagcctaatattttcattgttaataagttccatgtgatgacaatgctgctggtactatggattctattttgaatagcaagtgtcaagacagactggcaataaaagtgaaagcaaaaacttttattttgtaactctcatgtggttaaaaacagtattcattatcaaatcaaaatcaacttttatagaaggagtaatgtccagtatgttgtagaataacttttaaggtaatcaaataccttgccttcactatagcatttgattacccgtaagtgccatttattggtccattggctcttttatgaactttactctcataaaaactcaacctaaacgaagaaaaaaagaggaaacagtctggttaactctactgtaagtgttcctcccacaaatgtgttttcaactgcgacagatttaatgtttcgtaacattattcttttatgtaggtggaacatttcatttttatccttttactgtcttccctagtaatatttttaaaagtcagactaaagttgagttagactttgtaggctgaaaaagttaagatataaattttaacaattgattctcacaatttcttaatttgttatttccataatttttggaagcttagttttgctatttaaaaaattaggtataatacctgaaaatcaataataaagtatgttaattaatcaatgctaaggtttgaattgaaattatttccaatcgataactcatattcaattgaacttatatgcaattaataattcctattcaattgataactgttcatatatttgggcttatatatctctgattatttctaaacaatatcatagttgatgctattgtgtcatgcaagtagtgattctaagattccttttaataatgtcttgactgtataataaaaaagtgtattttaaaaatacataaaatgttcctagaaattaaaaacatgattgttcagattaaaaaataataaaaccttgcatttataaaaaagtaaactaataattataaagtagaatattaattataatatgctaatattaatgttagaatattaattataaaaatatttacatgatataataagaagctagatattaactccactatatagataattaaatgtaaacagactataaacatcaatgaaaaaataaagacagtcagataggacaaagaaaatcctcaatcataagctgtttataagaaacacttatattcaaggattaagaaaagttgagaaggaaaagataaaaaaatgcaacttgaaaataaaaattaaatgcattgtctaatagcagacaatgtatattataaggcaataagcataattttttactaagattttactctacttttaggctgttagccacaatttgacggttgctgacagaagactccagacttctgagttagataaaaagatcagagtatcatcacagcagtagcagtagccagaatttccacattttcatattgacagctgcacatacagtaggttctattactacagtagatctttccaagctaagggaacctgatacctttataataggcacaagcacacattccctttgccccagaggaaggctatcttccaaagtctgttactacaaaaaatatccttggaaagatagttccgaataaaggcagtcaatgttgttgctcagaagacatgcagaaatgtgaaaaattcatagagaatcttcttccaatattatccacccctcattttcacatcttggctcctggaaatttttcccatgaatacattgtcaaattaatcaccagttaaattaatcttactgacagacactggcatcgaatctttccagtttgtctcatatagaatttacttaagcagctaacaacatgactcaaagcagaatgatgatgtcagcctgcacaatagatatcaacccatgccctttagaagcccagacttaaccagctgaacaaaattccttaaacgttatgaccttagaaaggaagctaagtgccagtctctataagtttctgcattgacatttctgctaggctggaaacattaattcaagcagagcaagatgtattcatgattacatagcttctactagaacacaaggaagaattctagggcaattctaccacttataacaaccttggccaataattttcaggctgacctgaatgcttttcaatttcaggatgatgtttcttttaataacttgaagataccttatgaccaccactagaaggcaagtcattatcatttggttaggaagcaagtaatgcctgagttcatacaagttcagtctctggggatgcaaatggtgtatctatggaatgaaaatgttgactccagtgtgacctcaagttcagctaacacgtgtgacgattttctgtcagcttaaagaaactgggtttctgggttttctgggtctgattctttttttaaggagaaatgcctggagccaaactaaatggttcgaccatgccaccagccaggtggtattcatctgctctatggagcgtctaggcagagaatgtataaatggggtggaaaatatatccagacgtgttgacagatgtttttcatgggaggtgcaggagctggggacatttcctgctgtttttgactgacttatctctacatttaagcggactttcaaattgtggtgaaagtcttcggcagggaatagtagatacagcagtcatttaaattaacacactagtaatgtttagtagagatgcatttaggcatgtttccttcatgaagaaagctctaggaacagtttagaaagagaaagaccactaatgtccctccctaccttcctgtacctggtggaaactaagttattttctcaccaggttctgcattactgctctctctccgctacctcaaaaatagtgcaccccattccaatagccataacttcatcttttcaccaatattccatagtcatagccagaccttttacacagagtcaggtataagaataatttttaaaaacttacaaggacatattgtgtcccccactttgacctgtatgggccacagtaggaaaaaatagcaagcagtaaattcaactaaatggtaatgggcattatgatctaggatgatatctgtgatggttaattttaggtgcaaacttgattggattaaggaagacagagagagctggtaaagcattacttctgagtgtatgtgtgagtgtggttccagaggagactggcatgtgaattggtagattgaatggggaaaatctgctgtcaaggtaggcagcaccatccaattgagtcaggataaataaggttaggaggccaaactggcttgtccccttgtgtgaagcccagcaggctctgcatcccttgcaccctcatgcatgaccacccaattttttgcaaggttagtaaccctacaggaaggataccggcagacagccagatggttacaggtccctgatacccagtatggcccaggaaagaacaaaagccccttattcctgatgtaacttccccaatcaccagtccatcagcactaaaagccaaagaaggtattagctacaaattccaacatttgggggctagagacttccctggggtcccacatgcacagctaggctcaaggtttagcttatagtaagcttttcctcatttgaatagtaaaaaacacaccactaggtggagattttatatgctaatgatacatatgttacatgttagagcatgtagatgccgagcacatgttccaactgcaggtccgcctttgcatacttgaccttgccagtattttatgaatatgtatatacagctaccataaaaagagattccccttaaggcactagctgctgtctctccctttgagcagcccactcttgcctctcagagtgtacttttgctttgcagtaaacttctttgcttactcttactttggacttgctctcaaattcttaggtgcagcaaagtcaagaacctgaactggcctaccagcagcacaataagctgcggggctgaatagaacagaatggcagggaaaagacaatttccactctatagtgctctctgtctctctctatctctctctcctgttgatgtaacaccctttttttttcctgcccttggacattagaactccagtctcttcagtctttggactccaggacttagactaggggctctccaggttctcaggcctctggcctcagactgagaattacatcattggcttccctggttctgagacttttatacttggactgagacacacaatcagcatcccagcttgcagacagcctgttgtgggacttctcaccctctataatagtgtgagccaattcctctaataaccgcctctcatctatctatctatctatctctctatctatctatctacctacctattcaactatctatctatttttctatctcctattggttctggctctgaagaattctgactattacaatgccaaaccaataagagaacccagtgtggctgaaccagaatatacttgcacctcctaagattctttgttcatcaggttaatagagagtataataacaggccagtctggggttccctttaggagaacaaaagaaacatcatgcttgacaatattctgtgcagaatcccaaatattcaaaattggtctgtatattattccctcatcccttttgtccaaatcattacctaagaagtgattaacatgaaataacatttttaagtgacttttacaataaaggatgcctaaatgaaaatgtgccacacagccaagaacacaatatggatttgcttcaaggaccctgatatcggggtgggaatcaactgattggattcaaatagcaacatcataaatgaaaaatggtcaacagtggtgaattactgcaagttactgagcaatgagaggacttgaagggttcactgtagtcaatctacattggtataatgctctgaaattggtattcctcactaggaaagaaatgagtgacttttggccagactcacatatctggcattaagtggtagcctctgtgacagaaacaaagccatttattttgcatacattttataatggcggatgtattgccatgtctagtgcagtaatggatttagttagcagtgatagtaatttgggtggtacaggcatgatcagcagcttgattccagttggtctctagatgaattactcagattgtttaattaacagccatttgtttctacagtttacagcttcagtctttaatctgctagtttgtagttttctaagtgtcagagtaaacatctaggctactaacaacagaccaatactcagtaaaaatataacaatgtttatcaaagggagttctgggccgggagcgatagctcatgcctgtaatcccagcactttgggaggccgaggtgggcagatcacgaggtcaggagttagagaccagcctggccaatatggtgaagccccgcctctactaaaagtacaaaaattagccaggtgtgatggtgggcacctgtaatcccagctactgaggaggccgaggcaggagaatcacttgaacctaggaggtggaggttgcagtgagcagatatcacaccattgcactccagcctgggcaacagaacaagactccatctcaaaaaaaaaaaaaaaaaaaggtggggagtactggctagagtgatgagaatggctctgaattatgcctactcagtagagataccacatttgtttttagttctgcatatttggtggtaagaatgaaaagctacatcaaacaaatacacaccattgtaggttagatagctgaaccatcagtaatctaggtcaacctttttaagggataccttatgaatgaaaggtgcagtggggccagcggctttgcttcatgtaattgagaaacttttccccaaggggaaaacatccactttttcatgtaaagacaaaattatattggggttagaccagttgaattttggactataccatttccatttgacaaattagatagatggggacttcctaccttattagttcttgagtctccattgactcatcctgataggcagtatcaggcaggagagttgcaaagcctctgtggatcaagtcttcagcttcagcaaaagcccagtagcaaccaagtaggtgctttgcaagaagagtacagggagcagtcatattagtcagatgtaggattcaaaagtctaaaggacacttccagctcgattttgcgtctttttgctagaggcttcaatttgcaaaactatgccacacaaacttgcaattcaaaaggttctttagatttgtggggcccaagaggtactagcacttttctatatgtgattcttcctaagcaggagaatcccctctggcacttataggatagggaagtgtaaacatatagcacatcagctcctactgtgatgattaattttatttgtcaacatgactggaccatgggattccaagatacttggtcaaacattattctgtgttcctacggaagttattgagaatgagtgtaacactgaaattgatagaccacacaaagcaggttgccctccctaatgtgagtaggcctcatccaatctgttgaacactcaaatataccaaaagtctcaccttccccctagtaacagggtatttttcttgcctgtccgccttgagctgggacactacgcttttcctgcctttggactcaaactgaaacattggttgcctgtgaataaccatcagctctcatggttatcaggacttaaaactcatattggaagtgcaccaccaggtctcctgggtctccagcttgccaccaacaggttgtgggatttgttagcctccataatcatgtgagccaattccttatgttatctttatacataaagtataaatatataatgtatgcctactgcatagagacaccatgtctatttttaattttgcatatttggtactgaggatgaagaactgcatcagatgaacgtatgccactgtgatttagatatctgaaacatcagtaatccagggtgagaattataaaaataaattatatatgcagtatgtagttttatctatctatctatctatctatctatctatctatcatctatcttatcagttctgtttctgtacagaacccagaatattacagattttggcatgaagaagtgggctgtttctgtaacaagtatctaaatatgtgttaacatggctttggaaatgggtaatgagtaggagggtggagaggtttggagtttcgtggtagtaaaagtctagactgctgtgaagggactgttcgtagaaatatgaattattagagatgattctcatgaggtctcagaaagaaaaaacaatattggagagaaagcctctattttcttagaaaatacatatatcctcatgacctaaatgttggtagaaatctggatttcaaaaaccttttattttaaattcagggttaaatttgttacataggtaaatgtgtgtcatgggggtttgttatgcaggctatttcatcacccatatatcaagcctagtactcattagtaatttttcctgatcttctagctcctcccaccctccacccccgataggccccagtgtgtgttgttcccctctatgtgtccatgtgttctcatcatttagctctcacttataagtgagaacatgcagtatttgtttttctattcctgtgttagtttgctaaagataatggcttccagctccatccatgtcctcctttcaaaggacatgctctcttttggttttattgcttcatagtattccatggtgtacatgtaccacattttctttgtccagtccatcattgatgagcatttaggttgattccatgtctttgctgttgtgaacagtgctgcaatgaacatacatgtgcatgtatctttataatagaacaatttcttttcctttgggtatatacccagtgatgagattgccaggtcaaatagcatttctgtctctagggctctgaggaattgtcccattgtcttccacagtggcttaactaatttacactcctaccgaaagtatgtaagtattcctttttatccacaacctcactaggctaagattggttatagtgtaaactttctatgacaacttctaagtttctgcatcagtaattaatatagtttcacaaaagaaaacccatatgtttatcttgtttctgctaattacctgtaaaattgtatgtcatatggttgtattattaaaccaaattcctatatttgaatatctgtatcaaatgtaacctcatttatttgtccatatattgcaacatgaacaggtaatctgatgaggtataatctcacttcaaagaaatagcttttcacttccaaattattcttccaaagaaaaatgacatgtgaattacaaaaagcaggtgctctgtagtaagataaaatttgtactatttatttgggattagtttctctctttctttctggcttccagtgagtaactcagtttcaatttcttcaagtctgtatgtcttacactggatactggggataataagaaatataataagggattattacgggaacaagttggataataaatatggtagaaacatattatcaagatattagctgatattgttttgctttttttgccacttattcccacttttctcttttctttattcaagtactttgtattgcctttcaggcttctagggcagatgactagaataatgtaagaaatattctaaaatgctgggacatttctaatctcaaataagaataacaagaagaaaaattatggggactatgttcatcctctgcaaaacctagagaaaatatgaatagagaaaataaatgtagtttttgctgtatcaatggcaacaacagcagaaaaaatgttatgttccattcacgcctgtgattatggaaggagattcatacctgatacatatttaaggcacctagcagtgggtccctgaaaagataagagagaaataacaatagctatgcctacgttgatctatttcatcacaaatatcttttcacaaaatgaattggtagaatcttaaatgttcagaaaaaaacattatattgaacactagatcatatatctaatatataatcatcctgatgagttcttcaaatgctatttgtaaattctatgtatttggatgcctgtattttttgctgaaaaaaaaaaaagaatgtctcagtacaaaagacttagttgcaaaatggcagtgtggaagtatagtttttcagaaaagaaaacactttaaaatctctcagtaatagaggtaacacctaaagtattatgtattagaaattccaaggaatgaaatgtcactccaaaaagaaaaataaaatttgagtgggaagattctatcttgtcctctgacacacatcactgactttttcagaaaaacatccatactgacaccagaaaagagctgcctttttgtccatgataggtcctgatgtgcactgaatgctatatttggtgtgcaagaaaactgtttatataaaaaattactatatatatatatacacacacaattttagacaggttttatatctatatacatatatacatattttactaagaatattaatagcattatattttaaacataaaatagtttgactttttcccaaggtcgagtaatgtcttataaaattaaaatgaaaatacattattaaaaaatttaataaggaacaattatgaaaactaaatgatgaatgccaataaaacaaaaaattgtatggtacttggatctaaagaagtacaatattttagagctagtcttgattcttaggcacatatacctactcatgtacattttaccttaatgaacagaataaaatattaatacaataaagaggagcttttttggttattctaaatgctgtcagatatcaacttagagactgagaagccatttaatgttttcaacttattgcaacctaataggtcaattctggaccatgtttgtgacttaaatgataacacacaactactcacaataatagactaaaattgttgtgggcagtggccagaatgactaaagttcaccaatctgaaaatcatatattattgctaaccccattgtaaagacaagtgattagatcatcatcaaactgcagtccgcttctgctttgtcatgaacaaaaaattctttattgtgaaaactcatcctttggtaacagaatggacttaaagatcctttttattttttaatagaaattaattgatttttggtaacaaagaaatgcacttcaagtatgcaatttttaaacatgaaatgttaacatgtatatgttttctttattccaaggtgtgaaatcctactgtgcttgaagtatatttttctttattaaattcaaaaatggggaagacattgaatatacctaaaatataggtaaagttctcacgattctcaattaatatttactaacttactagctacaatataattttcaggaaaaatgaatgtaaaggtttctggctttctataaatttaaaaaaagtgccaggaattttcacagcctatttaaagttatgatactctagcacaaataaataaaagagaaattggtaaaacctgacaatagttctgcataaatttgaagttattaaagcaattttaacttgtatcttttgattttctttgtttttaatttcatttgcatatttcttcatctctattaatacaagaaataatatttatgaaatatatattaagctccacttaaaactgaaagaaaaaaactgcatttggtgtaaaattatttatccacacattctttctttaaaaaagaatgtcttcattgagatgtactaaactttgcccttttaaaacacacaattcagtgactgttggtacattaagggaaatgtcactgctatctaatttcagaaatattttatttattttcatcagtatattttattttaaaatatagattgtagtcttctgttttcaggttttcaaggttcgtgcatgttgtagcaagtatcagtgtggtgttctttttgattgctaaataatactgcattatataaatatgtcaatttatttttaatccagtcatcagttgattgatattcatcttgtttccacattttgactatttactaaatagtgctatgaggagccatcatgtacaagtttttgtttgtatccctgttttcaatttatttgaatatatacctatgactagaattgctagattatatggtaactctgtgtttaactttttgagtaactgtcaaactgttttccaaagtggctacaacagcttacatatccataagcaatgcacaaggattccaatttctccaatccttgtcaacacttactattgtgtatcttcttgatttaaccaactactgggtgtgaagtagtctcattgtggttttgatttgtattttccccataactaatgatgttgaacatgtttatgtgcttattggttattttaatatcttttttgtagaatgggtattgaaaactttgcccatatttaaactgatttatttgtaattttatttttcggttgtaagcattcttcattatagtatagacttgtatctatctctagtcttgtatagtatagatttgtatctatctttcaaattatgtatcttctccaatacacaatttgaaaatattttctccatttctatggattgtattttcactttctttttggtattctttgtagcacaaatgtttttaactctgatgaaattcaaatttcaacttttactaattccttgtgcttttggtatcacaacaaataaatcatcgcctaatgcaaagtcaaggatatatatgaccttttcattatgagttttgtaattttaatcttacatttaagtctatgatatggtttacattttttgttttgttttgtttgagacggagtctcatgctgttgcccaggctggagtgcagtggcgtgatctttgctcactgctacctctgccacctgggttcaagtgattttcctgcctcagcctcctgagtagctgggattacaggcatgtgtcaccacgcctgactaatttttgtatttttagtagagacggggtttcaccatgttagtcaggctggtctcaaactcctgacctcatgatccgcctgcctcagactcccaaagtgttgggattacaggtgtgagccaccgcgcctggcctacattaattttttatggtgtcagcagtaatcaaacttcattctttgccatgtgaatattcagttataccagcaacatgtggaaaatgataaatttttcttcattgagttgttttgaccataaatataagggtttatatctggactggtttttttcttgtgtttttgagtggagtgttctgtgaatatatgaagtctaatttgcttattattttattcaagtcttctattttctcattcatattttgccttgttgttctattcattattaaatatgaggtgttgaattcaccaactaattttgttatattgttcctgttacctttcatttatgtcaatttttgctatttgtagttttagtctctgttgttaggtacatgcatgtttacaatcactgtatcttttatcattagaaaatgtccctctttgacaattcaaacagttatcgtcttaaagcttattaagtctaatattagtatagccacttgttactgttggcatggcatatatagttttttcagcttatttatgtatttgaaataaaagtgtctcttttggatggtatagagttgggtcattttaaacgtacattcggccaatgtttgcctcttgattgaaatgttggagtgtttaattaatttatgttcaatgtaagtacctattagttagcatgtgtatgccatttttatatatctttatatgttttaaatcattttgttcccctagtattccactactgttttgtattgtattaaatatatgtcctattatatcattttaatttcttttttattttactttatattgagttattctcttagagcttatcctgtagattaaaacacatgcatttaaaataatttatcttgaattaataccaatttattttcagtaatatataaaaaactttaatatatgccatcttctccaaccccctttctgctgttattgtaatataaatgacctcttcatacattatatgcccattaacagagtttcttaattaatgctttatgcagttgtttttaaaatcagacagaatattttacaagttaaattacatttatttatactgtattttacatttcctgatgtagttacatttactgttctctatttctttgtttggacttgagttactgtctaatgtcatttcctttcaatctgaaggattttcctagatatttctgtgagaaagatctgctggtgataaattctctcagttttggcatacctggaaatgtattaatttattctttatttttaaaatattgtttgctactataaattcttggttgacagtctttcaaccctttggaaatggcataccaccacttttaacctccataagaaacctctctttatcttattgaagatcccttatgtgtgattagttgtttttcttttactgctttcaagtttctctcttttagacttttgataatttgtaatttatctgcttgtctccttgagtttatcttacttgaatttatagattaagattcttaatagaattcagaaagttattttttcttattatttctattttttttatcttttctctctcctcttcttcatcatagagtcccgttatggtccatgttaatacactttattgtgtaccacaagtctctgaggttctattcaatcttttgtctttcaagtttcacaatgaataatctcaattgacccatttgtatgtttactgatactttttactgccaactcaaaccttctgttaatctcatctagcaaattttttattttagttgttatacttttcaactctagaatttctatgtggttcttttttaaatgtatatctttttattgttatctaatattcagtgtgcaatcattctcgttcttccacttaattctttagatataatttcctttagttctttgagcatatttaaaacttatttaaagtctttgtctagtaagtccaatatctgtaatttggatataatttctattaactacttttttcctattatgggccatagtttcctgtttatttccattataacttgcagttgagaactaggtaaaattattttacaaatgtagcatgttttgtctgagaattagtgtcccttcccccaagggcttcttgtcactgtttgttgtggtgtttgccatttatttgttcagtttaattctaaaagtcactcttccctgatgcatgtggtcaattaagtctgcttaattatctcagtgcttgactaagattgaacggagatttatttaaattccttgaaccagtaaatcttagatactttgctggagaggtttgtttgtgtgctgggatacacatgcaatgctccagcaatgtcagactctgccttagcttcacttcctgctggtggaggaccagaagtagtaagggtttggagttttctaaggtattctctgggcatgtacacactttgcacatgtgtgcactttcttatgtctgtaggattatgtcaaaggctttcaaagtttcctatgtctatctcattctccacaggagctgtcttttgactagtctcttgtttgttccaaccagtatcaatgcctcaggcagccactatgttaaacaactaacacttatttatttattgacaaatgccctggagataaggatcttcccactgagcagttctggctcaggtcaaagaatgaccaacttggtatatgagacttttccaagaagttgtcagacagataaaatagtgacaattctctgaggatgggcctttttgatgagcttcaaagcttgtcttccccttgcagtgttttacagctactgtggttgtgcacctaatagttttcaagggtactataggtccagaaagtagggcaagttaattcatcacaatgtttagtgttcttaaattatcaaccactgagatttaatcactttttgtgaataaacacaccagattgttgaaagtcattaattttcagagatctgaaaaaatgaattttgacaatttttgccagtgttcatgttgcctttatgaggagtagatttctgtaagtaccatttattcataatgtcttgatttggttgtcataaatttcaaagttactacatagaattaattgttaccttccagtttaaagacagattcttaaactgcttagcaataacagattcttaagcaatgcatattatgaatataccttctgttattaatataacttaattaaatcaatatttaagggggagtgttacagtagcttatattaatgatcactgatgtaactgacatataataaaacagataacaaaatttctacacttgcaaatgactggagttttcgtgagctaggtcatattatcttttgcatgtatttgaaaatagaagattaagtcaacaaataaggcagaaccatacttttaaagaagtttagaaaaacatttatgaagggaccacactgcatctgactctcaagaaattcatagaacaaaatgtcaggaatcaaatttattccactgacatcaactggacttgtgaagtatctgactttttgaaaatgtggggtattttatgagtggtgataatttaatgaagcataaattgttcttctgaactggctctcgttagtaagagtgttgaatacaatggttaaaaatagagatgaagcataatttacctatcttacgtgtaccatttttcaaatatgagaaaagtaacttagattaaaattaaggctaatttgttttagtgtttaaaaactctattgtatataacacatacaatagagattttagtatataatatacactatagagattatagagattctattatatataatatacatttggaggaaataatatggaaatatatgtgtgtgtgtgatatatatgtatatatacatatatatacacacacacatatatttccatattatatatatatgtatatacatatatatatatacacacacatgtggaggaaataaattgttatatataaattgccatgtatttatttatttattgacaaatgccctagagataggatctttccactgagcagttctgggtcagatcaaagaatgacaaattctaaatgagacttttccaataagttatttaatttatttccaccacacgtataatacacattcaatttatttcctgcacatatatgatatacatgtggaggaaacaaattgttaagcataagtattttaaatctggtatgatgttcaagaaacttgaactttctaaaaacagcttaattttttttaatgtaacggcgattgctgaaactgtcaactttcctgacaatcttatttagaaaaaaatgttattcatatgatatattaagtcattggtatggtttggctgtgtccccactcaaatctcactttgaattgtaataatccccacgtgtcaagggtaggaccagatagacataaatgagtcatgggggtggtttccttcatactgttctcaaggtagtgaataagtctcacaagatctaatggtcttaatatggggaattcccctgcacaacctcttttgcctgccgccatgtaagacatgactttactcctcattcaccttcagccatgactgtgaggcctccccagccatatggaactgtgagtcaattttctctttcctttataaattacccagccttgagtgtgtctttattagcagtgtgagagcagactaatacagttataacctatgaaaacagtaaaatcttggacagcttagcttaagaacagtggatattcggcatggaaacatttgagacccacgttcttccagaaatgttttatgtagtattgtgaaagatggtcccagaaacaagttttagatagtagttacttgcctccccttgagtttgaggtatttgttacaacagttgtacatattataaggaatcaattttttattgtgaatttttctatttttaaatcaaatttaaataaggtaaataaatatatactagtacttacccatgattttcagtggtgtaaatctggttgtacgtgttttgaatatggcatataatatttttgttggacagagcataaaaagaaattcgactgccttatgtcctgagtgaattctctgagctcccaaaactgttacattgttacattattttcctgtacccttaaatatttaatgtggctactcttgccataagtctttgtgaatcttgtttcctgaaaaagaagaagtaatctatggcaatagtattcaagaaaaaaaaaaacaacaatttaaagacttgtttataagaaagatggactgatgaccaactggggaacagttctataaatctatgtaaatatacagaaacagactaattgtagaagtgtgtatttagcttaaagatataagggaagttagttgataaacatagaaagttgcttattcaataaataaacaaataaatacaacaaatcacaggttcttttctatgtcctctttaagttaccaggggtaaagaagaaaacaaaacagacacgaacaacagttttcaggatttgcgtcaggggatctaagagaattgtaattataggatataattacatctaatctttttttacacatttatttgacatccccatctgccttcccacaacaggtgatggaggtggaagaggaattcccaaacttggtttctgcctattcatcaaataaaggagttcatattattagaatttagtccattaaaaacaaagaaggctatattcttgaagatgcgtttgtgagaatgacacatcctgatgtagaagggagtgtagctctctcaagaaagagagatggaggaaaaacaataatttcacactaagcagaccttgtgggcggttctaggccatcttaaacattttttgttttattcgtgaaataataggaaatatattgatgcttcaatattgattgtagaaacagatttgcattttcaaaagattccattagatgcagagcggagtttggatttaaaagaaaagagattgtgtgtatggaacaggatggaaggagatggggccaaacagacaatcttgtgtctgatggattaaatatggtcaaaatgtagagtatacattcaaaagcttgttagtaggtagacataattgattggattcagtagatgaggaacataatagtgttaaaatagatctctcaaatattacagaatttaatgggcttgtttactggggttaaaaaccaatagaagagtgactgttgctcacagcgtcacagcagaaattaagagactggtttctagccagcgcggaagacagccatatttatgaatagaattgggcattcaaaaaataaataaagtgtaaattacagaagtttaagtggatgtgaaaattgccttgcagaagggttactaggtagaaattaagctaaaaaggaaaaaaaaagtttaaaaatgagtacatgaagagtaaatacagagcttttacatactttattctttacaagttattcagtatctactatgtgcaaaatgtgaatagtaatcaataatgaattagacatgcctcccattttatgaagctaagcatatttataaacccatatttggataattcatcattttttaataaccggagtcactagctcattgattatcaatgtctcattcatgataatggagaaacagagagaaacagtaggaagcacaaagaatttcatacatgaaagtaaatttaagagtggattcaaatgaaattaatgctctaggcctctgttaacagactgtgacctaaatctcatactgatcgcacaactaaaattctgaagtccaaggaaaatgatgagacacagagatttttctccttaattttaatttattcttttttaaagaaagcatgggggatatactattaaagttaatatcaccttccttattaagacataaaaaatgtcttacttgtaatcactaaaagtaaaaaaaaaatccttaaatcttgatttactttgggatttctattgtttagctgtaagttaaaaaatccattatctaaatactagtttaaataactttaatctggtaaccaaaaatacttcccttatagaaattgctaggatatattgggagcattaatttaaacacactaatgttacatgtaagtttttgacccttgagccagagacctgccaggaaaattaaaaggtgaaaataaccttagctttagtgacctgaattctccatgatctaacacttttctgattcacttgacagagtttttatgtttttatacaaaaattaaaaagtaaattgtatactttcttagaaatcccatgaattttaaaagtgtatacataaattaatttgggtacagtcagcaaatacttcttcagataaaatttgatgtctaaccagcacctattatgctcaaatgttacagttaaaattttcacagataccataagtgtaatttactttttatatttttcatactgctgctattatacttgagagaaaaatttccttaaaaaatctgttcatctttctagagaatactcctgatttctcagcaagtcttctactatttatgaatcttttatctgttagtgatcttcccttctctctctctacatgtcaaaatcaataatctccaatttctccctgatggaataaatactcataaactataaaccaatgtctggaacattggttttcacagctattgtcattcctaagagatgatactatctatcatctataacaaatgatgatccacagaggcttaaaaattgtccaattttttttaaagtgcatgtgaagttgtaattcactggggcaaaaaatgctatatgaatgtcaacatagtcttctttaattctttcaaattttatgtatttttttttaccgttttcttcaatcttctcctttagaaaactttcagatatctttctttctgatacagataggatactctgcaactaactcagactccatagagcaaagtgagagaaacaacctttttcatttttccaagtttttttgccttctctctatggccttctctattatgacaaatcaatttttttatatcaaactaaaaatcttgggaaaagattttgaaagaaaattattacatttaaaactccatcttttgctaaaatattaagctgtttaaaactataaataccacatggagatattctgcagatggatacatgaatttcataagtagtgggtggaccaaattaagaaagcccaatatctgcatttgacactagatctctagatcacatcaagatattatggaagccccacattgcaaagaatcaatgctgagaggtaaacagacactagaaaaggcattatttaagaatgagggcgtaagaacacgagtgttcggcttaaggagataagactaggtacaggacagaatttctccactcagtagaacagaaactcagttctcagaaccagagcacagatcaataatataaatttaaaactaaaagaaaagcacagaatccagataagagctaaatccatgcaatcccacatttcccaaaccaggactgagattgatcctggacagtacccaagatagttcagtttccctatctacagggattggctggggacatcaggacaagttagctgacaaaaaaaaactgacttttttttttaatctttaagttctaggatacatgtgcacaatgtgcaggtttgttacatatgcatacatgtgccatgttggtgtgctgcacccattaactcgtcatttacattaggtgtatctcctaatgctatccctccctcctctccccaccccacgacaggccccggtgtgtgatgttccccttcctgtgtccaaatgttctcattacaaattgactttttaaatttaaaactgttttttttttctttctgaattctgccaatttttctttctgctatagcatccctccacttcattcaactcctacaaggaaccaaaacttggctgggcgtggtggctcacgcttgtaatcccagcactttggtaggccgaggcgggcagataacgaggtcaagagatcaagaccatcctggccaacatagtgaaaccccgtctatactaaaaacacaaaaattagctgggcatggtgatgtgtgctgtaagcccagctacttgggaggctgaggcaggagaatcacttgaactagggagttggaggttgcagtgacccgagatcgtgccactgcactgcagtctggtgacagagtgagactccgtctgaaaaaaaaaaaaaaagaaaagaaaagaaatgaaacttatgtcctcgctgtgacagtttatgtgccagtactatatcttatcctaacatgtagttacaagatttttcttccagatataacattccacttcaatttttccctgtgcctgacatgacctgttcctctacaattagatactatgtctttccatgttatttaccaatctagacctgcaaacatccaaattgacatcactatttagaacacaaaaatatttttagtatcctccgtctgatctgagtgtctataattttctcaatgtcatgctgtacattttcaacgtgtctgtgatacagaagcaaaaaagaaatttaggcagttagtgaggataagagagtccttggtaaggtttcccttctaatgaaaatcagctgtgaaatcatttctttgttaacagaaagcagcctaaaaaattgagctacagatacagataagctggaagcgtgcatgattgaatgtcagcagctatgccaacaggaaaaggctaaccagggtccaggcgtgttcagcatggaggctccatctttcctttcctttgtcaaccacatgcacagtaaggaacagacagcatggtactggccaggtatagaacccatctgcataataaaagattagggtagggaggccagcttctttgcccattatgtaaggcacacatggtccaacaaatctttggaatgtatgtaaatcagccatcacctccttaagctagtctaaggctattaaattctactatgagttttaagtgtggatttaggtcttacaatattaagtaatggagtccatcatctgtcaaagaaggagagacataaatgaagttgtatatgcctaaaatggagacaactttctaatttctttttaaatgaagtatataaaaataaaaattgttggaaattctggaaattctgttttatctgaaacttttaattatttttttaattccaacaatttagattatatttattttccagaaacacactatattaaggtcatcatgaatcacacttggcattcattcagttatttatctaagtagatattcaacaaaaatttattataacaattgggtgaaagtattatactaatacatttggaaaataatgagtacttaaaaaaggttagattctagaaagcaagtaaaagaatggaggacaatgctgaaaaggcaaggacaagcatttcttatttctcaattcacatacgttcacgcatttaaatggaagtaccaagatttattggacaagagacatgatatagtttttagtgctccaaataataaacaataatattaccttagactatctaaatataaaattggatgtttaagttcttcaatacatattgaaaaagtaaaactagacattgagactaggttttggatgccagctctgttacttacatataataaagactgccctcatttttggatctccgattctttccttgtttttaagttgtttgtttagttttgtattaaaattataaaatgaaaacttttgctgtactgaaaattaaaaggagcatatctgatgatatttctataagcacatcatgacaactatgaggagttaaaaatacaaaattttatagaaaaataatgacaaaacaatgcttttttcagttttatatttgagtatatttgatttatcataagctgaaatgttgcaactctgagttgtactaccctgatcaccaactaaaacaattatcctcactgtgtattagccttgaattgttactttatggtgatgaataatattagaagtacaatgttcaatcctgctaataaagggtgccaacaaataaaaaacagaacatattacacatccataaaatattgaaactacttagattttgaatctgaaaatatactgatattataatttttaaaaagtgttcatatctactgtttgtctctaagtgtatttcctataatatttaactataataatatatagtaattagtttataaattaacagtgaaccgttttacatcccttgattttatacttttgctattattttacagtgtcaataacaaattaaaggagaaataaagtaattatacatagactgtgtcattatttaagcctccaattctttgtctaacatgaatgaaaatacttacaattttctatagtaagtacatatatcagaagatgcatttactcaaatgaagagaaatgtgctacatgaggatcctacatgctggtagtgaatccagggacaaagagatttcatgagaagcaacagcagaaagaaaaaaaaagcaaatgtaaaaatttaatcttaagattatgaaattaatctctggttgtgttgataaatatcatatttataaaacaagtccatgcccattaagaagtcattagataatatagttcaaatctaagctgtttgttttctttaaaatatataaaacacttaagatacattttaaaaattcatattaaaagatttggacttgtaataatttaagtacaaagaaatacatgctcagcaccgacaccattccttattccccagattaagacctaatggccactgccaaattaactaaaggaatcattacaattgaagctggcatagtagactcagtcattttacaatgtgctcactaggaaaagttataactgagtttcttcagaagtaaacaattggaaatattgcataactttacaattgtcaagaatgtatttcctaacaacaaaaagtgaagctgatgagtggagtgcagaaacctcatttagagcagatttctatttctaactgtaaaaaataactggcatcaaattaatccatcctacttaaggaggagtaggatagtttggctgcaacaattacaacttttactgaagccaccaaaatatgtcttagtgatgatactttggaataacatgatgaccaaacagacattgcaagttttaagcaaaatatacaagattttgcattaagtggtttgtagtgtgtaggatggaaagattggtatcatattagattacgtagaaatgcaggctcctgagccccactccagatgtgtaaaataagaatcagcagtttagccagattaccagatagttcttataaacactgaagtctggaaagccctgatttacatgaatgttaatagaggaaggagtgcagggtgtacagaatgagaccttagtttcaatcagcctctatctactaccatgggctggttaagtgtttaacaactggctctctggaaaagaataaataaaaacaaaacgggccgggcgcagtggctcatgcctgtaatcccagcactttgggaggccgaggcgggcggatcacgtggtcaggagatcaagaccttcctggctaacatggtgaaaccacctccctactaaaaaaattcaaaaaaattagccaggcatggtggcaggtgcctgtagtcccagctacatggaaggctgaggcaggagaatggcgtgaacccaggaggcggagtttgcagtgagccaagatggcaccactgcactccagcctgggcaacagggcaagactctgtctcaaaaacaaataaataaataaaaatgacaaaactgccggagcttctgcatacctgaacacatgaagtttcctcaagagtggcaaacccagagatgctctggaagctctgtaccctttccctcatcccttgtctaatctatctattcatctggtgttcattagtatcctttgtaatatcctttataggaaaggagaaaggagtaaaatactttctcaaaggagaaatttgaaatatttgcaaaacattgatgtatgtacaatgtctaactcttttcatactcaacatcaggaaattagataataactttctgcaatgagtcagctaaatatccagccattctactgtggcaaattaaagcatctcacactgtatcaagtgtagaaacataaattgctcacatcaacttcaacaaatacactgtttagtgaaacatgagtctttataaacatactggaatttgaaaaaaataacacactaagaaaaaaattttttttaatttgctgatttatgtaaagtaacactgccaacatacttgatttcaaggtactaagatgaaaactctgaatgcagctggaaaaaaaggtcaactgcacaatttgttcttttgaccacatctgagttggctgtagtacactattatctgtaagtcactatctgaagaattgtttatgacaaaataaaaaatgatatgaattcctcatgaaagctgttagaataatagttgcttttatttgtttctctaccaaaataactattaaagattttctgacacaaaacataatggccaaaacaggattggtgcttattgtatgttttggaatacattaatagatagacaggactgtattccatgccatttttactagtagaacgagagtattttcatctttataaaaagatagtacacgagaatatttgctgcttgttattctgacactgtggcagagactgccagttgtctcctattggtctctatccctttcaatcatagcaatatattgtttagcgggacatattaacactcaaagactacattctccagcaaccaatgtaaccaagtttcatgtggctataatctggccaattggatataagtagaagtgtcataacacagcttctaggaatcttccttaggaaaatatttgtcccatctttcttcccttcatcttctctgctgcttggtacacatatattattgctatattatgttttggactgggaagaaaaagtttcccatcctggagatggaagagtaaatatttaaataagcatatgtctcaaaggcttaacggagcagaggaatataacggttttgagtagggaagcgttaagagatgactattagagaaaattcagcagtaaaaaggcaagagagaaagctagggaacttgttaggagtctagtgtagtagtctagtttggtccagggatgagacgatagtagctaggagtagagtgttagtggtaaagaccataagaagtggtaagattacaaatatatgttgatttaatattttctgatgaattggatataagctgttagaatgaaagaaaatcccaatgtttttggatgtgaacaattaaacacatgatgctgccatttattgaaaaagacatggagatgagacaatttggaattcaggaaagatatctaattgaaaaacaaggtaggtagttacagcaagttgattgcaaaaaaatgccaccatttcttcattccatcctgtccttatatgtgcctttggccatatagccttgtcatgcccttgtggtctcatccttctcttgtctgtgacttgcttgagccaatgagaagttagtagactgaatcaatcagaacttgataaagggtacgttttcattttcccatgtttgcacttctgctataggcatgagaacatgcttaaaataattgtactagtagatgagatattgtcctataagaggccaagtggattagcctcaggcagaaacatgagtgagtccatacaagatcaccagaataacagccaatcccttcagaagcttgaacaataagaatttattttgaatgactctgaggttttctatgttcatggagatagctaaatgaaatatatcctcagagtttctataattattttagagactggtgtagattgccccatgtagaacatgagtgtaggtagagatgacagccccaaaactgagcactatgccattctaatatctagaaataaaaagcaggaggacttacacaaggaatttaaagaataaagatatataaggagaaaattaaaaaatggggcatcctgggagggaaagctatgaaaatgctttaaggagtgttaaaaatggagaatattttaaagtctgaaaagaggaagaataatgtgagaattactaagtggcagtaattatactcaagggttgtataagagcagtgatatggtttggctgtgtccccacccaaatcttatcttcaattgtagttcccataatccccatgtgtggtggtaggggcccagtgggaggtgattgaatcatgggggtggtttctcccatgctaatctcatgatagtaagttctcaccagatctaatgtttttatcagggatttcctcctttactcagccctcattctttcttctgctgcattgtgaagaaggatatgtttccttccccttccaccataattgtaagtttccagagccctccctagccctgtggaactgtgagtcaactaaacctctttcctttataagttacccagtctcaggtatgtccttgtaacagtatgagaatggaccaatacaggcaggattgaatgaagaaatggtggcctgttttgcagtcaacttactataactacctaccttgttttctaatcctatgccattcctgaatccaagttgtctcatcaccatgtctttctcaataaatggcaacacgttttgttcagttattcatgttcaaaccttcataaatataacaaattccagttcttggagttcctctcctgtaaaaagtcactatgtgtgggggtatcatcagctctctactgattgctttgtggaaattgaggctctgggaacccaaacaagtttgaaactctggctatttctatggctgtatattaaaaagtcctttgtccttgtctcagttttgtgcattctgtgacatgttaacttgttaactctcaagaatgataaaatctccgaatccttttttttcttttactttaagttctgggatacatgtgcagaatgtgcaggtttgttacataggtatccatgtgccatggtagtttgctgcccctatcaattcgccatctagattttaagccccactccataggccccagtgtgtgatgttcccttccctgtgtccatgtgttctcattttcaactcccatttgtgagtgagaacatgtggtgtttggttttctgttcctgtgttagtttgctgagagtgatggcttccagcttcatccatgtccctgcaaaggacctgaactcattcttttttatggttgcatagtattccatggtgtatatgtgccacattttctttatccagtctattactgatgggcatttgggttggttccaagtctttgctattgtaaatagtacttcaagaaacatacatgtgcatgtgtctttacagtggaatggaaatctctgaatctttacagttcttgacaataagtgaagtacatacagatgggccgagttcttgataaaagtatgaagtatatacagattggtccatagtgtctatttatttgtcaatatggaatgaaacatggtatttaattaaacttaccaaaataataatctgttatagtttataactgttacttttggttccaggtatcatctcttatggccataatgtctgcacaaaatgtttgtttgcttcagggacttcataattatcaataaagttcttatgaatttttgtttacacaattacttaagggactctaattagcatgtatttttcaattaacttctgtgtaagccttgtcattcttccattgtgacctctttttaaatgaattggtctgtctctagcattgacctttatctcagagctgcaactcttcagtgaactacctcccttagcctctgtgagggttttaattttgcaactggaagagctttgcgtgtgtgggtgcatgtgtgataagtgtcacttcttcccttggttcaagctgaaaattatttacctcattggcaacattgtgatttctgggaagccccagttaagggtgccatttcttaaattcttcagtgcaaacacatttgcttatttcaacaaccctctaaaaaatacaaaataaatattagaatattgttccttttgaccaaatggagattgaaagacacctccaaacattatagtatacatgggcatattcattatatttaaactatatggtagaacagaaaagatactagctaacatatatgaaatgctgcttacatgccaagtattgctctgtggatgttgtatcatttgctccccttccttatcttcaaaataaccttgtagaatcattattatattttccacttcacattttgaagaatttacagtatctgagtgataaagccagcattaaaggtcatgtcttttgacaccctgttagcatatttgtgattcttctattaccatatatgtcttacaaagaagaaatatatatttagaagatgcatttatattaaaatgtggccatcttgacaaatgaagccatttgaagcataatatatgattatgattgaaatgtttgtaacctataagaggaagtacaaagatacactatttttgcccccaaaatttatttactaaaataagtttgaggaaaaatatgaagaatacattgactatatatttttaggtaaagcaaagtacattatgttgattaattataaaatgcatcttttaatcttctattctttgtctttgtacatacttgttttgaattatcatctaaataagtcactcaacataatatagtaggcataattccactattggctccaagatttccactccttccccatgagtgcaggtggaattatgcagctaatataatagttgttcctttgattaggtaaagctatattacaaaaggtgattgaagagtcactcttatgactacattatgctgtataaaactctttttagccaactaaagagggagataaatatagagatatattcctgctctgctgaaagaaagccatgttgtgaacggtctttgagaaagtcatggataggaaccaaagggagcctctaaaacgtaagaaaattttccagtcaatagctagcaagaaaatagagtcatcaataatacaattgcaagaaaataaactctatcagcaatcagtatggttgaaagaggaccctgagtcttagacatgaatcacagagctgccaacgcctggactgaagccttttaagacctgagctaagaacctagctgactgcagctcagacttctaacctacaaaactacaagactgtaaacttctgttgtattaatcctctaaattgtggtcgtttgttatgcagcaatataaaaccaatatacatgagaatgatcattttttaaagatttattttaatatccctaggcaaattaaatgctatggtctgtccacagggaaaggcacaatataatactgcataaaggatagtgagtgaagacttgtgcttgtcagttacgaccaaaagagcacactgccagagatctctttgtaacacgtgaaataaagtcttcaactgaaagcacagtgaaagaaccaaaaatattgataagtgccttcaaagatgacaggcagtcaaagaaattattataactgcaaatgaatataaagaaaacaatttagaagatcaattatttttactacatacttggaaataccatcattactgtaatcattaaataaaaagaacaataactaatcaatatttagttttctgaataattctaaagtcccacaaccagtgctttgaggtcaattcacatttcctgacaaaagaaaacatcatatccttcaaaatgtattattaatcactattgctcagcttcttgcattcctttaaattttacatcattgatttcccatttactttagcctgttattatgactttgcaagaactaaaattatactccccctcaacctatgaccaaatgaaaacgacttttgggcgcttcttttttctggtgttctattaattaagattttgatagcaatttctcacacttggtagcattaaaattcacttgaacatatatgattaaaagaacatataaaatctgaagaatattctagataaaatcaacatatgatactgtgtaagaaatttcttttttggtatattgaaaacattttacaaactatcttgtcctttgtgataccaggttaataattatcagtgttaaagctgatagttattatttcaagtactgagaaaatgaaatttgaggctattattttattcatgctgaaaattttatctagcatagtataatgtatagccaccatattaaaataattgagacttattattgctattgcagtatttgatttgtacattttactttattttttctgatacttaaaatgatatagtaaaaagaataattatcttaataaggaagaattcatttcaagtttattttttatgatgtaccacaatatttagcatcaaataatagtatgaaattattttttatcagtttactaagttttgggaaggggaaattaaattctcatattaatttctaaagcaagctcatagtgtaactttataccactatttttgcactatcaattataacaactattactctgtatggcctttgagtgaaaaatagcaaaataccttttacatataattagaatctgaaataatcactctatcaaacttcattcttacatacttatcaaaatgataaattatagcagttgataagtataacacattcaactatatttatatatatatatatatgaaggaaattcattgtgaaacaggattacataataagtttgatcactttatttctggagaatgaaataaagccttttatgccatcccatctttttcacatgaagcacaaagcttatgtaggtcatatatcactaacttaagcaatttttcattctcagcttgtttttctttttgtgctacataagcaattctgtatttttgaaatgcttcaaaaagtaaccatttaacctaagaaaataaatatttttaaacaaagaaatattcattaaaatcataaataatttcgtctatttttaattatttaaaaaataaaaggctattttccctaaaccttaattatttaatgtaaatatgtatgaatatcacaaattctaagtgattaaatatagctcatgtctgccttttaacacaaacacattcattggagttttaattccttaacgtaggagatgtattaaaccattcctcattactaatcaatttttttgttagatggtctgtatatcagctgagtttaacaagcatttattaagtgcttggaacatgtgaggaatatgttgaaaccagaggcaggtacacaaaatgagtaaaacatgttctatacttgtaagcttctcacagcctactgtgagtgaaaaatccaaaatgattttttatacatgttgctaaacgtgtcatatctgtcaagtgctataatttatcattttaatatgcatgctagaattgtttaattgagacaaggtatggacacatctgagcatagagagaaagagcattcaaaaatctatgattttttgaaggtaaccaaggcctgcataatgtctggaaagataagtatgtgagccaataagtgaagtgtgtgcagggtgttctgagcagaaacaaaaaaaaatagcctgggttaagactgggtaattcaaataatacagtatatgtattaacaaaagtttgatatgcattaatagtgttaattcaattgttttataaattgaagtaaaccctggctagaaatgaagctggagggataggtagtttgtacaggttgtgtatgctacactaagctaaaatgggggtgataaaatattactgcttaatgtctaaaagcatctatagtattgctaatctgttgaaactttcctgttaatacagtaaaagtgatttataccttcctggataaaatatgtaaaatgactagaaaattaataaattattgtttatatctagccgaatctgaatattcattgtaagtttctttattttgaagattatatttaaataataaactgatttgtgttattctctagattaggattttgaacatttacaactgcttagaaggtagagagatactcatgatttagctaaaaagtcacttgtggattagggtgtttccatgactaactaggttgactttatgggcctctaaagacaaaagattcgaatttgaccaaaagacaaaggtcaaggtctttgcaggtatgacatttcctcgtattctgttttttgaaatatagtaactctcatttattcttagaagtatttaagaatgaaaatccattaactttttatgaacctaacctaaatttattcctagcaaactgtttaataaatggaattttataacataatcttatcttactaaaatccaactgttttgccagaagcataattgacttgattctaaattgtaagctctctattaaatttcatgatactgccacttagatttttaaagcttagtagttgaaaataacccctaaacttaaaaaaaaaaaaaaaaactaaagtaatttaatgctctcaaggataaatttctaataaacatgtttgacagagaactaaatagaatggcaaatagtaaaactatccttttatatgtcattattttaaaaagacaaagattatataagtcatgcataatatttgcaagggtgtattttgcattttatgttacctattgttttaatatacattcttgtttaagcaatgttttttgttctaaattatattttctcatatccatttaaatctaagtggaatcacagctaacagttctaaattaaatttctaaaatgtatacagttctcaaatgtaagacatttaaatacattttttatagtaagtgcttcgttaaattattggtctttactatttctcatgtaattttgtagggtgagataatccatgtaaaatagctgtgaatggcacatataaataacttaataaatgtttcttagtagtagtagtgttattagccacatttttatatttctgaattaaaatgtgagaatgatttattagcaaatttgctaaatgtgagcattttttctataatgttttaattagtaatacacatcgacaatcatagaatagtaagtaccttgtgtttgaagtggttttcaatgtatattctttatttgcaaatacttcatccaacagtgaactaatatgtccagaatacaaaacgaactcaaacaacacaacaggagaaacatgaataatttcatgaaaacatgggcaaaggacacaaatagacatttctcaaaagaagacatacaaactgctaacaggtatatgaaaaaaatttcaacatcactaataatcagagaaatacaaatgaaaattccaatgagatatcacttgtcccaatcagaattattattgttaaaaaggcaaatagtatcagatgtgcaatgatgtggagaaatgggaactcttatacgctgttggtaggaatgggtactagtacagccactatagaaaacagtatggagctttcttaaaaaactaaaaatagaattaccattccacagaaattccagtacagaaatttctttttacagaaagaaaaagaaatcaatatatcaaaggaattcctgcactaacatggttactgcagcactattcacaatagcaaatatatggaattaaccaaagtgtccatcaacagatgaacagataaagaaaatacacacaatggaatactatttgaccataaaaaagagttaagtcatgccatttgcagcaacatcgatggaagtggaggtcagtatcttaagtgaaataaaccaagcacaaatagacaaatattgcatctttttacttatatgtgggatctaagatatttgatcaaatgaggtagatggtgggaagatagaaaacagaaacttggaagggtgaatggggaagaaggggagggtgaagagaagtgggttaaagggtacaaacttaagttagatagaaggaataaattcaatgtttgataaccgagtaggatgaatatagttaacaaagttgtattgtacccagatgatggccaccctaaatatctgactcaatcactacatattttatacaagttgcaagatttcacacgtatctcatgaatttgcacaaataaaaaataaagaaaatgcaaaactatacaaaaagactataattttattgattatataactgttcctgataattatattgtctaactgatacatgccgaaattatttagctcatcccagatcttaagataatcattataaatgatatattaaataatacatacatataattacatatacatatacattcctctaaatgcttgaactatattaccatatttccataataaatgattcctaagatggtaagatattccatggtaggttctcatatactctttcacctataaaaagtgactatgcatctgtcaaagaaaagtttaaaaggattctatattacaaaataacttttatcagaaactagaatgcatttagaatattgtttggcaggtctagaaagacttaagagcactccccaccctttgttccacagaacacatatctcatcaattgcaccttgatcaaattttgacaaatggttatacgactattaaacttagtataagttaatattttttcaattttattgtttctcagaagaactttttactcatttggctctttataacattaaaacatataaaacctaagttctgtgaaacaaactttgggaaattcaagtgtatggtagaaattcagaaattcaagtgtatggcagacataataaggaaaactagagatatatgcaactagatattcattagaaaatttttctgcagaaatttaatagttcacagattcgactgcaagaagtttcagagtaaagggtctccaatacataattaaaggcccttaaactctagcaatatttaagaaacaggaatatcaacttccacagttttaaagtaaatgggctaaagaaggctaaaatacactttgaaaatggagaaattcatctctgaagatcccagactgacttactttaattaattgtttattccacatttgagatattaagtagaacttcatgatagttctatgccactaatggaaaaaatgtggcatatgcatagcttttatagtcaagaggtcacccattcctttggatataatttgatccaataaaaaattcagatatattttatacgtgatattatatagggaatcaacagaaccctgaatgaaagaataaaataattagtttttaggagttagggcaaaagctatcatgaattttagtccttttactacaattaatgctggaatccaagataattgcaaaatataaatgtcaaaatggtttgtaaaataaatgtgtttaatacatatatcaaaaagattttatttaattcttttgagtagctttttaaaattaacaatttaataaaatttttagcacctgttatgatttgcctctgtgttcccacccaaatcacgggtaaactcctattcacatttgcttcaaagagaataaaatacctaggaatctaacttacaagggacgagaaggacctcttcaagaacaactacaaaccactgctcaatgaaataaaagaggatacaaacaaattgaagaatattccatgctcatggataggaagaatcaatagtgtgacaatggccatactgcccaaggtaatttatagattcagcgccatccccatcaagctaccaatgactttcttcacagaattggaaaaaacgacattacagttcatatggaaccaaaaaagagccctcatcaccaagtcgatcctaagccaaaagatcaaagctggaggcatcacactacctgacttcaaactatactacaaggctacagtaaccaaaacagcatggtactggtaccaaaacagaaatatagaccaatggaacagaacagagccctcagaaataataccacacatctacaaccatctgatctttgacaaacctgacaaaaaaaagaagaaatggggaaaggattccctatttaacaaatggtgctgggaaaactggctagccatatgtagaaagctgaaactggatcccttccttacaccttatacaaaaattaattcaatatggattaaagacttaaatgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaataagtgggtgagggatatgaacagacacttctcaaaagaagatatttatgtagccaacagacacatgaaaaaatgctcatcatcactggccatcagagaaatgcaaatcaaaaccacaatgagataccatctcacaccagttagaatggcgatcattaaaaagtcgatcattaaaaagtcgggaaacaacaggtgctggagatgatgtgaagaaagaggaacacttttacactgttggtgggactgtaaactagttcaaccattgtgtaagatagtgtggtgattcctcatggatctagaactagaaataccatttgacccagccatcgcattactgggtatatacccaaaggattgtaagtcatgccgctataaagacacatgcacacgtatgtttattgtggcactattcacaatagcaaagacttggaaccaatccaaatgtccaacaatgatagactggattaagaaaatgtggcacatatacaccatggaatactatgcagccataaaaaaggatgagttcatgtcctttgtagggacatggatgaagctggaaaccatcactctcagcaaactatcgcaaggacaaaataccaaacaccgcatgttctcactaataggtgggaattgaacaatgacaacacttggacacaggaagggggacatcacgcaccggggcctgttgtggggtgggaggaggggggagggatagcattaagagatatacctaatgtaaatgacaagttaatggattgcagcacaccaacatggcacatgtatacatatgtaacaaacttgcacgttgtgcacatgtaccctagaacttaaagtataatcaaaaagcataaaaaaaaaaaactggtggcattgtgcacctgccctagagatgtgtggaactttgcacttcagagggatattttagggtatctggtagaagaaatttctaagcagcaaatcatccaagaggtggcttgggtgctgttaaaagtattctgttttaaaacggaaacagagcaaaaaagttcagaaaatttgcagcctgatgacgcagtagaaaacaaaaacccattttttggggagaaattcaagctggctgcagaaatttgctaagtaacaaggcacttaatgttaatccccaagacaatggggaaaatatctccagggcacgtcacaggtctttatggcagcccgtcccattacagacctggaagcctaggagaaaaaaacggtttctttgactgggcccagggtcctcatgctgtatgcagcctagggacttggtgctctgcgtcccagctgctccacctgttgctaaaaggggccaaggtacagctcgggccatggtttcagagggtgcaagccccaaaccttggcagcttacacgtgatgttgagcctgcgggtgaacagaagccaagaattaagatttggggacctccatctatatttcagaagatgtatggaaatgcctggatgcctaggcaaaagtttgctgcaggggtggggccctcatggataacttacgctagggcagtgtggaagggaaatgtgggattggagccctcacacagagtccctactggggcaccacttagtgagctgtgagaagagggccaccatcatccagaccacagaatggtagatccacctataacttgtaccatgtgcctggaaaagctgcagaccctcaatgccagccagtgaaagcaaccagaagtggtgctataccctgcaaagccacagggtcagagctgcccaaaactatggcaacctgcctctttcatcagcttgacctggatgtgagacatggagtcaaacgagatcattttcgaactttcaaatttgactgccccacaggatttcagacttgcatgggccttgtaacccctttgttatggacaatttctcccatttggaatggctgtattttttcaatacctgtacccccattgtatctaggaaataactagcttgcttttgattttatgggctcataggtgcaagcgacttaccttgtttcagatgtgactttggactgtggacttctgggttaatgctgaaatgagttaagactttgggggatgcttgggaaggcaggattgattttgaaatatgaggatgtgagattcggaggggcaaagggcagaatgatatggtttgtctctgtgtcttcacccaaatctcaccttgaattgtactcccataattcccatgtattgtgggagggacccagtgggggataatttaaatcatgggagcagtttcccccatactgttcttgtggtagtgaataagtcttatgagatttaatggttttatcaggggtttctgcttttgcaatttcatttttctcttgccagcaccatgtaagaagtgtgtttggggtttctgcttttgcaatttcatttttctcttgccagcaccatgtaagaaatgtgttttgccttctgccatgattctgaggcctccccagccatgtggaacaactgtaagtccaattaaacctccttttttccccagtattgggtatgtctttatcagcagcattaaaatggactaatacagaacctattcaattacatctaaaatattttattgaaataatatctaatacggaacatatttccacaaatctggaactattttcattctacttatatattgtaaaacatattgaagtagagagtagaatgattgttaccagaggctgggaagggtagtggggaaggaggaataaacaggggttggttcatgggtaaaaatgtagttagacagaaggaataagatttaatgttcaatagcataatagggataatatagttaacaataatttattgtatataaattctaaaataactagtgaagtgaatttgcaatgtttccaacacaaagagaagataaatgtttgaggtgatagatatcccaattactcttatttgatcattacaccttgtatgattgtatgaaaataccacatataccctataaatatgtataattattataaaaattaaaataaaacaaattttgtttaaataaaacattttcttgattattgagatcccactcatgggatatgtgaacttaagtgacttctaacttcacattttaagttagtttcctttgtctaacgctaaacattttgaatacattaaaaaaaaacctcagctctaataaaattagcaggattatgtactatagggtccccttgttatcggtgactttgttttttgcggtttcagttaccattgataaccaagatcggaaaatattaatttaaaaattccagaaataaacaattcataggtttaaactacaggccacactaagcagcatgataaaatctatgagcactctattctgttctgccccacccatccctttgccaagctgtatatgctacctgcctattagatacttatttgtggtctcagttatcagactgagaaaacatactactgtatatatggtttggtactatccacaatttcaggcatccactggaagccttggagtgtatccctcacagataaaggacaatgggactattctactgtcaatgagtatttaagaaatatagcctaccctgatttaatggatctcatttgtagtgttttctgatatctgacagaatttcactaaactattacattgtattatatgttgattaatcttttgtatttaggataaactatcaggtatagctaatacagagaaatatttctacttagaaacattcataatgatgttttatattttaactgaattattttcctgtcttataaattggtagcaattgcctagagctaaataaaatataagaataagtgaaagtaacaggtttttgaaacttaagaagcaaaagaaatcatagaaaatgtaaagaatttgatagcggtctttattaaatatttttgtaatttgacaaaataaaagtatactttacatttctaaataaagcataaagtttttacattttgaaaatcataatttcaatataaaaattttaaatgtatagaatgattccaagcacacagaattgttaaattattaatatattgatttttttgctattaatggatactatatggaatttaagatgaaatatttgcctaaagaatataaatttaatgtatcaagggatctagaaaattaattttaaacaatattttaaattgatctgcactctagtatgaaagtagagactgtataactcattctggataatttagcaacactaaaggaaaaggtgagaactggttcgtggaccagtgtgctttggtaaacaatttcttacttgtccacgatgaagtatagaaatcaagagtaagcatttaagtactttcaagcaaattgacatcagtgcaacatttcctccattagcttttattttacaaaagtattggtgtgcaattacagatacctattggtctttcatcatagacagtttgaaaaatgtagagagtgaataagtagaacttctcctactttaccttctcctctgcaagttaaatcaatttcaatacgctaaattgtcttgaaagatctcatagtagttacagcacattaccttaactgagaataatgtgtttgttcattagcttgatgacctttactcacctaataatgatttttaaagaaatatatttgtaacattaagtcattaatcacattcagctacacacacacacacacagagagaaagagagagagaaagaaaaaaaggaaggaagcagggagggagggagggagggaggcagagaaataaagagagagagagagaatgtgtgattacttcaacagctcttgctaaaagaacagaccataaaaatagcctttttaaaaaagcatattaactccattatagaaatttgtacaaatatactgtatgtccccatagaattgaaatgcttatatataaagtactcttttaatcaccatcatgatactatcaatattgtaattcatatgtatagactgtttattatgttagatcctattctaggcactctatattatttttttcctcacaacactatgaagtagggagaattattatctcaattttacagatgaagacaatgagatttagatacattaagtatcttctccagaataattctctttgcagtataccagttgaacaaatatctttcttagcttttattatacaccagattagtttggtctggtttagtcctctttccagggagagaaagatagaatttacaatctcagtaggcataagaatcagtgagtctcttattacaatgcatattccagggctccacggcagagtctgactcagaatatgtaagtggggccaagaattctagattttaatacagtctccagataaagctgatgcatgtggttcagtgttgacaatttgagaaacacagataaatgaataacattagtaataaatacggtctcataaatactaatacacaaggacaaagtcttaggaaagttttttaaaaatagtaaatgattatatagaggaggatgaaataaaaagaaatgagatttacacattaggattagcttgaaaaatatttttaaaaatacaggtaagagaccaggagcagtggctcttgcttgtaatcccagtgctttgagagatagaggcaggaaaatcgctagaagcctggggtttaggacaagccagggcaacacagtgagactcctatctcaaaaatataaaaattaaattaaatttaaaaatacaggcataatacttgagaagatgtccaggttagtagatctattttactgtatcatacacagggcaagagttgtaatttgaggtaactgcagaaaaaaaactggatccaaatgcaggggagtgggagacagattttgtaattccaagataagatttccgagcttcacaatatgccagttggccctggcagtatcactggctacagttaaatatagaaatgctaccagctactccctctggatcatgttacatagacttaagcatgaaattgtaggccaaataatgcccctctacctccccaaaaatgtatctctggaacttgcacatatgtcatgttacatggccaaaaagcctttgaagatatgattaaggttaaggactttatgatgcggagattagcattcattagccagatgggcccaagccaatcacacggactttaaaagctgagaaatttcttcacctggagtataagatgtgtggagggagaaagtagcagacagatacatcagaggggaaatcaaagattccaaggtgaggaggattctttttaccagttgctggctctaaggtatgaggcctctacgtgaagaggagagaaagccttaggagctatgggcagccccagctgacagccagaaggaaacaggtatcatggtcctacaaacttgaagaactggatcttgctaacaatcagaatacgccagaaagtagattttccccaaaacctttggatacaaacccagcccactgaaatttttattttagccttgtgggactccaaacagagaaatcagcaaagaacaccaggacttttaacttataaaactgagatagttttttaagattattttaagatgttaaattgaaaactaatatgcattgaacaagatactgtgaatcaatacctgaagattttgcagtatgataacccatccttcagtactatctgaatgtcaagtatcctatattttaagtcagcacatgccaaacatacatttaaatgtcaaaaatatatgaatctattttaccttaagtgaaaaagatggacagaaatttagtgtggtatatgtagaaacaattgggagctatgaaaatattttttagtatgagttcatgaaacctgacagccaaaccaaaaaacatgccaacctcataattcacaagtacattttcaatatatttagtacttcctgaaagcttaaactaatctaaaaatatctttatattttgatgaacagaatacaggttttttattaagagcgcttagcacaaaataattgcattactaacttcttcttcagtattgccaaaattataccttaaaattaaactttgtggttatagtgttttaaactatgaattaagttgccaggataaagaatattcaactattgtgagagctccttagaaaaacaacgattattactatcaccgtggaggaaattaagtcttggaatttatcctcccttgctacacaaaagacagttcagaaaagtattaggtagaaaataatgttcaaaactgctgctatctgacattatttaggatataaaacagagaaagcattttactaaattattagccagaggattttttttctagtgaaaaatactgtactagaattagtgtttagtttaagacattcccttacatgcaagatgttaacatttatactgaaacaattctatttactatgtgattgttttctttaaacacattatattttgaattattatatggtttagaaattaattgcccttgctacggtatttatgtatctctttatgataatgttagacctgatgtgataaattctgtaatatggtcctggggagatgaattgaaatctgatacactatccctatggggaagaaaaggactctttcctaaattagatggaaattttattgtcaaatcacatagataagaaatgataagtccatgatttctatctgaaaccttcaagaacaaattatttttgccatcagaattatttttgctagcacattttttaaaaagcaaaacatgtagattctgtgcctttaaacactctgagtagagcctgggcaccatcccattatcaaacgatattttcctagtgatatgtatgagtatccacactaagcgtgataaataaagatcataaatgtcctctattcatttggcatcaggttttgatgccaactgagtttgtaccaaacttctaggaaaaagaaaaaacacaaccttcagttttgagaaatatttagttgtcctcttcctggtttaagggattattgatcttattcctggaaaggctgtttcaggagtagatgtcaactcttgtctctttctgaacttcttctcttgactctaactttcagagaagacagattactagtttactttctggtagactggcacagcacaagggactgtagggtagggtctgtgatgcctgacacacaaatcaggtctagagtcctattactctcacatttaattccgttttgttaattcgtaaccctgtagcaatttaatggtctcacatagtgatataaaatattaaaacccactaagtatagcattttactatacattaatgattaataacaagataaatttcaggacaagatttgagacaacatgatgttgtctcaaatgttgattcttctttcctacttgaaaaattttgttagattacattaagggcagtggtttgtttgccactaccatcacttaccttcgtaatataccttaaatccatgagcactaactgcaaaatcactggtcaaacgtagtgagaacacagatttggtacttgtcactggaggtggcagatggaatcctgttaacctaaaacaaaatggaattaattgttagagacataatcattttatctaagagtttttaagaaggattaaagtcatatttaaaaaaaataataaaacagattttctcctataatttccagaaggaatgctatccagccaacaccttgatttcagcccagttaaactcattttggacttcagccctccagactgcaagataatacatttgtgttgtttaagctactaagtttgtggcaatttgttgtagcaggaatggacaactgatatacaattctttcctgggttttggaatatacatttttaaaatatctagataaatactaatttattctataattgaatatggaagtcctgtgaaacctagtgactaagttaccaagactgctgttgatattatataaaatgagtacattcagaacctattaaggcaatatttatgtaattatgactaaaaatctctctatgaagagcgataacatagtatgagatattatatatatagtataatatgaaattacatccttacattagaagatacaagagaccgagaagaattaggcaactagatcaagttcacagaagagccaggtctaagactacaactgtattattgcctcctattatcaattaaacaccctgtttggcatctgattgtctttgagacattaataaaatagaaacaataaatatttgaactattaatgtgtacattaacatccaaatcattttgtatacaatttcaaattggtattcactcagttgtattaaataatatttgaagcaatatttagaacacttttatcattaagttactcaaagtaatagagaagaacattgtgaagaattgttcacttttagcaaaagctgggtttctgtatatatgtttaaataatcagcatgtagtggcatgttgtgtaatgggagatttgttttgtttttttaattttaatcaatgagagaacaaaatgtattttttaaaagttattttcatataatagctgtatcattatgaggatttgaggtaacttgttttactccttcttgtaatacgttgtataattgatttaaaaataaactcagttatgagtctaattagttttttctttataagacttcattttgtaatttcatatttatgtgcatagttattaaacatctttttctcctttggatactatgcttcaagatgtcaatgttttttctgcatctgttgagatgatcacgtgaattttgtttttaattctatttatgtggtgtatcacatttattgacttacgtatgttaaaccatccctgaatctctggtgtcaaacccacttgatcatggtgggttatctttttggtatgtttttggattcggttagctagtattttgttaatgattttcgcacccatgttcatcaaggatatcagtctgtagtttccttttttggttatgtcctttcctggttttggtattaggatgatgctggcttcatagaatgaattagggagggttccttctttctctgtcttgtggaatagtgtcaaaaggattagtaccaattctttgaatgtctggtagaattctgctgtgaatctgtctggtcttggactttttttcgttgctaattttaaaattaccatttcaatcttcctacttgttattggtctattcagggtgtctaattcttcctgatttgagctaggacggttgtatttttccaggaatttatccgtctcttctagtttttctagtttatgtgcgtagaggtgttcacagtagccttgaacgatcttttgcattttggttgtgtcagttgtaatatctcctgtttcatttcttagtgaggttatttggatttcttctcttttcttggttaatcttgtgaatggtctatccattttatctttttgaaggaccagctttttgtttcatttatcttttgtaattttttttgtttcaatttcatttggttctgctctgatcttggttatttcctttcttctaccggctttggtttggtttgttcttgtttctctagttccttgaggtgtgaccttagaatgtcagtttgtgctatttcagtctttttgatgtaggcacttatggctatgaactttcctcttagcaatgcctttgctgtatcacagaggttttgatacatcgtaccattattgtcattcagttcgaagaatttgtaaatttccatcttgattgcgcttttgacccaatgctcattcaggagcagattatttaaattccatgtatttgcatggtattgagggttccttttggagttgatttccagtttcattccactgtggtctaagacagtgcttgatataattttaattttttctttatttattgaggctcgtttttggcctatcatgtagtctatctactggtctatcttgtagaaagtttcatgcattgtttaatagaatgtgtattctatggttgttggataaaatgtgctgtatatctatctgttaagtcagtttgttccaaggtaaagtttaaatccattgtttctttgttgagtttctgtcttgacctgtctagtactgtcggtggagtgttgaagtcccccactattattttgttgctgtctatatcatttcttaagtctattggtatctgttttataaatttgggacctccagtgttacgtgcatgtatgtttaggattgtcatattttcctgttggacaaggccttttaccatcatataatgttcctctttgtctcttttaactgctgttgctttaaagttggttttctctaagaacacctacctctgcttgcttttggtatccatttgtatgaaatgtctttttccacccctttagtttatgtgagtccttatgtgttaggtgagtctcctgaaggcagcagatagttggttggtgagttcttactcattctgcagttatgtatcttttaagtggagcatttaggccatttacattcaatgttagtattgaaatgtgaggtacccttgcatacatcgtgcactttgttgcctgtgtactttgttttttatttgtttttggtttttaacttgcatttttgttttataggtcctgtatgatttatgctttaaagaggttctgtttgatgtgtttccaggatttgtttcaagatttacagctcctttttagcagttcttgtagtggtggcttgataatgtcaaattctctcagcatttgtttgtctgaaaaagactgtatcttttcttcatatatgatgcttagtttcgctggaaacaaaattcttggctgataattgttttgtttgaggaggctgaagataggcaccaattccttctagcttgtagggtttctgctgagaaatctgctgttaatttgataggttctcctttatatcttaatgtaataaaagccatctatgacaaacccatagccaacataatactgaatggggaaaagttgaaagcattccctctgagaactggaacaagacaaggatgcccaatctcaccactcctcttcaacatagtactggaagtcctagccaaagcaatcagacaagagaaagaaacaaaggacattcaaattagtaaagaggaagccaaactgtaactgtttgctgatgatatgatcgtttaccttgaaaaccctaaggactcctccagaaagctcctggaactgataaaagaattcagcaaagtttccatatacaagatccaagattaatgtacacaaatcagtagctcttctatacaccaacagtgaccaagtggagaatcaaatcaagaactcaaacccttttatgatagctgcaaaaaaaaattaaaatacttaggaataaacctaagctaggagtcaaaagacctctacaaggaaaactataaaacactgctgaaagaaatcatagatgacatggacaaatggaaacataccatgcacatagatgaggagaatcaatgttttgaaaatgaccatactgccaaaagcaatctacaaatttaatgcaatccccatcaaaataccaacatcactcttcacagaattagaaaaaaacaattctaaaattcatatggaaccaaaaaagagcctgcataaccaaagcaagactaagcaaaaggaacaaatctggaggcatcacattacctgatttcaaactgcactataaggccgtagtcaccaaaagagtgtggtgctaacataaaaatgggcacatagaccaatggaacagaatagagaacccagaaataaacccaaatacttacagccaactgatctttgacaaagcaaacaaaaacataaagtggggaaaggacaccattttcagcaaatggtgctgagataattggctagccatatgtagaagaatgaaactggatcctcatctttcaccttataaaaaatcaactcaagatggattaaggacgtaaatctaagatctgaaactataaaaattctagaagataacattcgaaaaactcttgcagacattggcttaggcaaggatttcatgaccaagaacccaaaagcaaatgcaataaaaacaaatataaatagctgggacctaaataaactacagagcttttgcacagcaaaaggaacattcaccagagtaagcagacaacccacagagtgtgagaaaatcttcacaatctttacatctgacaaaggactaatatccagaatctgtaaccaactcaaatcagtaagaaaaaaaagaaaaaatcccatcaaaaagtgggctaagggcatgaatagacaattctcaaaagaagatatacaaatggcaacaaacgtgaaaaaatactcaacatcactaatgatcagggaaatgcaaatcaaaactacaatgcaataccaccttactcctgcaagaatggccgtaatcaaaaaatcaaaaaaccttagatgcttgtgtggatgcagtgatcagagaacacgtctacactactggtgggaatgtaatctattataactactatgaaaaacagtgtggagattccttaaagaactgaaagtagaactgccatttgatccaccaataccaccactgggtacctatccagaggatatcaagtcattatttgaaaagatacttgtacatgcatgtttatagcagcacaattcacaattgtaaaatcatggaatcaacccacatgtccatcaatcaacgagtggataaagaaactgcgatatacacatatcatatatatgatggaatactactcagccataaaaaggaatgaattaacagcatttgcagtgacctggatgagactggagactattattctaagcaaagtaagtcaggaatggaaaaccaacatcatgtagtctcactaatatgtgggaactaagctgtggggaccaaaaggcttaagaatgacacaatgaactttggggacttgggggagagggaggtgggcacgggataaaagaacacagatatagtacagtatatactgcttaagtgatgggtgcaccaaaatctcacaaatcaccactaaagaacttactcgtgtaaccaaataccacctgtaccccaatacttatggaaaaaaaaagatgtcagtgtttgggactcagagtctaaaaccagtgcttctgtcaatgtatgtcatggaggagtctctcagtaagtacttattaatctaatgagttgaaatggtaggagaatatcgatgccatcttaacaatttcttattcacactaagaattgtgttcttgaaacatcataagaatataaatttattgttattaagttattaagaaaatttctatagcttaagtagagactcttgttcagagaaagtaagttttccccatgttaacctcaaaagtttaagataaatatctcatgcacacttttttgacatatctttctaggaacaacaatatagttcgaaaacttattttaaggtaaagctaatatgatttgtatctttaaaatgtgagctataaatttatggtatttaaatatattgttttcacttggacttaacatgttttctaggtaatttaaaagcatactattttatagataagtatgctatttttccatgtaattatttgtactggttttgatatttgtaaaatttagttttttgcatatattgctcgttactacattatcagttatattccctccgcgttgatgcacgatgaaattgcatagtgaatgacattttatgtttctttgaaaattgtaccacagtccagcggtattttctttgactcacagttgaagaaatcacagctcaggaatgataagtaaattgtttaaattcatgcaggtggtaggcaggtagtggagcaaagataaaaacagtaacttcagacttcaatccactaggactttcccataagagaaatgatttttttctatgaagccagaataaaattttaatcagttttggtttttgcacaatgcccatgtaggtttcttaacaagtattttgaatgaatagaacatatttcacccacatcacaactttaagtagttgtgggtggtaagaattattatgaagtcattgaattaaaggtgagtaaggcaatggggagccattgtctgactagttggtgacagcttttttttttttttttttgacagagtctagctctgttgcccaggctggagtgcagtggcacgatctcggctcactgcaagctccacctcccgggttcaccccattctcctgccttcagcctcctgagtagctgggactacaggcgcccgccaccacgcccagctaagtttttgttttttagtagagacggggtttcaccgtgttagccaggatggtctcgatctcctgacctcgtgatccgcctgcctcggcctcccaaagtgctgggattacaggcgtgagccaccccgccccgccagttggtgacacctttatagcgaaaactgcactggttagcaaagatatttcccgactgggaaaactaagtaagattagtaaacatttaaatatatgagacgaacatcctggaatcatgcaatataaatttcaggcagatatttttaatatgtcaaaaattaaggctgaccaataaagtattaaactgtattcattctgattattagtgaatattttgtcacatcttgacaataactatgttctctcaccctaaatttgtctttcaaaaatgcatgtaaactcatactaatgaataatcatttcattttgatacatttagtttcatgaaaattctacagcttttcctctatttatttttttacatttcaactgttatttggtgaatattttgtcatggaccaggacttgtctatggcaattttttcagtacattttctcatctgacagaatggtgcaatgtattagctggtattttttttttcattttaaattttatggtttctaattgataatctctattcttatttgtccctactcccacatacacctccaaccccatcttagcattttatgttttactagacaagaaactcatcagaggcttttgttccctgtttgaaaaatcatgcacttagaacatgtgatcctgtctcttctcatgttcccttttggatgaaaacattcttgaaatatttcctctgtaaaaacttagaaatgataacgatattttatactgaaatgaataactagtcacaaggagaattaaacaattaacttacaactttctatcaataactaatatgaaaagtactaaagtaattatttggtaattaatgaaaaagtgatagaaatttacattgcaagaaatccatttaaaatgtcaatgaatatgttttttaaataataaattgtacgtttagaatattttgtaattaatgagaattaacatactgtatttcaacttaatgtgatgggaattcttaaagcatcagacttgttaaagcatataagaatcagcatcattcttatagataagaatgatacctgtctcactatctaactatgtttattaggttttaactgtaagattttattttttctgggagagttgagaagaacgaccacacatatacattctctaagaatgtaaaaaaaaaagactctatttatttaaatgtaatgtgtataacagctgattacaatattaaaatgttatttaaagaatggatgtaacaggcatcgttttaaattaagaggttattagcatattgctgcttataataagatagaagcaaaatagacatggatgtaagaggtaagagagaaagggagagaaagggaagcaggaggaaaggagagaggacgaggagtaaagaatgactgatgaagaaagaaataggaagaggagagagagagagagatttatttaaaaataaaagtggtactattacaaactctcaggattttgtgaatgttaagtaaggtaattcatgtgaaatgatctagtgtactttttggataacaaattgtcattaaatattagtttctttagtgatgtgactcaaactccattgccctttttgctgcaccctgtactgctaatgctaagatatattatataatacgaccagcataagcacagtgatttcacattactcacagtaagacttttggatatgaattatcttataatttttctttggttcaacagtccttaaaaatgatccaaggatatacagagaattctctgctgaaacaaactattagcctatttaatgtcacaataaacaagaaaaccacaggaacaagctgatatttaaagtaatggctgttctgttaaaataaatcatgcatatcctattgatattggagtacatgaagcacagcacaataattcatggttatgtcaagatgtcactggcagtaatattaaagaaaaatatggctgtggcaacatttgaataattgtatcatttgttgagagcaaatgacctgaagcttctatcaaatataaaattccagaaagaaacgtgtgagaaaggcaaattcaccatgttgggaacatgtgctgggtatacatgtaaatatttgtcagtgaagcacttccataagatttggaatgtgaataaaagttgatgtcatggcaggtaggtacggggacttcagaaagttttagaggtgaggtttatgcattgacttaacagaattcttattaaaaacaagcatttgattttgcaaacaactgagcttatcactggtattttcctgcaattctgcaaattcttgattacctgaaagttagtgaaggctatctttgaccatcaaaagccagccttaaacctagaattcttattattaaaagaattcctgcttgaaatatttcatttttttggtctgagcactgagaaatgcaaaaagactaccagcctattaatgaaattttcctctccaaataatttcaaagtaggttattttctagtaaattattttcactctttttgttacaaaagtgttcctttgatttctagcacaagttacagtaatatgcaaataattcttagataagatgatattgacagtatattcttaactatttgtgtaaaactatgcataattttcattattttaacttttggcattttttcctctatataaataaaaatgatggctgatatttaaagtagaaaaatataaaccacaatcttctagagaaaactttttcttcctgcaaaaatggatattgataaaaatgtagatattctcagctcactatatttaaagataccatgtttccagaaaatttgtttttaccattgactttagagtttgatcttcaggatcaacattttctccagacccatgaaatacactactaaaaattttcttcaaaagtcaacctttccaatttgttctctttatgctacaaatacttcaaaccttctataatgtcccccttcttattttttccattgaataactgacgtttaaggttatacatgactgtaattccaaaggccatcttgaatcattgagaaaactagaaatacaggaaaattatgtagagcaattaatcaatttaaatatattttacagtttccccaccttgtataaactcctgaaaatgttaattagcatatttttctaaggtttctaagaagcagttgactctagtgactataagcttgtattttagagtatacaattgaaaaaaaaattcattctgctgcttattagcagtgtaatattgggcaagctactttattccaaaaaactagggataagatgaggtaaatactaggaattatcccatagttatgttgggagatttaattgggataatgcttgtaaaagcttaccacagttgctgacatatgctgaatatgatttttaccataattattttgatgatgaacccacccaaggttcatctaattataaaaaaactcattcagtgataactctggagctggactacctggagtaaatctcagtgattccatttactgttgtgtgacattgggcaggttacttgcctctcctgattcctcagtggcaaaatgtagatgaaatggtaccttccctttaagtccctgtcaagtttaaataagttaatacaagcacatcacttagaacaatgccaagcatttagcaaactagctactcttgagaaagatgacagatctgagaattagagaattctttcacacaccactcagagttttcttcttgacgcactacattattgatagctataacaaacttggagtatttgggataaatgtagtatttcttcaagtacatgctattgtgttctactaggttgtttattttttctgctaagtttatcattgctatgacttttgatctttttggatgtagaattagtaaagactcatcacaagttatttatttaaggtcaatttaaaaaaattatgaccgagagagaggtgagagcattgatgaagattctcaattagaagacagacagagagagacagagagagagagagagagagagagagagagagagaaatacatctgtgtctttagtaacttacaattactgagattgagtcaactgacttcctcccataaaccctgccacctttttttggtgcatttcaaagatatctatcagaaagtattgcacacactttatcatgttaattttactgtatttctttacaagtactctatattcattaaggaaaaactgaaacaaaacaaaaaacacgattctacaaatgcatgctttgcatttcccatattgacaattttttgtttggtccacttatccagtccacaacaataagaatttaactcaaaatttatggctccttctatttcccagaaaggtaatattaattagcacccactctcggttttagcaaaacatgaaatttacacaacttttattattttttatgcatttaaaatgtatatattataatgtggtattttctttgtcaatttcctccagtaattagagggtttgcacatacaatctatgccaacaaataataaataatctttgtgatatgttccatggtaaggatgaatcataatttctttaatctgaaataattatagaatgtttctgaggatctattccattaccagttttgttgacttaaatatttttaaaaaatatattaagaagagatacattttacataaaatacaaagagcactgcaattggagattttgaataaagccttatgatagtgatgattaaagatgttttgataaagaaactactatagtttcatctagacattgtaaaatttaggagtgtggagaaccttttcagaaaagttttgattctgtttttaagtcaatattttatttacaaagctattagagacaagttactgagaatataacaattactcttacaagatacatatagccattaattgtttccattgtgcccaataacactttcttataaaattatcaccactgccctctgagatgattatttatttgtgtgtatgcatgcatatatcccaatacaactggtaaataacataacacctcaaaatattatttctaatcattttaggttaaataaaagtataatctgtcttcattggaatacatcataaagaaaacattaacatgagaatgcagtgacatggaacgtacatgtggtcatttacctaattaatgaatttagacatgatttatggactaatttagtgttttcaaatgatcattattttcttgtcacatgaaaagccattcagtcaattattatactattttaaaataataatcataggccatattctaacatttaaattggaaaaatggttaaaattaaataataaattacttgtactgttataagctcttttactctatatgaagtatttttttaaattacccatttatataataaatataaaatgataaaattttctacttcacaatattgaaaataattaaggttaataaatactagtaaacataattacataataatgtcttcatatatttgaatgttctatttttcaacattctagggatacttatgtgagatttactaatatgagaaatgccaatttaattatattttagtaaactctaataactatatattttagttgttgaaaaccatggaaatatgacttgaagttgcaataaatgttttgctgtctattatgtatctgttttaaacataaaagtctgctataatacatgtgactttccccattatctgtcagctaatattatggcattaaaacagagtgattagattaaagtaactcatcataatatttcaatcatttaacattttcatgataactacgataggacttcattgggggaattaaaattttctttttaacactgcatttaaggacagttattggaaaattgcatgtttctttgaaaagctaataaagtttctatgtaagaaggaaagctaaggtattatggattctagatggaagaaataaaaaatactgactactttcgataaggctagtagatagactttttaatttgggattcctttgagagcatctcgttttcagttacactatggaaatagacaagaaaccaccattgtcctggaaacccaagatgtttgttcccctacgagtagccaccagtgtatcagatactgaaaggtttaatagagaaatatgttattgactgtacacaaagttatatgaaatcatcaataaagtcagagagagggaataaattttgtttgaactaggtgtgtattctacacaaaaaaactaaaggaagtaaaataaatatcaatagacaaatgtcaatgagtattttatagtgaaaataacaataaaagtaacttccttgatagattttcatttttcaaggttctacttctacttacttctaagtagaagttctacttacacatcacagacaagattagaataattgcataatgtttttaagccaatatccactaggtttaggaattagcattttaccatattttataactgttaatgtgtcccaggtattcaattaataatgcctagtttaaaagaatgtttacagtttactttgtaattattatttctttctttaggggacccatataactctgaaatttgggtacaattttgatggaatagaagaatgatagaaatagtttattcttacatggtgtgtagttagatgacaagaatgtaaaataaaaaatttataagttattgaatttctgaaagagagaatattggcaagcataatattaaacagtcatgttcgtaagtgcataaactaatttatattcaaaatattccaatcctattttgtaaatgataaaaatttaagaaaattcaataatatattttttatcattagatcaacaaaaatatacataaaacaaaagcatattcttaaactatgtactgatgtgcatatttggaaactaaatattatgaagagaaaattgtttgtaaatgtaaattggacaattatatgcagaagcattatcaattatttttattagtctttgggaacaaaaaataatagacaatttacacacaaaagtatcactgattttttggagaatttgaaatatgcttgtgaatgagacaaaaatgtaatttttgaggtaacatatgagatggcatgctgttaaacatagtagttatattaacagttgccagacaattttagcaagttacattggaggtaatattattaggttgatgcaaaagtaattgaggatttgccattattttttaaaggtgaaaacctcaattacttttgcaccaacctaataaaaaatgaactaatatgttaaaaatatgaaaacagagaaggaaaagaaggtggagtgatgggaaagtagggagaagaaagatgaaaaaaaattttgctaaatttttgtaacctatcaaccaaccaaacaaactgttccagcaggcattttgttttagagtcccattttaaattccttctaaacacattatctttgtgatgttccaatgttaaatcattgcaaccatgacacaccttcactctagctatgttatatgcacatgggtagagacaaaattttactatttatactatgtaatatagttctgaacattataacatctatactctcataggtgaaacatttttatcttcagataacctcttacctgacctttaagtatacatatatatttatatatatacatatatatatatgattcctattttacgtgcccacttggatatctaatccacatctcagacatatgtccaaaacctgaatttggagattagaaactgagaagtggagagaagctattatttctcctttctctcttcctttctcttcatttgcttctggtagcaactgtggaagtgactgtattgctttgaggatccctgctttggtggcagcagccctctctttgtggttcagcagtgaccatatgattccccatctatagggtgagcatctgctgatggtcctcccccattcccatatccactatgtgccacagtagtgcatggtacatggcacacacagaaatcagtttgttttgtattctggaaagcccaatccctcggtctcactctctagccatattttctttctttgctaaataactcctgaatcacttcttttcctttacccgctttcatctcttcacttcttttataacaagttccctttattaaattctttctatttgttttcctagtcatagtttgaaacagaaattaaagaaggtggctatttatgggtagaaaataattttctcatttttctcaccaaagatgtaggaagaaaaatacatataagaaataaaattaatagataaatactttacatttagttacagttaactgagtactaccttactgatgataaaatcagatcacggtttaagtgttatttttcttgagtaaaaaatatatttccacaaatgatattctatctccattgaaaccggatttatatctaggtagtcttaaatgaattctaaatactgttttacatcagaactcactgtactctctgagccattagatatgtcttcttgttaccatgtattacattaagaattacattgccaaatatatatgattcacttaatttaattttagctaattaggaacatgaaactatcttgaaaaggaaattcaaggatgcttttaaaattaaattatttatgttaatgtaataatagtttgtctgtttttatgttaaatcagcataattattttaactaatgaaataatgttaaatgctaccagttattaagtttctactatgaatcaaacattcaacatacattatctcattatctcccataacatatatgtctatacatgactttatttatattattccattttgaaaatgaagaaaacaaaggcctatgagaatataaatttctcgttaaaggccacattgtcagcaaacggaaaagtcagaaattaggccactttctttttgctgttctgcgaggactctcaattagttttgctaaatttttaatgagtgtatccaaattattctgatgtaagaagttaacgtgaatgcttaaaattaatctatggatctgataattagaaaatcaccttgttctgagtagcttcagtgaggtgacaaatctaacttattgcttattaatagaaataggaaaagaggaactatagtagcccatattgactatcattttaagctatttgactgtgaaaaaaaataagttacagcgtgactgacattcaccttaataaaggacaatcctaattacagacttgcggaaggagaaaatgaggaacagaatcataacatcataaatagtaatgcggagtcatagaagccaagatttcaagagtatcctcactaatgattatgtaaaacatcatgtgggtgtcatgtactgagttaatgttttacacatttaatccacaaaacactgtaaaaatagccatgttttatatccttattttccataaagtttatttttattttcattttatttttaatgggtacatagcaggtgcatatatttatggggtacatgatgtattttgaaacaggcatataataagccataatcacatcatggtaaatgggacattcatcaccccaagcatttatcatttctttctgttataaacgtcccaattatactcttatagttatttttaaatgcacaataaattattgttgactgtaatcaccctgtcatgtagaaaggttaagtggtttgctcaatcctgtttgtttagtggaagaactataattcaaaagaggttttttttctgactccaaaattcatgttctttctactaatttaacactattgccaccacaatttacatataatatgaaggtgaagaaaagacagacatttagaattaagtattagaagaacaaaatgttttcccatcaaagaacattaacataaaaaataatactgttttaaaatattagctatctaaaggtagagcagaaagaatgatataaaataaagttaaaaatttagcaataggccgatttagtggattggaaaatatgtgagtttaaaatagaatagtagaaaactagggccagcatgttagctcacgcctctaatcctcgcactttgcaaggcccaggtgggcgaattgcctaagcttaggagttcaagaccagcctgagttctagtgtgattgcattttggtctcagattgtggcaattcctcagatatctagaactagaaataccatttgacccagccatcccattactgggtatatacccaaaggattataaatcatgctgctataaagacacatgcacatgtatgtttattgcggcactattcacaatagcaaagacctggaacctacccaaatgtccaacaatcatagactggattaagaaaatgtggcacatatacaccatggaatattatgcagccataaaaaaggataagttcacgtcctttgtagggacatggatgaaggtggaaaccatcattctcagcaaactatcgcaaggacaaaaaaccaaacattgcatgttctcactcataggtgggaagtgaacaatgagaacacatggacacaggaagggggacatcacacactggggcctgttgtggggttgggggagaggggagggataacattaggagatatacctaatgtaaatgacgagttaatgggtgcagcacaccaacatggcacatgtatacatatgtaacaaacctgcatattgtgcacatgtaccctagaacttaaagtataataataataataataataataatagaacagcctgggcaacatggtgaaaccacatctctactaaaatacaaaaaattaactggttgaggtggcacatgcctgtagtcccagctactcaggaagctaacacaccaggagagaattgcttgaacccaggaggcagaggttgcagtgagtcaagactgtgccactgcacaccagtccaggcaacacagcgagactctgtctcaaaaaaaacccaaccaaacaaacaaacaaaacagaaagagagcttctgaaacatccaaataaaatatttgttgaaagtaaatgtgtgaccagattctagaagggattttcatgagaagaacaatagaattgaccctaacagggcaattagtgtcccatgaatgttatgttatcagatatagagaataccaaaaagttggcagagagaaactgtctttcctccttctgtttcttggttagaaaacacacgatctctacacgtcagaaaaccagccaacattgtctctaattcgtagttccaaatagttgccccatcacgaaaaccatttttctgcattctatcaaatataaacttccagaaaacaactagataaaaaatttagtggcttcaagttgcatccttgtaaacacaagcgaaaaaataaagcatttatagaaggtggtaatgggcagatacagggtcatgctactttctcataaagttaaacacaacattatttatgtttgtcctttcttgtatgctgtaagaaaagtatatcaatgcttgatcagaaaaagcaaaacattttgttaaaatattgtgttatttgtatatattgaattaaattgttttattaagttaatatattaaactaaagaaaagaatttccacgtagctattatgaaattaggtgctagaaatatagataagatactctattaggtctcaatacctatcataaaactatagtgtttaagtcagtacagtatttgttaaagggtaaacatactagaatctggtcgcacattaactgtcaatacatactgtcagtattatgaatgaaaatattttacttggaatttgatggaaactttggaatttcatgttagaaattgttcatagaaaacatcaaagttaaccacgagaactgaaatatgaaaaatttacctaacaatttgatgcagtagtaaatcagatgggaacaataaattactccaattaatcataccaagaaaacatttagtttaatctggactaattagtaatctaaaaatgctattttatttaaactagtagtcatttctgatccactcattaggcaaatattacagaatatttatatcataatagtattatgttaagtatcagacatacaaagacaaatatagctgctcctaaccaaaaagattcatagtctattcagcctattcaacaccaagagctggtcatattaattagttatatatttactttttgtatattttttgataaagaaacacattttaatttcaaacaactatagacgttttaccatgatggaaattcaaagtcattgttttatgtaacatgcacctgactgacacatttagttattccgaaatcttgtagaaaaatatcaaatttctgcttttattaaaacacaaatttagatgtgattaagcagaagagacaatatgtagcaaattaaaatttgttgatacacagtaaagctggatatatttaatcaacaggctttgatacaacacacagtaagtacaatattagctgtgtgaacttgcacaatgtcaaataatagagaatagtaagagcaattagaaggtataaaaataaggttaatactataattaaaatttaatttttaaattggatgtggaagatatgataggaatatagttaggttggtgttgaaaaataaaaatgaagattttatgtgaaaaattttcccccatgatttttatttattctggatattaatcctgctaggtttctctcaaaacatattttgaaaatacttacgtattttaacctaaataaggttttttttctaaaataacaagacattgatatgataatagtgggattcattttataacattagcacttcaactgtaaattgatataatcattttcaacattttattttcattattgacctcaaaattaagaagcaaattaatttgttaaatctgtttcataataaaatattccttttaaacttaaaatcagcaagtattttattgagcatcaattatgaattaatcaagaggatagtaggtactcatcatttaatgtaatatcttgcttattttaatattctcttatcatccaaagacaagagaagaaaacctcaaaataacagaggaaggtttgtttgtagtagcttctttttggaaggtgggaagctgatggaggagagcttggagagactagttacatgtttggtaaaatccgaaggacatagcagagatgaaaaactcacaaagcagagttcaaggtctggctagagatgagggtcacagaaaggatagcaaacagtagagactgaggaacaggaaggtaagaaggagcgagatccctagagcagcgatctgcacacaatgcctatatcaaaacattgtgtccatggattgttcatatttgttgaaggaagataggagtaaaaaatatttcactgaatattttcttattgaatacatattaatttttatactgtagtctaacagagacagaaaaatgtatttcttctggtaaagaactcacatgtccctctggctcacaagtgcattgagccaatcagtgctgctataaatattagccaaaagcgtgctcaacaatactttttagaaagatttgtctgtatgataaaggataaatacataataaccaatttggtttcaactgactatctcagagattactcatgggtttgttctgcattcttagtaatatcttatttttaatgtagaatatttaataatttgtaaataagatagtgttaattctagaattattttcctttcctttttttgctgctcatgcttatttgaaaaatatgtgtagaatagctatttgtgttatattgctataataaaagcataaaatatgttgccctgcctaagtagtcaatgggggttgaggaaacagattccatggtctagaaatcagattgaattcagttagtaacacaatatattttttgtttgcaataactttgaaggcatatcaaaagcatattgagcctttaattggagagaaagtggctagaaaaaccagaatgttagtggatgtggtaaataataagtacaagcagccaacaaacacatgaaaaaatgcttaacatcaccagtcatcagagaaatgcaaattaaaaccgcaatgagataacatcttacaccagtcagaattgccatttttaaaaagtcaaaaaacagctgggcacagtggctcatgcctgtaatcctagaactttgtgaagctgaggtggatggatcacttgaggccaggagttcaagaccagcttggccaacctggtgaaacccctctctactaaaaatacaaaaattagctaggtgtgtggcacatgcctgtattcccagctattcgggaggctgaggcaggagaatcgcttgaacccagaggcagaggttgcagtgagccgacatcacgccactgcactccagtctgggtgacagagcaagcctccatctcaaaaaaaaaaaaattagcaaagcatggtggtgcatgtctgcagtcccagctacttgggaggctgaggcaggagaactgtttgaacccaggaggcggaggctgcagtaagccaatgtggcaccactgcactccagcctgggtgacagagtgagactctgtctcaaaaaagtcaaaaaaaaaaaaaaaacaacagatgttggtgtgaatgcgaagaaaagggaacacatatatttttcatgagaatgtaaattagttcaacctctatggaaaaccacgtggagatttctcaatgaactaaatgtagaactaccattcaactcagtaattccacaactgcatatccactcaaaggaaaattctataaaaaatcattctataaaaatgatacctgcacatgtatgttcactgcagtactattcccaatagcaaagtcatggaaccaacctaagcatgcatcaacagttatgtggttaaaggaattgtgatacatatccaccctgaagtactgtgcagccataagaaagaatgaaatcatgttctttgcagccacctggatacagttggaggccattatcctaagcaaattaatgcaagaacagaaaaccaaataccacatattctcacttgtaaggaagagttaaacactgaagatgcacagacatacagatgggaacaatagatactgggaactactagataggggaaggagggtgggaatataggctgaaaaactacctataagtactatactcaacaccttggtgatgggattatatgtatcccaaagctcagcagcaagcaatatacccatgtaatgaccctgcacatatatcctctgaattcaaaaatttaaaaagggcacgatatttattatacaagtgtgacaaatgcatacaattgagttaaaatgagtgaaaatgaactacagcaatatgccacagcatggataactcttagaaacataaggttgagccaaaaaaagcatgtcccagaaaactaaatgggatgatatatattttataaatcttacaaattaacataattaaacgtgatgttgcttagggatgttcatgtatgattcatacatgttcatgtatgattaaagtataatttcgaaaaaagttaaaaatgaccacaacatggaggtgcttgttactggtagggtgaagtcagagcaaggagaggatgggatacaaatgaaacaaaatgtgagcagcatccttgtttagtggtaggcttattggtgctgattttaataaagcacttcacaatgtgtatgttacagacttatatattattatgaataaattgtattcttaaaatatagtaatagagaatatagaaaatttatatggcaagataaatggatgcaataaagagttaacgctagtattctaataaatatattatggcaatgaactgttttatatattttcatttttttaaataatcacatctcactcagatataatttgactgttatagttagaaaacataaccttaaaatgaatgaaatgaggttgctgattagtttatgtttttttttaattaccacaaaaatgtaggcagtggctgtggcaagggtctatattctatacattttagttcttctatctgtcctgctatatatatgtgacacttgtgatttttttctctaaaaatatcatttaaaaatacaactgaaaagcctttagtatttctgaaaacaaactgggtgactgtaaacttaattatatatatttttatgttgataaatttaattatttttctgtatgggttcagtatcttttaaataactttataacatcaaacttgaacatctatgaaggaaaagtcccctttttacatgattatttgatggcacaatatccttcagatgtatgtcacgttttaacagaaaataggtcatatacatgagatttttaagtggaccctgatataaatgtgaccacttttcttataccctttaacctttgtgacattttaatttatatttagtaaaatgactcaatgaaataattcaataaatttatctgattttatggttgcctggcttaagtcttcttattcatcactccaaaaatgctatagttgaaaaatgcaaataaatacaattaatgagctgtgctcgaacctatttatgttcacacttcagtctcttgaaatcctgtttttgatcttgaaacagatatcaatacttttgagattttattttctcacctgtatatataatataatataatatataatataatatatattatataaaatatatataatatataattataatatataatataatataatatatatattatatatataataatataatataataataaaaaatattaggaagaatatctgaaatgatgttatgagaattgtatatgaatagcctgacagagtatgtattcagagaatgttagtttttaacagatacagagtatatgtaccttccttcagaatatcaaatattaacacaactaaatgaatttgaagagttaatctaaaatgtcttatctaaacattttatttacgagctcatattaattatgtaaaaattttgttactaaaaacatttacatttatgagaacattaatatgctttctgtaagattatcaaatggtcacttcgattatgccattttactgatgagaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagtgcaatcaggcaggagaaggaaataaagggtattcaattaggaaaagaggaagtcaaattgtccctgtttgcagacgacatgattgtttatctagaaaaccccatcatctcagcccaaaatgtccttaagctgataagcaacttcagcaaagtctcaggatacaaaatcaatgtacaaaaatcacaagcattcttatacaacaacaacagacaaacagagagccaaatcatgagtgaactcccatccacaattgcttcaaagagaataaaatacctaggaatccaacttacaagggatgtgaaggacctcttcaaggagaactacaaaccactgctcaaggaaataaaagaggatacaaacaaatggaagaatattccatgctcatgggtaggaagaatcaatatcgtgaaaatggccatactacccaaggtaatttacagattcaatgccgtccccatcaagctaccaatgactttcttcacagaattggaaaaaactactttaaagttcatatggaaccaaaaaagagcccgcatcaccaagtcaatcataagccaaaagaacaaagctggaggcatcatgctacctgacttcaaactatactacaaggctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcacgacataggcatgggcaaggacttcatgtccaaaacaccaaaagcaatggcaacaaaagacaaaattgaaaaatgggatctaattaaactaaagagcttctgcacagcaaaagaaactaccatcagagtgaacaggcaacctacaaaatgggagaaaattttggcaacctactcatctgacaaagggctaatatcccagaatctacaatgaactcaaacaaatctacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagagataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcacaagaacaaaaaaccaaacaccgcatattctcactcataggtgggaattgaactatgagatcacatggacacaggaaggggaatatcacactctggggactgtggtggggtcgggggaggggggagggatagcattgggagatgtacctaatgctagatgacgagttagtgggtgcagcgcaccagcatggcacatgtatacatatgtaactaacctgcacaatgtgcacatgtaccctaaaacttaaagtataataaaaaaaaaaaaaaaagaaaatgtggcacatatacaccatggaatactatgcagccataaaaaatgatgagttcatgtcctttgtagggacatggatgaaattggaaatcatcattctcagtaaactatcgcaagaacaaaaaaccagacaccgcatattctcactcataggtgggaactgaacagtgagaacacatggacacaggaaggggaacatcatactctggggactgttgtggggttgggggaggggggagggatagcattgggagatatacctaatgatagatgatgagttagtgggtgcagcgcaccagcgtggcacatgtatacatatgtaactaatctgcacattgtacacatgtaccctaaaacttaaagtataataataataaataaatttttaaaaaaagagaaaatgaatgtttatggagcgtgagtttcactttactaaatattttattaaatatttttagtcaattacaacatcatgtgtagtttgcttttaggatatcagtgctgttttaccgaaagcaggctaatggaagtaaacctttccacagatttactacaaaagattgaataaatataatctaaggaacaaagtgtttaaacttgcttattgtcatcttttgtttgatcttttaaccccagttttaatggtttaatttagtctatttcttcactaaaagccacctcatttctttttggcaaaatgcctggtataaacaataaatagttgtgtatactctggaatccttgccttagtcagatttgaaagagccttttatgttgaccaaaagttttagaaatcctatctgtccttgagatctatgcaatcattaatttgaatgctccaaagtaagtaatgataactaaagagaataatcattaactgcctaagatgcatcaaaattttaattggctttttttctaattcacttgcatgcccaatgcccaatggcaatgcagtaagtcttttgtaaattaaagtattaggtagggggatactaaacacaatataatggtattttcaagtttgtatatagaaaaatgcatttctacactcagcttctgtttcctggggtatgtgttttatacaaggctatgactgaggtcatagttgaaccaacagtaagcaaagttcactttgtcacttggtgtgtctcattaatattatagataaataacaaaactctagtattgcttttcttatttattgagaaataataaataataactattattatagttgttaatatcacatatgtcatttcagcacacagctatacacgcaatcactctatgccattgagtcagacagtagagcctctgcgtttcccagatgttttattatataagagagagaatcagtacacaagggttggttccaactctgaagggagaaatctttatcgtcagctaattggattgagttatatcactctcaatgtaatctttaggaaaacttggagatagagacatgcgagacaatgtcatcaggtagagttaaatcactggagtgcactgacataaaataaaactaccctctggtcatttgtttctatgacctaaggcatttagatatttttggataattttcatggaaagtcattctctacctcaacattatgcctacaggaaaggaaacagattattgcatggcattaaaagaggcatcaagtatagtgaggaaagattttaattgtgagtattaggaagttctatgggacattgagggagcaaaggagagaagaaatactaaccatgtaagaaaataagtgtagtggctgctcaaaaacatttatggggatgctgccaacattttctgaaggagaaaaggtctacttgttatatgttaattataaagaaccaaaaagaaatggtctaacaattacacaagtgggaattcaagctacagatggtttattcactctaatttctgttccttaattatgtccattaggcttttgaattctatggttatgacaacaatccatcaagtttgtataataaatatgaattgtgacagaatgttacatattttaaatccctcaacgtatcaagaaaaaaaaatactgggtaaagaattgatatttaataaaggaatatataaagttcagataatttagccatggtaatgaaatatattctagaataatgaccaagaaggtataaaaatattatatatagtcacaaagtaaaaatccaaagagggagaagagtaatattactgtagaaatacagataaaaaataaggcctagccttttctggaaaaaacttagtttatcaagtaatacttttaagaatgtacttgaaacatgctttattataattgtgtccagaggcagccagctaggacacataatttattaagttgttatttctaggattccttaaaatgtacaccttaattcttcttcactttaatgcttaaatagaacaaaatgaacttagactccttcacatcttcaagaagaatcacagatctaaatataaagctaacactctaaaccttcagaagaaaatacaggatatctttccatctttggataagcaaatatttattgtactaccagaaagcactaacaaaatataatattaataatttggactttgttaaaattagaaaccttaactcatgcaaagataatgtaagaaaatgaaagagcaagtaacagattggaagaaaataattgcaatgcatgtatttgtcaaataaatgctataaagattgcaaagatccttataatttgatacatcaagactaagcaaacaacccaattaaaaaaatagacaaaatatttgaacaaactcttcataaataaatggttgataagcacatgctcaatattattaggcatcacaaaagtgcaaaataataccacaataaatgctgacaacctcaaatgtcaacaaaggtgtggagcatttagaattctcatacagtgatggtgaagtacaaaatgcgtacacagcttagaaaagctatttggcagttttttcttatgatattaaatctatatctacctaataaccaaacattttgactcatctcatttcacagaatgagagctttaaaaagttcattttacccatggctatagagtgtttctctattttacaactttatgtgtttttgcaatagactgcaatttttttaattctaagttctgtttcatacttggggaatttattctcaacatattacaaaattttgctattatttgcaatataatatattttgtgatttttcttaatgatgattgatgagatattgacatgtagcaacacattaatttttctttttagttctataaatatccagtaaatcatttaagtcttttttttttttttttttttttttttttgagatggagtctcgctccgtcacccaggctggagtgcagtggcgcgatctcggctcactgcaagctccgcctcccgggttcacgccattctcctgcctcagcctccccagtagctgggactacaggcgcccaacaccacgcccggctgattttttgtatttttagtaaagacgggctttcactgtgttagccaggatagtctcgatctcctaacctcgtgatccgcctgcctcggcctcccaaagtgctggcattacaggcgtgagccaccgcgccctgcccatttaagctttcttatgtatacagtcataaaatctgtaatgaattataatttggtatattgttcaatatttagaactcatatttctgtatctgtatcgttctattttgataattaattctttttaatgatgtgatagcttatacttcctttgtcttttattttaatggcatagaagttataattattgttttcaaccccgtataagtgaactttaccacctgtagaccctctttaaggagaagttaaagagagccacaaagtttatatatgcatctggatgttatttagtttaagaaattaagagatagtcttttatcaaccaacatattaaaatcagctttcaatttctttacggcagatgttttttgtttttttgttttcttttgttttgtttttagagacagggtctggctctgtcaccctggctggagtgcagtggtgcagtctctgctcactgcaacctccgcttcctgggttcaagcaatcctcccacctcagcctccagagtagctgggattacaggcacaggccaccacacccagctaatttttctgtattttttgtagagatggggtttcaccatgttgcccaggctggtctcaaactcccgagctccagccattggcctcccaaagttttttcttttttttaatgattttattataatttcaacttttatcttggattcagagagtatatgtgcaggtccattacatgggtatactgcatgatgccaagccctaggacgtgaatgatcctatcacccagatgtaagcatagtacatgacagtttttcagcctatgcttccttcgctccctccccacactattagtccccagtgtctattgttgccatctttatgtccatgagtacccaatgtttagctctcacttataagtgagaacatgtgatatttacttttttattatctgcctccgccttaagattttgtgttatgttaacacttacacttacatttgattttatctttacctatccatttgtttttaacatttctaatccatggacgtttatataactcaggaaagtgaagtttatgttgcagtcattactacaccatgactatgaccttgtgataattactccctgtttttaaatcacaactttggaaacaatttatttagaaataatatttatttatttacctatcaaaatatccaaaaaataagctttggatattgtgatagattttgtcagttgcctggccctcagtcttctccatgctgttttccacaactgaggttgaaaatgaaagctgtttttctagaatactgttgaccaagggatggtgatgtcaggctgttctggccaatgatataggagaagaatccttctaaggacttttgggaaagcttttgatttactgatgaactgtataataacaaacttcttgttatataagaaaaataaattttttgtttaagctacagtaagtcaggatttctgttacagccaaacatccaaagtgataggccatatcaaagtagcaatgaggagaccagagtaacatgtcaggagtcacactaaataaaagtttttgtactcaagtcttttaaaaaataactatactactacgttggttatttagaaataatcattctcttccactttgagaaaagattatcattccataatatttcatatgtattaaggttgtacatgttaaaaattaggaaaaggaatttaaaaatgagaatttataaaacatctagctcttgactttgtaacattaaaagaaatgaaatgaatctttaaataaatggataatatatatcatataaaaattttaaaattcttcacttatttgtgcagaaaaaacagctaagatttaacaagcaaccaagaagctgagaaatatttttgtcacaaaaaggaaatatttacatgtttaagaataaatgaattatgtaaatcatcaagaaaaatattgatacatagacaaaaaataaattacaggagaaaaccagcatggttatcaaacaagagaatatgttaaatatctataaaaatcagatatatgtaaataatcaaattaagaataaaagatgtaagtctgggaagactgagaggtaatgaagtatagttttctagttgtaataatattcattgatataagattctggaaagcatattagtaatataaagaatattatttgcttctgacctagacatcctgtttctaccaagaaccaatctaaaatatagaaaatatatattcataaggatgctaatacgtgaattaattataaaagaaaaaacaaaaatataatagaatgataattacataaattatatccacaggattaaatatttgcataaattaatgcttacataaaatgattaaatatacttaacaaattcaataaattaatgtttacaaagattctaatcacacattagacatgtacattataatgtagagagattattaaggacatacaatatcatatatggaatgatcctgggtaaatatatctgtctctgcctcattaaataataggtgattttttacttgttggtataagtttattattcggaaaatataatattaatgtaaaataaacaaggcttagaataacctttatgcttccagcaatgttgccttaaatgcatcagcacttgttctaagataaaattatgattaagaaagaaattatctaacggtgctttgccaatatcaattctcttttaataaaaaataacttacagaaaaacaagtaatatcattaatcattggaggcttagagtacagtttttaaaatatgaaattctgattatgaatcccagtgtgtttatttatacaagcaagaatgacaagacccacaaaccattttttttcctacattattgcaagacaagtgtaagaagccatttttaaaaaatctattggagctcatgaaaagtaaaaaaaataaatatcaatttctggaagaaagagaacagcaaacacaccataaggacatgcattaagtgagaatatgatccaatatgagagaaacaaaacccaagaaaacagtgagtcaaacagccagacgcaaatatgaatcaaactctgccagcagcagtttcgacttctaatcaaacagcagattttgtatataaacacagtctggaacgggctgtaggttacatactaatttttttctttccagtcttgctaactaaagtcagctataacattaactacagtacttcttgaagcacaaaaaccaataaatgtgttaaatgtttacagtgagcaaaacattagactctaaagactatattataacatagactacatgttagaatatagtcttgtcattttgcttgtataaatagagtacatgtatgaatatagtctataaaataaataggaaaaataaatttgtagcttacctttcggtttatatttgtatatattacacctgtttgaaaatataccttttattattatttctcttactaaatttgatccaatactgctaagaaaaaatagatttttatttatatatcaatacataaactttggagattgtgtctaactacatagaattatatatattgaagagcttcagatctaaactaaacaaatctgaattgtaatgatagttctgccttttgccactttcaaaaattttactcgggcaatcaattcaagcctcattttatcagttgtaaaatgatgatgataatagtaattattttacattgtttggatacaggagaagttaaataccataatgaacacaaaatacatagcacagtgacaggtgcagaggaatcattcaataaatgttaagggttagagtcactgagctttcattatattgtattccccataaaatctctgtgaattaagtgctattattcccaatttacagattaggaaagaaagaatgagaacaataaatttattttcctaacttcgcaattttttaacttcccagaggccacagttgtttagaaaagcaggaaagaggaaaaataaaaatgtgttttctcattttcaaggcaatctagagagaataggtacatgtacaagcattactatcagggaattgatactttgaaactaacaggtaatattgaaagaagtatttttatatatttaggaaaattatatcccacagattgccagtgtaaaaaattgtacttccacttataggtattatttgcattaacaaaagacaccagcttttaatgacagtggcaatgatgatcaaacagcagtcagacgtgcgtaccataatgtatatttataaaatagatgattattgtatgagttacaatgtaaaagtttatgtatgagtttacaatgtaaaaggaaaaagaaatcagatttactcggtaaacgagtatagaggaaaaaaagaaagaaaaatagaatcttagctgtaatcaacctagtaaccttgtttttgcacaacaaagtttgtgaaataactcaggcatttttaagtgtcatctgactggaagcagttcgatgtgctctaataggattttgtagacatgcagcaggttcatacacattttctcgtaatacctgcagaacagtataatgagatggctagaaccggccttactaccatctctcagtttaaacagaggtagcgtagattgctcaaaaagctggtgagcaacaaacctaacatcctaatgtaataaatctcatctccagatccaccattttccccactacattatgtttttcattgccaaaacttgaggaaaataaacactaattctttcttttttcttttttttttgagacggagtcttgctctgtcacccaggctggagtgcagtggcgcgatcttggctcgctgcaagctccgcctcccgggttcacgccattctcctgcctcagcctcccaagtagctgggtctacaggcgcccgccccgacacccggctaattttttgtatttttagtagagacggggtttcactaaaacactaaatttttacttaaaattgaaaaaatataaatgcaaaggaatatggaagactgatgaaactgtaaaaagttagcactgataatctgcttcttgtacattaggaaggcaagaacatgttatcaactattagaaagtaacaccatcagagaatcataactcaaacatagccaagtatgtaaagagtctttaattcctacatgttaccttcttagactattttaaattacaagtttaaaaaagcttatggcacttaaagaaaagtatacaaacactggcataaatctaggactaaataaaatgtgcaattcttggaatgttgaattttttagttgaattatagttgatttacaactaaaataagtttctggtaagacctcaaaaatacttctaattttacataacctctttgccaagagaaaattctgaagaaccagaagaactaccttaaaaatagtcagggtgctagttaatttttacatctgtttaatcaataagcttcaaaaaacactttcatttatagaggcaaaaatataaatgaccccatttttgacatgaaagtatgtagttttcagatatttagattttataaactacacacattatcagaaattaatttattctactattcatgaatgctgacttaaggtgtttttgcatagtgttgtatattaaaattggacatattatcactgaaatataccttatatagtatgttttactttatcaaaagttatatccataatgaatgaaaccttgagataatcatttttaaaaacaaaatacctttagccactataaagagatcaccactcaatatatattcacctttgtgagacatagtattaatgtactagcaatatgacatcagagacaccaagctaatttgttcatgggatgatatattttcaaataaataataattagatggtgaatacaactttattataattgcatcacaaatgttaagcatcttttgtaaaataaactacttttacccaggaaatattttctctccagtcttccattcaaaacacactaaccttgtcctaaagtttgtaggatgaggatgtccatcatataatgataagtagtcgtattcttcttctagagcaaatgactgaaaaacaatttgtattctatttcgttcttctgctattattacccatgtgcagtttgcaccatttggatatccatatggaaaaccagggctttctatagtgccattaagtccttttaaagttccaccacatgtataaataaatcctgcaacaaaagacaataaacagacattaatattatataaatcaagaacaatccatgagataatattattttgaaagtctattgcatttccaagaccaaagttaacaataattttataaatggcagtttaagagctgggcactatatacaaatatatatgtaaaatataagaaacaaaataatagaagatttatcatttataatacatactgaggtaaataattataaagcagttgatgaaataaaattatccacatacatctgattcattatccattacaggttcctatagacaaacacaatcctagaacacggtatctttcttcaaagagttttaaatctcattgtgggagctcataaacaacactgacattttaaagatctttgtatgcattttgggtcccaaagaattaactccatttttcttggcaacacatgctagcttttttgacatattcagatctctaccctgtagctcacatgctttaggaaaatctgtctcaccctgattatagaagaggaattttttaaagtctatgaaatggctctacctttcattaaaatatttagtccatgatgaacagaattctaaattaaccacatcagagtgaatccgaaggtcaggacaaaaatacgttaaataaatggatcttggacaactgacagcacccatcttaagaacttctgtatttgttccatggaaagtctaagttactgagagcatgagttctggagatacctagaaaacttactatatttcttcagcaatttgtctcttcaaatatatatatatatcaggtatatatattaaatatatatctcaaatatatcacaaatatatatcaaatgtatattaaatatatatatcaaatgtatattaaacatatatatcaaatgtatattaaatatatatcaaatatatatattaaatatatatttttttgagacagaattttgctctgtcacccaggctgtagtgcagtggcgagatctcagctcactgcaacctctgcctcctgggttcaagtgattctccagcctcaacctcccaagtagctggaattacagacatgcaccaccacgcccggctaatttttgtatttgtagttgagacggggtttcaccatgctggccaggctgctctcgaactcctgacctcaggtgatccacccacctcagtttcccgaagtgctgagattacaggcgtgagccaccatgcctggcctcttcaaatatataatattctgtagcatattgtgtaatgtaaaaacctaagattaatacaaccgtaagagaagatggtcccagtctttatgtaggctacatgctaataaaacttgcatttagaggcggttaaacaggatcagaagttctcatgagaaactcttcacccagatgttattatctttatctgtgagtcctacaggaagctgaagtgccagaagctgtaaatcagagttatcaagctaatctgagggagagaagtcgatactaccaaaagcatctatgtttggaactggcatagaaatgcaggaaatttggggctcctctctttgagaagaaatgaatatattttatgtaagtatggatactttttaaaagtaagaggaatgctgaatagaagtcctcagaagccagagttgtagattatggcagatagtggctgatttgggatgttgtacatttattccacattcttttcacaatagcaccttgtttttgccagggaagccacttctctatcaaacagctatatacttttttttttttttttgagacggaatcttgctctgttgcccaggctatagtgtagtggcgtgatctcggctcactgcaacctccccctcctgggttcaagtgattctcctgcctcagcctcctgagtagctgggattacagacatacgccaccacgcccagctaatttttgtacttttagtagagatggggtttcaccatgttggcaaggctgatttcgaactactgacctaaagtaaaccacccacctcagcctccaaaaatgctggattacaggagtgagccactggccaggccaaaacagctacatactttggagcagctgactctgctgactccagtgatgagaaatgtggctcagggcttggttgaccaatataatcctatcctctgagcaaaatttactacagggatcttttcctatatctcaccatatggcaaagtcttaagcctgggatatttggtatgtttatgtgctataaagcatagttcttgttatcattttgcctctttgaaaattgaccaggaagttggatcaggtagaagaggtttaaaaaaaatcaatatttgtgtatattcagataattttgctcatgcaccaaaagtcaaatagggcattttatgattttcaaaaataaataaataaataaaaggtctctttttaaattgcttcttgcagagcaattactttgaagccttaggttaattagctatcacccatttctattagttttctgcctgaacagcttccaatttgaacttcataactaaaggcaagcatgaatcccttcagctacaatctgatctacgggctgttttatatactctcaagccccataaccctgatagttttagaaaaaggacatatgtcttaaaataacatgctcagctttgtccactcattcttcaagggcctgctgattcatggatttcgagtacttttatttttagacaaattaggaattacacctatatttaaacttccttatctgtattcttctttttacttttgtttttgtttatcacaaagttacattaaacatagcattattctctagaataaagtacattttttccagaaaggagttttaaatattttactttaaaaatttgaaaatcagaagtaagcattataaagcaaaatatcctccctcattcatttatgcttcacagggttggtcatttttaatagcgcagtgtttttcttactaggcctttcctaggcacaagcagatatccattctatattatttttcaagtgatgtcagtcatattatgcctatttttctgaattgttatatctattttaaaaaaatcactggcattcttctgggtacagatgtagacttctactacattcttctttgaaagactttatagctacacagcatatagtacgcctatagtataatttattttaccattctcctaatgataacttcatttttatggttataacggtctaatgagcaactgtgtaaaaacaactctgtacatatatccttgtacaaagtatatatcttttgtgtacaaagggcatatatccttgtgcacttgcttgatacctcccaagatggaatcccagaaatggggttgcagaaaatttatacagatacagtgaaaccatacttaataaatatgaaaatttatgtttctggcaccactgtatgaagtgtttttcaccctcaatcctaattctggcaacattagatatttttgaaaggcaaattttgtttttcatttttgctttttaagaaattttatcatgtttatttgaaatttgcaacttgatgctgtggaacacatacagagagtaaagtggttaccatagtgaaatagattactgtagctatcatctcacatagttacttttttgtttgacaagagtagctaaaatatacttatttaacaaaaatccttactacaatacaatttcattaactgtagtcctaatgttgtacatcaggcctctaaacttgttcatcctacatacctgctatatgacctacagctccccactttctcttccccttactcctgctcacccatggaaatcactgtttcattgcctatgcgtgtgtacttaagctttttaaaaaaaatatattccacatataggtgatatcttccaatacttttatttttgtgcctggcttatttcacttagcataatgtcctctaagtccatccaggttgtagcacatggtgggatttcctcttttaaggctgaataagatgtgtgtgtgtgtgtgtgtgtgtgtgtgtgtgtgtgtaaaatatattccattgtgtatatataaaaagggatctatatcccctttttaaggctgaataagattccattttgtgtgtgagtatgtatatatacacatttcattttctttatcaatttatctctcaacgtgtatctaggttgtttccacattttgactattatgaataatgctgcaaaaaacatgggagtgcagatatttttacatggtggttcttgtatctcattttggtatatacctggaagaggagttgctgggtcatatagtggttctatgaatataatatttttaatttatttaggaacctccatacagttttttcgtaatggctgtactaatctacattcccgccaatagtgtactagggtttccttttctccacatccctgacaacaattgttatctcgtctttttgataataatcatacttacgggagtaaggcaatatcttatagtggtttaaatttgcatttctttaaagattaattatgttgagcatcttttcatatacctttttgccattttatagcttctttggagaaatgtctgttcaggtcttttgcccatttttaaaatcaggttattgttttttctgctattgagttataagaattctttataattctggatatattaaccccttaacaaaaatgtagtttgaaaatatttttaatagcccataaattgcctattattttgttgattgtttcctttattgttcctaaggtttttagtttaatgctgttctgtttatttacttttgtttttgtagtttgagctttttggagtggtatcaaaattaattgccaaagccaatgtcaagaagctaaaaggcaaattttgcaaggcaaaaaaaagttatcatactattttcttttgcatttctctgataacaagtagttactcttgtaattgctattgtaattttgctgattactgttgagattactattgtgattcacttggaatctatatttgcctttgtaaatacatttctaagtgaaacaactttggttattcttgctcattgttctcataaatctacaattccttattgttctttatagtacatgtggaacatcacctcctttttctcttgtctcctctgatgattgttttcctatattctttcatctattcatcacatatttcatgccttacaggtaaaatgatataaagaacattgtccaagctcatcttctgggagctgacaatctaaaacatgagatagcaggacatttaggccattgctacaaaatacagaaagtattatgatttgggtgtgcacactttgctatgagaacacatagaagtaaaactaaatatagattaagtcagtatgatgtatatggaaaactcccctcaaaaactggcattgcaactttttcatagattcgtgttttacaatttctaaatgccttatattatgtttttcagaccttatcttttaatgtgcacttaaaattaacagtgtacttacagttgaaaggtaactaaattttatatgacttaggtctcactgtcatcaagagtttgattaacaatattgatttcaaaaaacatcatgcccatatttcacctttactattcagcaagaaataatgcaatgactatatgtatagtagtttaatgatgttttaatttttttgagcgtgctaaggtttctgacaaacaacattcacacttgtgtttactttctccagccatcttcacaaaacactgcaactgagcttctgtgaccaattatgttgacatgactcttgcaaaaattactcatgacctttccattttcaaaatcagttcttttttaaaaaattgttcttgtcatctttgtgcatttgttacggctaatcgttgttctttcttggaaatcttttcttattgtttccatgatgatgccctgcttttctaatctcatgaacttctcctaaaaccactcctttactaaatttctgtcttcatctgtcttctctattttgcaggcttcttagcaaccacagatatagctgtaagcaatactggtgaccataaaagaggcatatcttcatttatctgtttccaccctttgctatatatctccgtgtagatgtagcataccatgtagaaactagtcatccatgtcctttgcttatcctcaaatctcattagttcattctattaactgtctcttaaatctatctctagtcccctctttgtttttctattctaaaccctgtggatttgattcaattcttcctcatctcctgcatcctatcctattttaagagcaaccagtctatcctgctaggctttctgcatttgcccatctactcaggtccccacattgctgctaaagtcatttctacaacaaacaaacccaatcttgtcacttccttattcaatagtattattcagctacttcttattgtcaatataaggttcatacttctctccatgtatcttatataatagctaactgatttttgtttttatattgctgagccatattccatctttaattttggagtgctaaactggattcttaaatttcttgaagctgacctaggaatagttctttgaagtttactaacaacttcttcttctagacagaggaaggagtggggcacacatatacacctgctcatcaaagtcctcaaaatgttcacttactagatattaaggtaaagtgtcacttgtcatttatcttttgcttttctttattgatacttctgtttctaatatttattatttacaatgtaattttttatgaatgtttttcctaagtctttcaaaaatttgcctttatgccattgtggtttgagcaaaacctggcattcagtagaaattcagtaagcactttttgactgaataaatactttcctctaccatttctttgcccataccaaatgactctccaaacttccacattgaggaaactcagagacaaatagggttagtattataattttgggtaaatttttggataacagatttttgtaaagatttggggtgaatgcatttaacttgtaaatttcacattgattgaaatgaaaagctacatactcataagaagaacttataatactcactgaggaacaatatttctttgcataatcccaaaagctttaaaattgcagtattttacataaaaatttggaaatattatctcctcagagaggcctttgttttaaattttttaatataaacacaacaaatatacaaaatgtgcaccaaattaatgtacatacatgaaaaatttaataattacaaactgaaaacctatgttaccagtaggtatatccaaaactaacactattacaactctttatgatgccttcattagttttaatcacaatatctttcattactcatcaaagtaaccattatcgcctcagatttgtgtaattttctaaacttttactcataaatttattatatatgtatgcatttctatcctcaagtcatgatgaaattatcctatcttctcatgttgtactggtttacttatcacatgcacattaggaacacataatttttggtgatgggagagatggatagagattaatttattttctatttagatatccaaatcacccagagccatttataaaaaaagacacactttttgacccatacttcagtttgtcataaattaaacatgggtattcgtgtaggcctgttttgagatgttctgttccattagtttataccacactatcttaacttgtttcataagaagcatcattctttttcttcaaaactgctccagcttttttaaagcttagcatttacatatgtattttagaatcaatttacaaaataaactgctaaaattttgattgggattattttgattctatagataaattggggagagctaacattttgccatattgacattttcaatgttatgaaaatattattatgaaaaccttcatttatactggcttttttttatttttgagatagagtctcgctttgtgcccagactggagtgcagtggtgtgatctcaactcactgcaacctccacttcccgggttcaagcgattgtcgtgtctcagcctcctgagtagctgggattacaggtgcccgccaccatgcccggctaatttttgtattttaagtagagacaaggtttcactatgctggccaggctggtctcaaactcctgacctcaagtgttcttcacccacctcagcctcccaaagtgcttggattacaggcgtgagccaccacacccagctcctggctggcttacttttttaatttagatgagtgcttttgaccatcttaccccatttcagtaactattactttaccctcattcgctttttgaagccctaatcactgtctgaaattattagtttactcgtctgttttcaatgtttttcccataagaatgtaagtttcatgagatttgaggccttgcctgtattattgttatatcctcaaggcttagtataattcactgtagacattgaacactcttcattaaaaagaatgaatagataaacagtaaaataaaataaccaaacggctcaaattactcaattgttattcaaactattattattttactagtggccaacaaaattacctactggattatccaataatataaactcctcaatatatttgcagctccaaatttgttcaaggctcaacctgatcctgttagaatcaagtttaacgtgtgttttgattaactgaaggaccctagcagatattttgccctataagatttcaaaatgacctcatttgcattattcataaattaacaacatgaatgtacttataaaaagtatctttttcactaaaccaaaaacacttttcagggtcaagagaaatagtgggtaaaacaacataaattttattcacatgttctttcataaatgtttatatatcaaattatttgggctactcacattttagcagtaaaagaaaaacctaagcactgaatgttaatttaatttctattgaatgcttgtttttgtcactagaaaataaatataaaaggtacatttttatattgtaaaattatgtatgttcctccaaaagtttctccagtaacctttcttcttttgatcactaaccaatatttctattgtgttttatcaatacatgaatgaatgaatacaatactttacagttaataagaaggaatcagtctttgacatggtttggctgtgtccccacccaaatctcatcttgaacttgagagagatgatttaggatatctggtggaagaaatttctaagcagcaaagcattcaagaggtgacttgggtgttgttaaaggcattcagaaggggagcagaccataaaagttcaaaaaatttgcagcctgacaatgtgataaaaaggaaaaaccattttctgaggagaaattcaagctggctgcagaaatttgcataagttacgtggaaagaatgtgaatcctcaacatagtggggaaaaggtctccagggcatgttggaagacttcacggcagcccctcccattacaggccttaagacctaggagaaaatggtttcatgggctaggcctagggtctctgggctgtgtgcagcctacggacttagtgctctgtgtcccagctgctccagccatgactgaaaggggacaacgtagacctcggtgcatggcttcagagaatggaagctccaagccttggcagcttccatgtggtgttgagcctgagagtgcacagaagtaaagaactggggtttgggaacctccacctagaattcagaagatgtatgataacacctggctgcccagccagaagttttctgcatgggcagggtcttcacggagaacctctgttagggtagtgcggataagaaatgtggtgtcggagtccccacacagcgctcctactggggcaccacctactggagctgtgagagagggccaccatcctccagaccacagaatggtagatccactgaaagattgcactgttcccctggaaaagccacagacactcaataccagcccatgaaagcagccaggaggtaggttgtaccctgcaaagccacaggggtggagctgcccaagaccatgagaacccacctcttgcatcagcatgactcagatgggagacatggagtcaaaggagatcattttggaactttaagatgtgactgccctgctggattttgaacttgcatggggcctgcagcccctttgcttctgccaattcctcccatttggaacagctgtatttacccaaagcctgtacccccattgtatctaggaagtaactaacttgcttttgattttacaagctcacagatggaaaggacttgccttgtgtcagatgagactttggactacggacttctgagttaatgctgaaatgacttaagactttgggagactgctgggaaggcacgattggttttgaaatatgaggacatgatatttgggaggggccaggggcagaaaaatatgatttggctgtgtccccacccaaatctcatcttgaattcccacatgttgtgggaggtacccagtgagagataattgaatcatggggacccatgctgttctcatgatagtgaatacatctcagaagaactaatggtattatatgaggcagtttatctgcataaactctcttctctttgcctgctgccatccatgtaagatgtgactttctcctccttgccttccaccatgattgtgaggcctccccagccatgtgaaactgtagttcattaaagctctttcttttgtaaattgttgagtctcgggtatgtctttatcagcaggatgaaaacagactaatacagccttacactcaagtttctcagtctattcctcatcccgtaattccccactgatgaaaagagttgtatggtagaaaagagttctatatgcagtcattgtagaaaaagtattggaatgcagtgccacaagagtttgtttaggcaaactcacctgctctctcctaaaagggtctctcagtcacagaaagtttcctaagtgaatgtgtcataattccaatgtagatcttagcctcagattatgagaaaatggaataagtgacagagagtgaggtgtctgtccatcagggtagacttacaataaataaactcacagagtgtgagatgaaaaactacagtgccaatatttcttcctaacatatttctctatatagcaaatccaaataagaagacatcttaaattataagatatttataactaatttagaaaaaagaagtaaaaacacctattttaaataagagggattatgtgtatatttcaaatgtttcataacatctaacttagctagtttttcatggttatctccagaatgcagtggtatttgccctatgggatataattacaatgagcaatgctaatgttcacatcttagactccacattttacggttcaataagtgaaaaagcccccttgtttctgacagtctttctttgaacatgttgatagagttcagttgattacaaatcttgctagaccagatgccatcttgtctttttaaagtgaccatgttgttatattaattatattaagatcccattatttctagttttttttcctgatgatcctcactataacatctacaataataataacatagttttttttttaaatcagggtaactgatttgtctacaaattaaacaacaagaagcaacagcaaaagctgcctccagaatattcatttattctaatatttctattgtcaaggaacatatattattttattaaatctctacaataagcttgtgaagtacatattagtacgctctacattttaaagatgaagaaatgtgtaagtgttttatctataaaacttattagtgtatgtctcctcatttggatctctgaattattaactaatacaaattatctgctactattaagtaaactgtatttcagacatttatgccactgtgtccttctgattttattttcttattttcacacaaaattaattctatacagttcagttaattttataaagtttataacccattccaaattcataagaatgacattttaagcttaaaccttttgatatttgagtcaatttagtcttatatattataggaaaaatctaggaatcactcaataaaaagatggcattaacggtagaaatacaaattaactcagaaagtaaaaattatttctttaggttgtacctaagtttgaaagtttgagaaagaatataatgaattatgtcaaacataattggatagctttaagaagtctaagtcccagctggatttcccactgccacccaagagcttatataaaatactactgacttttaaaaactaaagtatttcaaattagagagtagtatttttctgtgattttctttatttttaattgggcagctgacatcctgctgttatgagggctatattaattacactttctcattttatgagaatatatgcggaataggaaaattagtgataacatattactttttgaataaaatgacttgtatttggtggtacttctggaatggcagaggggaggcctccatatagagtctcatacattaaaagcaacaaatatactggcaaaaatggtcaaaatctattttttccagagctatgggatttatcccaaatctggaattaatataaggggtgtttttttcaagaaaaactgctgaaccttactaataatggcatggaatatagcactgtaactcaactgctcccactcccctcttcccagtaggaaccttcaaaatcagcagcctcccatccctggtagctgtgcaaaacagcctcccagcaatcagggggaacagaccagatttggtgctcctcaacgcattcctttccccttgcccagaagactgtcgctatttaacctatcttgcattcccctggaaaactcaatttgcacatgttgctgttatttggcctgacatggagatttctccatggttagagccctatccccagctcatttgtttaaaaaaaaaaaaaagttgaaacaattgtttaacattgcaactgcctgaagcttctgtgtaaattggaacaagagcctggtcaaaacataaaaggaaggtctggggaaagacgtgctcacagggggctttgaaaagctctaccatattcacaaggttatgtgcatgtacaggcctgtgtgaatgctaagctgagagagaaccagtctctcacttacggatgacctgagatcctgcctaaaaaataagtgaaagctaagacaaacttgtaaattgttataatgttgaagttgtgcccaaacacacacacagacacacacagacacacacagacacacacacacacacacacaccagagagaaaaccttttgggataagatgaaagatggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaatccgggaggcggagcttgcagtgagccgagatcccgccactgcactccagcctgggcgacagagcgagactccgtctcaaaaaaaaaaaaaaaaaagatgaaagatgtattgatttgcttatgacatttgaggaaatatctgacctataatttgctaactgagcagaagctaggatagccatgcactagaaagaatacagactttacagaattaacctgggaaagtcactaagtgaacaaatatcaaaacaatgaaaaacaggtacaggcagcaaaacctggaagggtgagaatatgatttccactgatggtacattctagtatttaaaataccatgttttcttttctttctttctttctttccttccttcttttcttttttttttttttttttttttttgatacagggtcttactgtcacccaggctggagtacagtggcgtgataacgactcatggcagcctcaaccttcccaggctcaagccatcctcccatttcagcctcccaagtaccagggactccaggcgtgctccaccatgcacagctaatttttgtatttttttgtagggatggaatttcatcatgttgcccaggctaggctcaaattcctggactcaactgatccgtccacctcagcctcccaaaatgctgggattacagctgcgagccaccacttcctgcactaaaatatcatgttttcaacaaaaattatgacacattttaagaaactggaaagtatggctcattttaaaaataagtggttagaaactattttcgaagttcagaaattggacatatatgacaaagattttaagttagctactacaagtatgtttaaagaatgaaaataaataaataaataaataaataaataaggaattaactgaaaatgtacaaataatgtctcaccaaataaataacactattaatgagaaattagcttaaaataaccagatggaaattctgcagttgaaaagttaaacaattgaaaaaagaaaaattcactaaaggaattaagcaagaaatttgaagttcatgaagaagaatcagtaaacttgaagataattcaatgagattatcctctctagggaacataaacagaaaataatgaacatgaataagcaaagcctcagaggcttttgggacaatattacacataccaagatctgcataattgaagtcccagagaagatgcaagaggtgaggacagcaaggatatttgggtgggaaaaaagtcgtcaaatactttcaaatatgatttcaaaatattaatctacacatccaggaaaaataacatatagagatccacacccagacacatcacagtgaaactgttgaaagacaaagtgagaatcttgaaagcagcaaagagaaaaaataaatcaagcatataaaagattaacaatgattaaggccaaaagttgtagaattacatgtttaaaggaatgaaacaagagaacgttaacaagaaaatctataaccaaaaaggctctcaaaaatgaaggagaaataatgacatttgaaaaaaataaaaactgctaaaatgcatcactatctgaactgtcttacaagaaaaattaaaatgagtcctttgggctgaaatggaaaagcatgatgcagcaattcaaatccacataaataaagagtaccagtaaagcagctacctaggtgaacatgaagagaaccaaaaatgtacattttaactgttttattttcctatataatttttaaactgcaaaaacagtaattataagacatttctgaatagtttacaacgtataaatataacatttaataataaaatgctactataaaaatgaggagggaatgaaagcacattgctgcaaatattctgtctgttttggaaattaagttagtattaatctgaactagaatgttgaagtaagaagctaattgtaatccacagcattacaaataagaaaatatctcaaaaatatattaaaagagacaacagaggaattaaaattgtacactagaaagtatttaacaaaaaaaatgaggcagtaatgaaaggaaagaacaaatatataaggcgtacagcaaacaaatagcaaaatgacaagaataagttctgccttgtcagtaataacatcaaatataaatggaataaacactccaattaaataacaggtattgctagatggatgaaaattattattcaagagacatattttaggtacagaggcacaaaacaaatgaaagtaaaataaaaggatggcaaaatatataatatggaagcagttatgaaaattgagctggagtggctaacctcatatcataccaaatagacaacataaaaattgttacagaggtaaatgaatacttttatagtcatatagtagtccatattaataaaaaaatatgaaaatatttgtacctaacagattctcaaaatacatggaaaaaatggcagaattgaagggataagtatatacttcaaaaataatagttggagtctttaattctctgctttcagtaatggatataacaacaaagcagcatatcagcaaagatataaaatactcgagcaagaccagaagccaactaagcctcactaacatctatagaacactgcacccaacaaagaccatataaatgaaatagaaaatacaaagacaacagaaaaaagttctcaaaaccaaatgttgattctttgaaaagatcagcaaattgacaaaactttatatagactaaccaagaacaaaaagagagaagacaggttactaaaatcaagaataatagagagcacataactaccagccttaacgaaataagggttataaggaattctatgaattaaaaagttagattattcaaatgaaatgaacaaattcctagaatgacccaaaccataaactgaagaagaattataaaatatgaatagaactacaataagagattgaatgtgtgactaaaaaaaaaaattgtaaaaagaaaatcctaggcccaaaaagcttcattggtgagttttactaaacacataaaaaattaataccaacttttcacaaactctttcacaaaataaaagaggaagaaacatttcccaactaattttaaagaccatcttgctctgatatcaaaaaacaaagacaatgcgagataaaaattccacagaccaatattccttatgaatattgataaaaatatccttgatgaaatactagaaaagtgaattcagcaaaataaaaaaataatcacacataataaccaaatgagatttacccaggaatgcaaagctaaacctaacattctgaaatcaattaatgtaaaaacatataaacggaataaaggacaaaatccactaagtatcccaatagaaaaagaatatatattttacaaaattcaacatgctttttatagtaaaaccactcaataaactaaaaatagaatggaacaccttcaacctgataaagaacagctatgttaaactgacgaccaccatcaaatttaatggtgaaagatagggcttttcctctaagctcaggaacagaacgaggatattcattcttgccacttgtatttaaccttatacttgaggttctagccagagaaattagataagaaaaaaataaataaaatgcaaccatacagcaaagaaagaaatacaaatatttgctgacggcaggatcttatatagacatacctcagagatattgtgggttcaattccaaaccacagtaataaagtaaatattgcaacaaagtgagtcatgaacattttggttttccagtgcatataaaagttaaatttacactatactataatctattaagtgtgcaatagcatttagtctaaaaaacgtgcatgccttaattaaaaaaatactttactgctataaaaatgctaataatgtaagcatatactgttgggaaaatggtgcctatccaatttgtccatacagcattaccacaaaacttcaattggttaaaaaaaaaaaaaaaagatatcttcaaagcacaataaagcagaacataataaaatgaggtatccctgtatatagaaaaccctaaaaaacacactaaaaactgttagaatgaaaaacaaattcagcaaggttgcaagctaaatatcagtgaacaaaaaatcactgtatttttatattttagcaatgcacaatccaacaaataaaattagagaataaattcattcacaatagtgcaaagaagaatatttgtgcatatatttaacgagagaagcaagacttttatactaaatactacaaaaattgttgaaagacatgaaagaatatgtaaataaatgatagatatcctttttttcatcaattagaaggcaacattttcaagaggcaaatacactccagactgatgcacttattcaagcagtaccttgcaaaatcgaatgtggctatttttaattgctaaaattgacaagttgatgccaaaaatttatattaacatatatgatgcaagggaaccaaaacagccaaaacaatttggaaaaaaaattagatgatacctacttcctaatttaaagtgtatttcaaagctacagtaattacatagcatggtactggtggcataaagatggacataagattaattgaataaaattgagtccataaatatagttttacatatatagacatttgatttgagtgtgggggagtcaagaggggaactgagcaaatttattgttttcttctttttaaaaatcttattttgagataagcataaattcacattcaagtatttaaaaaaacactttcatccattttctaattggatcattaaattttttaactgctaaatttgaaaggttgtatatattctagatgcaggtactcttctccagtttgtgatttccaaatattatctgatactcaatagctgttcttttcatattcttcatagggtgtatgacatagcaaaagtttttaatattgatgaatttcatgtcatcactttgtcctgttatggatcctgctttgctataaagactaattattgttcacctattcttagattttaaacattttttgtatctatttttctaaaagtgtaatagttttatgtttcacatttaagttgtgatctgtttatttaatttttgattatgtatcagacttaggtcaacattaattttgctttcctgtgcatgtccaaatgatccagcactatttagtaaaaaatctacatttccgtaaatgaaatgcttttatacctttctcaaaattagtttggcatacttgtttgagtctatctttgaggttctctattgtgttccaatgatctatgtttctacctctttgctaatgccaaagtcttgattattgtaactacataataagctttgaaatcaaccatactaaatcttcccacagtattattcatttttcaaaattatttattctagttcctttgtagtttgaaataaaatttaaaataatgttgtctacgtctacaaaaagtcttgttgaaatattgtcaagaatggcattaaatttataagtaaatttggggataattgctgtttcactacaagagactttcagtccatgagctcagcatgtctctccatttatatagatccccatcttgaacttcttctactagctttgtatagttttcaggatagaagtcctagacatgacttgttaaatttaatcctaagtattttatattttcttaatgagtgtaaatgataatttagatgtctacatgttcactgctactatacaaaaattacgatttttaactgatatttgctttgtatctgtaacccagttgaactcacttatgtagagtagtctttctgtacatctataaaattttctactttctgtcttaatcatctgtattattttatattattttagattcagggggtacatgtactgtatagccacttacaatatctgcaactagggatagtttaagttttttttttttttttttcatttccagcctgtgtacctgttacatatttccttgtattgggatgatatacttattttgtataatctcttaatatggtggatgacattggttgattctggaatatagaactatccttgcatttttgcaataggcccacttggtcatgttataattatttttcatatattgttgagttctacttgctgatattttgcttagggatttatactctctagaagtactgatcttcagctttcttttatgtactggatttatatggttttgatatcaggacagtgatacctgcttcatgaaatgaattgggaaatttccttgctattgtttctagaataagaatgctagttattttgaaacatttgatagaattatccagcgaaaccatctgggtcaggagatttctcttttctttgcacttttgtaattgtgaattctattttcttaatagttatagggctatttgcaatatttatttcatatcagaggaattggcatatttttttcttttaaggaatcggtgcattttgtcttaagttgtccaattgatgtgtatagaattattaatagtgtgcctttcattatgtttttaaagtctgtaggaactgtagtgatatctctccttttagtcctaatattggccatacggtttggatctatgtcctcaccaaatcaaattatatccccaatgttggaggtggggcctgatgggaggtgattgaatcatatgagtggtttttcatggtttaacaccatcccccttgatactgtcctagcgatagtgagtgaattctcaagagatctgattgtttaaaagtgcatagcacgccacctccaccctggctcctgctcctaccatgtaaaatatcttgctcctccattaccttccaccatgattttaagtttcctgaggcctcccagaagctgatgctgccgtactttctttcttgtacagtctacagaatcatgagccaattaaaacttttttctttataattacccagtctcgggtatttctttatagcagtgcaagaacaaactaatacaatggtaatctgtgtcatcttttttctttgtcagctttaccagcagtatgtcaattttacctatcttttcaaagaagcaaattttgtttcaataatatttctctattattttctctattttgttgttttgttttcagatgttcagctctttttctatatttactactccttgctctggatttagctctcctcctccttctttttttttttttttttttttttttgggtatttacatgaaaccttagattgttcctttgatacttgaaaagaatatatattacaatgttgtgagtaaagtgttctataaatgttaattacatcctgttggatattacaatgttgtgagtaaagtgttctataaatgttaattacatcctgttggatattacaatgttgtgagtaaagtgttctataagtgttaattacatcctgttggtcaaccgtgttgttgagtacttctgtatcttttatccttttcacctataagcgtggagcccttttgtctctggctgcttgtaatactttttttcgttagttttctatttaagatgtgtatgcatggatttattttggtttatccattttggggtatactcagtttttgcaatctgtaggtttgactcttgccaaatttagaaaatttttagtcattttttaagtatgtctttagtcctgctctctttcccttctccttttataattccaatgacacaaattttacattctttattttagtcctacaggttcttgatgcattatccatttttttggcctactttcttcctgttgttcagattgagtaatttattttctgtcttcagttcttagattattttctttgttccctctatttggctgttgatcccaataattgagcttttcatactacttattatacttttcgtagattttgatttggttcctccttacatgttctattctttgctgaaacttttaaatttttttgctgacactttcgcttgaaaaaaaatgtattaagtgtgcctgtgctgtttgtcgaggcatttttagcatggctgctttaaaatctttgtgagataattttaaaatctctgtcatctagggttggcatccaatttgttttttacttagtttgatatcttgttggttttctgtatgacaagtgagttttttaactgcaatcaggatattttcatattatgctaaggaactctggattgtattacattttcagtgtatgagtctttttctgagtctaccccagcagtggaatgggaaggggaggattacctcattgctgtcaggtcgaagaagtccatgtttcctaattggcctccattaacaacccagggagtcacattgttgtaattgggtgctggtgaccactctgaacactagatctcttttgacaccaccccagcaggaagcagaagaagcaccttgttactatgaagtgggtatgaaagtccaggatccagtgtttacactgacactgcagtacagggggtctcattactggccagcagagatgagtattctagctctttcaagcaccaccacagtgagggtgttggaacaccttcttgtagcctggtaagcctgaaagtaccagctccccacttagtctttttttgctgtggataagggtggaagccacatatttttctgtgttgtttggctggtataggacatatatcaactcaacggttttttgtctttctgtgtttccattttcttggtcctttgggtacagaaggcaggctgttattggtgctttttgtgactgtgtctgtcatttccaagttactggcttatttaagcctgagactgagatacttgaagtaaaaggaaattccagagaactagcaaaatgttgttctttagatgtcaagttcactagtcaatctgccttttttcccctacctctcaatattggctttatatataacatagagggtttttagttgtttgtagcatgagaaatggagagaagtatgtctatgccatattcctggaagagcaagtctggccacagatttttaataagggtgacaagaaaatttaattgagaaaatatagtttgttcaacaaatggaactgggacaagtggatacacacatgcaaaagtatgaacactagcatcatagcatacagaaaaattaactcaaaaaggacaacagaacaaatatatagctaacattattaaaatcttagaaaaatacatagaagtaaaactttatgtctttggtttaggtaatagcttagatctgacactgaaagcacaagagaaaatttaaaaaatagataaattagattttatcaaaattaaaagctttgtgtgttataaatgataccataaggaaactgaaagatcaggagtgaagttttggagatgttggtagagggatacaatctttgagttaggagaaataagttcaagagatctattgtataacatggtgactatagttaacaacaatgtattatattcttgaaatttactaagaaagtaaattataagtgtttttaccacaaaaaaaaaatgataactaaggtaatgcatatgttaattaactcagtttagacattccataatatgtatttgaaaacatgttgtaggcaataaatatatgcaatttttattttcaataaataacaaaaggaaagtgaaagaaataacccacagaatgggaaaaagtattagcaaattatacatctgattagatatttgtattcaaaatatataaataactcttaaaacaacaataaaaagaacaacaaaatgaaataaacaagccaagcattttagtagtcaccctggtaaaaatatataaacaaaagagcacatgaaaagatgcttaaaaataactcaggaaatgcaaattaaaatcacaatgagataccactagataaccattagaacatctataattgttgtcaaagatatgatagaatgagaaatctcaaaatgtaagatggtgcagccaatttagaaaataatttgcaaattcctcaatagattatacatagagtaccatctgacccagaaattccattcctgggcatatactcatgagaaataaaacagatatccatactctacttgcatacgaatgttcatagtagcattatttataggagccaaaataagttgaatctctattaactgatgaagggataaacaaaatatggtatattcatacaatagaatactatttaacaataaaataaaataaagcactgatacttgcaacaacatggaactcaagaacattatgccaagtggaattattcagtaataaaataagatatatagtgaatggttccattcatatgaaatgtccagaataggcaaatctatgcagacagaaaatgattagtggttgattaggactgcacagaggtaagtggctgggtaggatggagtgtgattgataatagggtttttctttagaataatgttcttaaactagatcatattgatgcttgcacaactctgaatatactgaaactactgaatttggacctggttgcatttctctaaaataaatcactgtattttattttgtattctctaaaatatgacttattaattaaggttttcttgtccacacttgtctgtttaattacactttaaaatgtttttcataattttattgaaaataacagattttcaatgagccattaattgactctgaagccagacattctcatttcacaacttagcacttcctttgtgcaaatcatttaatcatattatgcctcagattctttatccatataacagaataataagaataactattttaaagattaagcatgttaacaactttctttcaacaatattttaaacataatgaatactatgtgttatattccctttctcttcctccgcctcatagttatactataattattatagtttgccatggagctccattacataatataaatgtctcattgtctttgagttagaaaatacaaatttaaataagtacatcaaaaatcccagtatcaatttgtctgagaatacaaaatgcctatggcctaaaggtatcaaatatgctgccaaatggatgtttttgaaacatgatttcatggctgtatttcaggttgttaccaaaaaaatgcattaagttattttattttcttcagaagaggacaattttgatcttagaacatcatacaaacgtttactgctaaagtgtctacctctcttaggagaaataatataatttgatattggtgaatttctagtgtaaacataaataatgtatattcttcttttattgggtgaatgtatgccaattgggtccaattttttcattgtgtttagattgttattagatctactattttttcttctgtttctttcacctgttactgagcaacttcattaaaaatctttattgcatagattttcccttccttgttatttcagtttttgctgtacatatttggacaagttattaggtgaatagaattaaaattactatatggtcgttatatgcttacttgtctaccattatgaaatacccttctttatatctatcaatgctcacaccgtaaattataatttatctgctattagcatagattcattcagctatttgtaaattagtgcctgtacttataattattaaaatactataatcaaggtgtatttcttataaacaacatttaggttttttttagctcatgtcatagtctttacttaactttgaagtatataacatatctaaacttactataactatttatatatgtgttatgtgtttgttcctctattatttgttccttttatgtcattgtttttgccttctcttaatcaagtaggtgtttttattgcaagttttttattgacttgtaagttttgtattctcttaggaagcaaaatatgcatccttgattattagagtcaattataaattagtactcttatcacctcctgaacaaaaaatgaggacattagaccattttaactccacatcatcagttgatgtttgtactattgtttctgtgcattttaattttatatatattatacacacccagaagacataaatactgctttaaccactcaatattcatttagagtaacctacatacttattcattaatcattacagtctttccatgtagacttatattgtgcctgaaaaatttcttccagtattttagttctagcaacaaatatttttgtatgctaagttttaaaagaaaaatcacaattttctatctgttctatcatttctgatgaaagggtttgtttgccaagcatggtggtgcacacttgtaatcccagcactttgagaggcgaagtagggttgatcacttgaggccaggagtttgagaccagtcagagcaacatgaaaccctgtctctaccaaaaatacaaaaaattagccaggtgcagtagcccctgtagtcccagctactcaggaggctaaggcatgagaatcgcttgagcttggaagtcggaggttgcagtgaactgagattgtgccactgcactccagcgtgggcgacaaagcaagactttgtctcaaaaaaaaaaaaaagggaaatatttgtctactccaccagtgccagaagtagaaattgacctgtattgctttatctttatttcttatcacttattcttctttattctttgtcacagcaaccatcctcttaggatcctcttcaaccaacataaattttggaggtgatttctgttttttaacatttatttacttttattttttaattgtacatatttcaagggtacaatttgatgtttccatacatatatatggacaaaacttatacgtgtatatatatgtaagtgcatgtatttatgcacatatatgtacatgtatgtatatatgcataaacatataagcatatgtatgtattcaaagcctctcgtagctattttttaatatacaataccttgctgttaatcataatcaccctactgtgaaaatagagtactagagcttactcctcctaatcttaattgcacctgttgaccagcagcaaagtttttaattctgaaaacctatatctaaactacatttcaataatcagctgaaataatcattcaggcaaaaccaattgatagagtaatcaacagttcaaggcaatatttattgagcatgagctagatgccacacactgtactagacattagatttataaaatttgtctaacagtatttcaatagttaagttctagaatctaatggcaggaacccataaacaagtagtttataaatatatatatgagacatgctataataggagtatctgaaaggctgtttaaaatatggaaactgagggaaataaaaaatgttcaaatttgattcccgaaggagttaaacttattatttgacatttcatttttactctagttttgctactatcatataaatatatgctttaggtgtaaagtaaacaatgagattgtccaaaggatattttctaaagtttatcagtcgtattggtccaccggcattgtctagactgacgaacacttccaactttactgctcatatcattctgcatacccaaaatatccttcctttgcttcttgatggtgaaaaaatacatagttttgcttttctgagctcattgggctctttataatgtaacctctttgtattgatttgtccatttactctagaattacctatgatgttcactattttccataataaggaaattaccaaactcgtagaatagccaaaatattaccagttgctttaaaagattaaaaagaaaaaaaaaacaagaagaaaattttgataaattaaacagtaatgaaagaacacgtggaccaaatatgcctcttaaaagtagaaataattaaactgtgtcggaaagcctatcaatcagacaaatgaaactatctgagacaaatgtttcaccttccatgtaaacactagactataacatcaaagggaaagaactgattgtttcctattgcttcctagcttcaatacacgattctctaatgcgctttcaaaagtatagaaatactattgtaaatagacgttatagctgaaaatcctgaaagctgaattatttctacagcgctatttgcagactaataagcagttcatcagtatattattgtaaagataaagaaaaaactgcaataaaattgtataaatgactaaattgattaaattgatctgattaacataaaatattccaagtattatttatttagttaaatctgagacactaggaaccttgcaagtaaaatttgtaccctagacgtgactcaactcgactctactctaggcctacccctaaagtcagaagcctaaagacaaattttaacaagattctcaggcatattaagtttggcagctgagtcttgccaagttacaggccttggcaaatactttgggctttccatagatctcactcacaatgtatgacataaaaactactcaatttccatgtgataatagtccaaaatgccttctaagtcaagaattagcactcttctaaggaagataacagaatccaaagtctgtacatactgttattatatattattcccaatgtccaatgatgaatcaacatttatgagaaattcaactaaatagaaaaatgcaacccatagttgaagaagataattaagaagaggagaaggaggaagaggaagaagaaaaatggaaggagaagagggagaggcaggaggaggaagaagagtcaaaataggaagaaaagaaggaagaagagaagaagtcaataaaggagaaggaggagactgagggagcaggaggaagaaaagactgaaggaggattaagaaacataactcaagatggctctgatattggacttagcagaaattactctaaagtagctacttttaaagctatttaagagttttatccatttaaaatcttctgaaggtaatttaaatgattcaaagaaaaaaatatggtcttaatgagttaatcaataggaaatgttggtacagaaatgggaactataaaaaacttaaagcaaaactgtagaacttgggagatggactttatatcagattggagactaggaaaacaaaagaatagtaaaattgaaaacatatcaatacaaattgtccatttgaagatcacagagaaaaaaatatgtgaaacaaataagcagaacttaagggacttgtagtccagtgtcaaacagtttaaaatgagtgtcattggaaaagatagtgcctttgagacagaaaaatacagaagaactatcgtacaggctcaggcttcccatatattattgaaggcacaaacttatagatttagaaaggtcagaatgataagcaacaagcgaaccacagctaggtacattatagtcaacattctgattcccaaagctgaagagaaaaatatgtacgttactagagaaaaaacatattacacataaggaaatgggccaagaaaaaaatcataattttctcttaaaaataattgcactcaagccgggtgcggtggctcatgcctgtaatcccagcactttgggaggctgaggcgggtggatcacgaggtcaggagatttgagaccatcctgactaacgttataatctatcttataattcagaaaacaaacagaaatataaataattagttgtaataatgtactataattttctacaaaaatactgtaaatttatatttaaaaacaatcaaattatcacatccttcatatttttaggtatataggtatttctatactaatatgctacattctatattagtgttttttcttacatatattaatctaggagtgtgaagaagaacatttccactgactaaagaaagttatgaacaaaacaatcttgaaatttaatttttttttactcttgaaatatcttatgcctatcagttctagaagttagtttagccttctttgaatctcagttagctctggtccatttataactgcttaaaagcctaaaaccaaatttttctagtaattgtggggtattttattgcttgctggttgattcacatctgtttttttctttccagttagatttcaaagtcttttgagataaaattatgttttcagtatcttgttttgaccacaatgcaaagattatgaaaacatctattaagcagttgtatggagcttgaattctgtgaaggaacagaattggagatgcaggtttgaaagtctttgcttgcttcgaaataatgtgaaatttcacttctctcaattctactattttcccacatgcactataactccctaaactttattttacttttcagaaatttatacctaagttggcattcactgtaagtatcacttgggcatcataccaacaacaagtatagtcgatattgtgcaatgaatacaaaaataggtaacatggaaagacacagtttcatattccagcaactggtgttcataaatccataagtgagccactcatattttctgtagctaagttctctcatcacgcaaataaaatacaaactttaacatcaaccacttaatattaacaatctaatgagctagaaagtgcatgttaaaataactttaccttaaattttattatctagtagaataatgataattattattgtacatcactttacaacttccaaaattatcactggctttcacctgcttttgctgtgttgtagtattatacagatttcataagtcatgtgtcttctttggacctcactttcatactgttgcctgtttcttcaactgaagatagggattttagggttttaaatttttaggtttttaaaaacaatgcatataaagcacccaatgtacacagaaagcataatacttacctgaggcaacatacttttattatttgtattactatttgtaagtactgataaatattcaaacaaaggataagtctataaacccaacctactttaatattacattcaagagataagtactgtgaaaggttaattgatactactttctaaagattcttcaaaattacttctgaagtacaatctttttatgttagctaaccaaaataatttaatgatatctatggaactgccttattgctcaaatttgcaagttttagacattaacatttttctaaataaatctatataaaattcaatgtacttaatatgactgtacatgctaaacactatgtgtgatgtataggcttgttattaaactccaaaaaactgaatatacaaaatttagcagaagttctgatatttccatatgcttaagcaatgagaagttccccttagaagtctcaaataatttagatcaacccatgttttagcctgtttggattactcaaggtaaatttgtcatttaccatttaccttatttgtcattttataaggaagacaaatacctagtcttgaaatttacttctgtttttttaaaaacattttacatgtaataattcatttaatcatctcaacatcccagtgaggtaattctaaacttattcctatcttcagttgaagagacaggcacagtaagaagaatcattgagagtagttgcccaggttatacagctttaaaatggctgaactgggatgggaattcacacaccccggctccagaacttagctgtccacagctatgctatttgcctgcttctttgtttttaaccatttcatttttagtaactcctcctctcccaagtctatctctattgatcttccagttctgttgcaaactgtaacacagtaacaagttccccttagaagtctcacataatttagatccacccatgtttcagcccttttggattattcaaggtattttgtcatttaccatttaatttatttgtcatttttcttccacctggaacaaaactggaagatcaatagagatagaccatgggagaggaggacgttttcttactttccactcttagtcaataactgggatttttcttttttacttttagaatatcctcaatttaaatttaaatatttattggcctttcttgatatattaactttctgagtttccaccccacttttctctttactttcttttctgataagaaatgcaaacctaatttttaaaaccataaatgtaagatgaatgaacttaaaaaatctggaatggcagttcaaaaagcaattaaaattgaggaatcaaaaagctcctctgattctttgtcataattcaaataaaggtatgcttttctgactgtggtaaaaactagctgacaagtgccaaggaaactagattttttttaaaaaatggaactttgtatatgtaaccacattattaaaaccagggcaaatttttcaggatgtagctgtgttctttgtatagttatgacttttgatctctgtatctttaccctgcctgtttagaataaactttacactctatttcctatctccagtcaagtattaaactaagaaaatatctgagagaaatacacaagaaaataatcacaaagcattaaaattataaaataatttatagttgaatgaccatgaataatgctttaatgatcttatgccttatgtgattaagaatataaagatgttttctttcctcttttctttatagagaatatacagatttggggtaccaatgaataaaatactgagattttgtggagtctgatatttaaacttgttttttcatcaattcttctttatgagaaaatggagatactccaggcaatgaaattcatccagagtaatatatttgggggtactctgaattcaatcacccttttcctcacagtttacaaaatccagaagtgtctaacagtcctccagacatgagctgcctgtcatgtcttattacctgaacatgtctattaataaataaataaataaataaatctttgcaagaaagtgctgagctggaaagagcagagaaaatatttccacatcaataaagtaacagaaaggctttcatggttgtattttccaacttatcttcctttgacacttacttttcttcactgcagaaacaatattttccctttttttctttgtattgttaccctacccatcttaacctagtgctaataactgctctggttattatctccttccacacctccctggctcttcctttaggcctggagtcactatttactttagaaggaataatacattgaaaggcgtgtaaaggtgaaaatcaggcggttttgtaattcccaagagtggaggttacagcctttggcacatcagcaaacaaatcacaaggactgctgaattcccttgcaggctttttttctttcatggtttggagagcaagagtgggagcgacagctaagatgacattgccatttgggggacacaattctgcaggtgatgttgtgcaggggaataaaggaggtgaaagataaattgtcactgaattggctttcacacagctgtaggtgtattttagtttaacggcagtgacagtccagctcccacctgctgacagacggctgctagcaagaagatatatttgagacttactgtcaagatacaagctttcatgttaaacaaataacgttttttaaaagagtatttcaaaggatgatgaaaatgaagagaaatgatacttaacatatacaacataaagagagtatctgagagcccaaagctgggctaaagttggcaaaggcgagataattatattttccaggagtgaatacctccaagaaaaaaataaatcattaaaaaatggggttggtgttgaacttggacattgcatggctaagagttcctagtaaaaatagcaaaggtttccatataagtacaactgagaaaggcagtcacctcttactctctaaccagaaaataagaaaagaagatgagagaaattttaatatgccagaccataatatgcgtttagcatactattgttatctccactagaatcttcaattatcatcaatgagattaaggtccgttattaatgtattcgtgtgcctgttgctcttctaaattgtttgacatgcattgtcttcataagtagtttttatcacagcactgtgaggtacctgttactgtacagaaaggaaaaatggaagcacagggcatttatgtaatttctcaagatcatacagctttatacatggtagtagagccatgtaccaaacaaagacaacctggtgatgaactcatgtcctttgctgttaaatatttagtacagcttcttgtataagatgaaaaccattccaaatgcaaagatgcctctctttactaggaaacccagctttgagaagcagggatgaagcagggaggaagatgcaaaaagatgtattgattatcaggagtaacaaatcaatcctggagatcaaggaagcaggtatgcatgtgggagggacaggtgggggctacatcgagattgtgttcatattcagttaaaaatgtttttagtcctctgaatacagaaggtaaatgaacagaaggaatgctcaaagacacagttcttattgttgttttggggtttttttatttgttttatttttattagggcttagatttactaaaatttgtcctcttctattttaggcttacgtgtatcatacagaatatttagtgtgtgtataaattaaaatgtattcattttagacctttacacaatatgcaaaaactctgtataattctgcttctttcaaatagatgcttttttgttcacttttcaaatataatcattaattttacgtactgaataatgttactggtttactatttggtatatgtatatacatacatatataggttttataatgttgattagtgtaactagtttactatttggttttattcataatcattatttatttttatatgtatataccatcctctgagcctcacagctaaaaactgttgtctgtggtggagagaattccttagtgcccttaccaaatcaatgagtcttcatttttcatcatttattttatttactccatctaccagtttctaacactgaccaacacttgtgccaaagggacatataaaccaccccttttaatgtttgtaactgcaaaatactaggctctgaggagatttttctcactgtttgagatggctataaagtttatgtcttacagcaaaagaattgctagctcatgaaattttatcatcactattgaatgtgaagatgtgctaaatggcatagatgcttaatgcatttatacagacatctaaactatatgcctcaagaatatcttacaggaatacaaaaagaaaaaattttaaagctctaggctgggcacagtggctcatacctgtaaactcagcactttgggagattgaggcaggaggatcgcttcaggccaggagtttgacactagcttgggcaacacagtgagaacccatctctttttaaaaaaataattaattttaatccttatatatctatattaaattgtctttctgaggaataacctcttttataaacatctacgtgttatcatgtgcccttaaattgatattatataagaaaggagaatatctactttcagaaacaatctgcaaaatcggtaacttccaacgatgtagtatggtagattgtcttcaaataattcctctcttccctgaatactcatgtcactccccccgttaagatatgaaatctatttccccttcttgaatctggatggtctgtatgacttgctttttccaatagaatgcaacagaagcaagtctgtgtccattctgggtctacctcttgagaagcctggcagtttccaattatggtcttaagagtctagagtccgaggctaccatgtcagaagtctaactacttggtacagaaaggcacaaccaaccacaaccattcccgctaccctagaaaaggtccaggtcatttgagtaaagctatgttggatgtttcagtccaagcagaggtcatagataaaggcatgagtgacccccgacaacatcatacggaggagaagatccacccagctaagcccagacagcccagagaatggtaagacagaatgaatcgttgtttttaagtcattaatttgtggaaataatttcttgccttgcattagataactgacatatataaggaactaccgtaaaatagttgagtctaaagagttaacttcaaactcttttcagggattccaggacctaaaataaagatatttctccaatcgtggtaagaactgttatggtgaattaaaaagaactctaattaaggagcaaacaagtactatacaaatgaacttaaacaactctcttgaatttattgagaagtaaaatccaactggatatcaagtataaactggtcactttcttaatgtcacttaaaatgattcccttcttttcaacctccctaatacgggaaagatcaaaccattccaatttctctgaaggattacccaagaggtctttctaccctacctcctaggtagctcttctctagtttatttctcatttctaagttgctgcattctaaaatgtagatagaatcaagtcacagcctacctaatattctttgtgcattttccattagttaagaattaagtccatgtcggacagcatgatgttccagttctctgtgatttgacttctgatttgtttctcaccctcagtgcatgccacttttctcctttaaacacagactccagttattcagtctctatgcctttacaactgctggtacttctccctagataccccttatgttctttagatctaatttccatgtacattaaaaaaaaaactgattcccatgccctttaggttcacaatgccctgaactcaagtctgaatgcatcctgcctttaaattaccatagcactggcatgcacacactcactgtagccttcaccacactccattagtgtgcttcctaagtaccaggcaatagcttttagttctttatcacagcactcaccttggtgtcaggaaaaccagaaaactgagtgtttgttggataagtggataaatgatagatgaaatggaaactgcatgtgaaagcacttcatcaagttaaaagtgcttgaaaatattattctgatgactccttcataacaagttgtaaagatagttcctataaaggtagactaaaaccccaaacagttaaatgaatatatcttggaaaaaggcaaagcgattacaaatatgtacaataaaagcaggattgccctcacctataaaatagataattctaaactgttatttaatgatactaaggaataatgaaaagaataattcaattatttacaacttgatcatgatagcttttaaagtatctgagaaaaatggagatagagtgaaataaattaaatatattaaataaaataagatgcatgcatttaaattatatttagtaatatttcctttagtcctgaaattgaatgtattcactatggaaatcagtacatattaagatgcagctgctgagtgtttcttaaacaccaggcattcgctaagtgctttgcagatattatctagtttaagtcttagaaaaacctatgagataaagattagcatcttctttataaaagtggtaattaaagtttgcctatgttgaaataattaataactgacaaagccattcctagatttctggtttaaagccttgttttcttgtcatcaatgaaactgtaagacagattggaatttcctgcatagaagaatctttcagaaaagagagttaccatttgtcttcaattgcttaatgatttttttttattaaagcagcaccaaacctcttaccactatggtattactttaccttgaacttccatgaatgtctgtctcatctagagtttccttcctgggaaataacagatgttcctcacatatttcaggattatttcttgtcatttaattgctacacaatatcacttgcagaaggttgaataatggccattctgagatctacttagaaccccaaaaggtaaccttatttggaattagtttattttcagatataattatagtaaggatcttttgaatagaccatcctgcattgggatggtccctgaaacctatgatgcgtatgcctgtaagaaacggaaaaagagaagacacacagagatacaagagagaaagccatgtgaagagggtagagactggtattattctgtcacaaaccaagcaacttctgacaccatcagaagctggaagaagcaaggcaggattctccccgagaaccttcagaaggagcacgcccttgctaacatcttgacttcagacttggcctccagaactgtgagaataaacttccaaaattttaaaccaccaagtctttagtaatttgttactctaagaaacaacctagttctcatttctgcacacctgctaaggacagtgctatgtctagagcacaaaagcaggtgacctccttagctgtttacagtaattaacaatggctctctttaggagatgacattttaagattataccaggagtgagtcaagcacactggaacagacaagacaaagactgaaaagaaaacagcttaagtttgcaagagagaaaggaaaccaggatggctaaagagcagtagttggtggatcacaggaatcaagtggttcataaagaagcaaaaaagaatcacatcacataggtctttgtacagcttatcaaggtgtttgaattgcacttttcaatttaacaaaaagccacgcattaatatttgggtgaattggtacagggacacaagagcagaagaatacacaatttcagtttgtgttttaaaagaggtgatactaattactgccatggggaacacaaattgcaagctaaaatgatggaaggaataagacaaggaaataggcttttgaactgttgaggagaggtgagtttcaaagtagtgccagtgatgatggaggaatgacttccttatgatgaattttgtggcagtatcacttgacattctgatggattggatgtgaagaggaaaggaaaatgatacatcaaatctctgcaataaaatactaaaggacataggaggagtagaaaaagcgagtaacttgggattgtagaattaagaaaagtccctcagaggaagagattctcacacatatgaataatagtggcctactcatatttttttaaaaaattttgcatatgaatgataggaacaagaggctgtagagagaatggtagataaaggatttttgtactaaatattctaacaagaccaatttgcagttgagctgtttatatccctttgactataaagagcagtaattatatacaacactgaaacactaaattattcaattgcctcaaatttgttagcctcacattcttttactatgttcctgttttaggtccatcctctgcattgagacatttttagatttgttttaaatctggtattattctattcaaagtgaatttattcaaaactatttctacttgattctgggaaatatttttgcctttctcacgagttctgcacagtgaccttttatgagtcctgttaaagtggattcactcttcagacaaggtttcttatcagtttttcacacttactgaagaggacttttttccccccaaatcatgtaaggttagctctataaatagtattttgtgattttgaattttatgctattctattttgaaaaaatcactggctgaagtgcatcttttaagaattacttcatttcttaaaaaaagatattgcatcttttctgcttgtctcagtgacctacttagctttttaaagctctccactgacatcctttttgtctcctacttttctcatattatctgttttccttttagcaaaagtctattttgttgttatttttaataaaagtgtacaaagttataaatatgcatagactattctttgcacttaggtgaatcacctctttaaattaatgaatgaccgaccattgcatgtttctcaaaggagaggccaggtaaagtcaggacttactgtgtcaaagagagagaaagtgtgcccttgacttctactttttatgtaatactctcattctcagaacataaaatgatttcaacagggcagtgttcataattggtcaacttaacttagttttgtactcctgaatttgaatacctgaataaataactcttaaaagtatataaaaagtcagttacaggaaagacagaaatttagctaaagtttatttgctctatcttaggggaacctccttgaaattaaaggaagaacgtttgaggtatataaaagaaaatacaaatcataaaattattttcctgaaaaaggagtacagactaaggatggaatccaattataaagaacttatataaattaatgagtgatataaaatgatcttgctaaacatgaatgttctaagaaacatttcaattggggagctattcagcaatgtcaaatggggatccccaaagtaacataacatagaaatttgttattgttgttgttttgtttttgtttgttttttcttgaaacggagtccaactctgttgcccaggctggagtgtaatggcatgatgttggcttcctgcagcctcaacttcctgggctcaagccatcctcccacctcagcctcccaaataattgggactacaagcgtgtgttaccatgcccgactattttttttttctttgtagacacgaggattcaccatgttgccaaagctggttttgaactcctgggcccaagcactccaccgacctgggccttccaaaatgctgggattacaggcatgagccaccacgcccaaccaacagagacaaatgttgatagtccccattttactctcaaatttcaagtatcttgtcaagtcttctccatctcaataaacatcaatattattttcagcatttcacaagccaaaactttacaaattttatgaaatatgaaattaggttaaaaacaatacttcaaaacactttaaaattaattcatatatgaacttatgtattatacagttttaagtgtatgtgtaacataaacaagtatcatatttaacaacttgaaaattctatctatattcctaatgtgggtatatatataaacatgtatgtgtaggtgtgtatgtgtgtgtacatatataacacacacacacatatatatatatacactttggctcacaggttttcttagtcagttctggctgctacaacaaaataccatggaatgtgtgtcttaaacagcaaaggtttactctcacagttctgaaggcaaggcagtccaagatcaaggtatcaagatgccagaaaattcagtgtctggtgagggccactttcttgctgtatccttacatggtggagagagagatcacctcttctttttgtaagggcaattatattaccacaaggttcctacccttgtaacctaatctaaccctaactgtctcccaaaggccgcgcttcctggtaccatcacattgaggaatagaacttcaacatacgaattttagggggacacaaacattcagtccatagcacaaatataaatatacatatatttgaatgcctgaataaataactcttaaaagttttatttttatatatatatatatatatatatatatacacacacacacacacacggggtgtgtgtgtgtgtgtgtgtgtgtttgtcaactatacatttatctatcaaccaaaaaaattataggagcagtttttcatcttttgtgaagatcatcttacacttgggcaactatagctgtaatagttgtacataatattagttgaatctgagtagaagtggaattgtatacttaaaaatgtatgagtaaaccttaaaatcatgttagaattaacatgattttagcaagtctaaacataaatatctttactctaaaacttaaataacattatctaatacattttacaacatttgttacaccctcccatgcatggtccaatactcttcatcccctttgcatgttttatatttccattcatgcatataccacttaaaaaaactatagaactattcatgtagtttgtttaaaaatctgcctttctccaccaaaatttgagcattaggaaacacacatgttctgctcattagtttacccccagttttagtgcatattcagcaaattcttaaattaatgcataaaatgaccacagaggaggaaaaaaattggctgcccagacaaaggaactgaaattcctataactgtgagagaactatgttcatcaaacctgagaagtctggatacttagtgaagaaaaaattggtcagctttttttgtggttaaagtataaatatgaacaaaaaaacaaggaagatttctacctttacagggaaggccagagagattcaaacaattctcattttcacactccttttccaagatttcatgagagaaagtaagcactcaataaaaatgtattgaatgaataaaataaatgaaatttacttgaactgatgaacaaattacatgtgatacttattctcactaagaacacaacaaatgtcaaaaaaatagaaagcatagtcaatgtaaatattttatctaaagggtactacgttttattctatcaaatatatggaatataaccaaggtacacttccattcagaaaacttctaaaacacatcttgtgagtgaaagctaatgacatctacttaggagttacctaaatgatgcagttacatctgtgagcattctaaaaatgcaagcaaaagaaattatttatatgttccttaagtaatacatatgatttacaacataaaaatatttttttctgaaaaaaatgttatattgttagctctacagctcatttttaaagtcctggatattattaataaaataggcaaatatgaatctagaacagagagatacttaaaaactccttagacctcccagaaatgaaaaaaatatatatacatacatatatttatgtgtttgtgttgtatttacatcaatgccaaaagcaaattattaaaccatcttgtttgcacagatttatatagcagttgttaaataatgtcacttctttagcaatgtataatggaaatcatgtttcaaaacctgcaataagcatttgctttggattatattgtttagccctttcaaaacttctgtgagctggttgtgttatttcactctcgtttccagatggagaaactaaagcttagaaaatgaagtaattttctcccaatcacattgagaaaataggaaaactggacattgaatccagacatgatctaaaccagttgctgcacagtatggtaaccactagctacatgtcattattcagtacttgaaatgtgactggtgtgacaggggaaatttattttaattgtgtttaatttaaatcaatttaaatttaaaaatgaaagaagtataaaataatttaattcaataaacacaacgttgttgtattggtagcactatatttagcttcaaacattgattgttttatatattattgtcttcttggagtatgatatggtttggcttgtgcccccacccaaatctcatgttgaaattataattcccaattaaaattacaattgggggagggacctagtagaagatgactggatcatgggggcagatttccctcttgctgttgtcatgatagcaagtgagttctcacaagatctgggtgtttaaaggtgtatagcacttccccctttcctctctgtctcctgctggccatgtgaagatgtgtttgctttccctttgccttctgccatgattgtaagtttactgaggcctccccagccttgcttcctgcacagcctgcggaactgtgagccaattaaacctcttttctttataaattacccagtctcaggtagttctttatagcaatatgagaacagactaataccgagtatgcatattaagtgtctaaactgtttctagtattccacataaaaacatcacaaatctagttaatgtcaatggatggatattttgcacaatgtaagcaccaatataatattgtaatgtgtttatttggatattatatgcaaatagcacaatacctaaatgaattgtaagtggaaattaagttgaaacacttattaaattgtaatacaactaaattatttctctagcttaaaaacaagtgtagaaaatttctggatttaaaacaaagaaatactacatatgcagaatcaagtgaaaatgcaaaagctgtactgcacacatagtagtgtttttaaaaataggaaactttttttttgagatgtagtcttgctctgttgctcaggctggagtgcagtggcatgatctcagctaactgcaacctccacctcccaggttcaagctattttcctgcctcagcctcccaagtagctgggattacaggcgtatgccaccacgcttagctaatttttgtatatttagtacagaccaggtttcaccataatgattaggctggtctcgataaaaatagaaaacttttttaaaggaaacttacaatcatggcagaaggcaaaggggagtatgttggagtatgatatggagagaaaaagagaaactgttagaaggtatgtagcaaatttctcaatgattaatgatggcaatttcgtgccacatagcaaaatagaaaaaaagcatactgtataatgcttctaaagaagcatctctgggatggtcgtggatggggcagagatagtcaaaactcatagaggcagtcaagcatcagtgataagagtagtagctctggattcaatttcatgccacatagcaaaataaaaaggctatgtagcaaatttctcaatgattgatgatggcaattttgtgccacatagcaaaataaaaaagctgctcggttaaaaaatatatatagtaaagttgataatattaaagatattttagcaaaaagtaaatttgataagcaatttcctctcaatagtaaaaaaaaaatctgtgaatatagtcccctgaaatcagaaaaaaataccaaaataatcccacaaattttaaaaaataatttgggattgcctctaagtttgtacgtttgaccaactatgattctggcacaaggtactggcgaagcaaatcaaatgttccatgacgtatttacttctcatctcacaggatccctttatttaattggaaaacaacaagtcataactctcagaagtagtcattacatcccaagtaggcttcaagtttttcatctgaaaagtactcaagagtctctggagagactgccaaaatcataggcaagtaggtgggtggtttaattgtgtagtaaaagaagaattaagtaaacttttccctaaagtgcctgagaacctaccagatgtctgctgaggaaacagagcgggggcaaattctgggcccagctaagatggaatgggaaatggattggttctctaggacctggaggcagctacagcttcagctcatgcaagattggcaatctagaaagagggcaggaactaaagagaacagcaaacattcttctagccattggcagtatccacataaaagaaaagagtttgtctttccagtctttgcttctgagccataatatcctttctcataatgcgtattggttgttgcaagcaattatttgccttaacattaaaagtttatactcttgaaaagaactgaaagactttaattttacattctgtattatataccagactgaggcttgctagatgtaatctgaattaaagaaaacagtggagatggtgggatacaacctacttataaatatagaaagtattcagacttaaaattttgaaatcaaacatgtgcagcttcaacatgggtaggctgctgtggactagcttatatatacccactgctctgtggggaatgaagttctgaagtccaggcaaaaggtacaaggtgatgtttacacacacattgaggagagggttttattacaaagtttacaggtttctgtaaaatttgcctctagaaattcaattttcattggtcttgtttttaacacttttactgtatatagtgtctgttttatttttataatatgtataatgcttctaaacaagcatctttgggatggtggtgggatgagacagagatggtcaaaactcatagaggcagtcaagtaccagtgacaagagtagctctggattcagacagaccaggttttataccctacttcagccctctagagctataggactttgagcttgttccctagcctctataacactatattttatcaagtataaggaaggggtataatagtaataatttgcagataaattaggacatatcaagaaacttgcacagggtttacatacattgatttattttgtttatctcatatgctaaaatacacattttgtgcttcaaaggacacatcaatttacactgggacacatgtaaaagtgatgacactataaacttaagtatttattacttcaatatctaagcactgacaagtgacttcagtctttttttttttttttttttttgagacggagtctcgctctgtcgcccaggctggagtgcagtggcgagatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccgtgacttcagtcttaatgaaatttccttgtctagcaatgggatgctaatggattcaaagaaatggaaacatttataagtattcaaatatcatttcactgaaaataaacaattttttacaagtagtgactgaatagttttaagcagaaaaaaaaggaacatttaaggactttaaattgactctattttattttagatggcatctttaagtaaagattatgtaacagcaactgaaaagctccatctgctggcttttgatttcactggaaatgcattatgatcatgttcttttctgatttgattcccctccccctaatagttaatgtacttataattgcttctttattgactaaaaacttagcactgatgttacacttttgcattttaaattcagtgctcatacattaattttaaaaatggctaagagaaaaaggcttgtaccatgaaataaacccatattttgaaccagttgcactcttgtaattaggtatgaaagcagtaaaattatttatgtcgatggaaaaagacattataatatataaatttccttaaatattcttaacaaaagtattttcttataatatttcctgaatgtcttcattatctttgaatatttgtctttgctatggtaaacataataataatttgacatataaaactcacttcattgaaatcatatgtttccaatggtcataaaaagttagacaagacagtgtatcattattatatcataaaaagttagataagccaatgtactgttattttatcacatggatttaaaaaataattaaaaacaaatataaccttaataacatcattggtcatcgaaaatttatacatgtgaaattgtaatttttaggcaactgagcatttatgacatttataggaaccatatcaatttgtaagctataaagcacaatttataatataaatcatatgggcagaaaacaatatccctgcctcattagcaataggaaatatagtcctaatgcaagcaaattttaatatttcattgaccaatttagcttatactcaatgttatttcctattttgcatgaacatgtctattaaggattagtccaatctcaaaagaaaaatgaggcagattttaataaatagatctataagctctgattggcctccatctatattaataagttattcacaagagtatgtatttctctaaatcatctgggaaaatagcatttgtagctaaagttgataaggatttatttgaagttgaacttgcattgaacatacaagtccagctggtcaaatattttgattcaaaaaaattactgaacacaaactctgtgttagaaattctgttaggtttggaagatacaaagataaataaactataactcacagattagacattagattatttgcccaagggaaaaagaagaaaaatacaatatcataataacagcaacagaagttggcattgagttatatatagaagagtcagaaaggaaaattgagaatatttccggttggggaacctccaagatcaaaagtaagtatattacatttgatcttcaaatgacactttctggtatacttctcagtaataaaaagtatctgcataaaaagtgagaccatttctccttaactagaaagtcaccatccttggtgccctgtaggtaacaagactattgcagtgtgaaacagcattatgtaatattttaatgaaaacttttaagcccgaggcaaattaaataagtaggcaaaacagctctttcccactcagtatttccaccctgttcccttttctcagttttgtgggatgcacctcttgtgtactcttgagattttgtctgtttgtttcagtggtaaaagataactgtccccactcaatatcacactttagtttgaaggagaaaagcagtaacttaatccagtgtgtttagaagaagaaactggattttcataagaacttcttcctccccatattcttcttgggatttagttaccctattcctgcctgacaaaaatggtaaaggcagtatttgcctctggaacccaagaagcctgaagtttgggagggtttaactttgaacaccaatgctgaggagataaaaatattgaatctgtattccttaaaaaatactgctcagcccagccagaatactgaccttctgctaccattttcctcacagataatttctgtaataaaaccctctcctcaatgtgtgtgtaaacatcaccttgtaccttttgcctggacttcagaacttcattaagttacattgactctcataaggttaagcctatactatatcacattgatcattgtgaaccagtatggtatggatcacaactcctgaagttcataagaaaattacacaaaataatttcttagatacgacaaaacatcaaaagcttctcttatttatagttaattgcttacacgcgtgtttgtatatttcaaagtcctttatcagatatgttttgtaaataatttctctcattccatggcttgtgctttaattcttttaatggtatctttcacagagtgtattagtttctggttgcagctgtagcaaattaccacaaagttgatagcttaaaacaataaaattctgctctttccctgttctggagaccagaaatttaacaccaatttgactaggatgtatttcagaagggccttgttcccggaggctctagtgaaggagttccctaactcttctagtttctggtggctgctggcttgctttcgtggctgcttcgccccaatgcctgtttccattttcacatcaccttctcctcttgtgtgagtctaattttcctccacctctcactaataagaactgaatttggataccactcagagaatccagggtaatctcttcatgttaagacgcttaacttaatcatatctacaaagatcttttttttcttacaagttcacattcacaggttccaagaattaggacctggtatctctgactatacattttcagcctactatatagatcagaatgtttttaattttaataatgtctaacttatcaattattgaatttcatggatttttctttggggattgtatctaaaagttattatcaaacctgaagttacacagattttctcctatgtgttctagaagtcttacagatttgtgtttcacatttagttctatgatcttttttgagttaatttctatgaaatatgtaaggtctatgtctaaatttatttttaatatggatgttcaattgtttcagcaacatttgttaaagaattcttatgtgtttttatgactataattgttctggagccattggcttacttatccttaccagagttggcttttaaaaagagctgttagagtgtgatgtagggcaatctcctaaaggaattagactaaattttttttttttttaaaaaggatctgatacagaaaatgtataaagcatggggacaggaacagggatggatgtaatcactctatgtatagttgaggagaatattattatcatactgctttacctttacatttgtattctttaagctatcatctttaaaaagaacacttgaaaagaaaaaaaatttgaatgtggaaatgaaatgctagcctaaaaatattttactaaaacatgtacttcgatttcaacaagttctagttttttgaaggaaaatagccaaattaaattctgacaatggacatatataaaaggattaaaaagaaaataaaatatttggatttaaatgaatctctaaacgataccagttatacttgaagatttcttgctgcagtaatttaagtgtgagtttttttccttattgttatatgttctccaaaatatacatgagatctaaaatttaccatgtcatggaaatttggaaaatgacacaattcaatgtaaggctttgttgtggctgcgttactcattctgtgctaaaactatatttctttaaaaagtattagcctagaaagataccaaaacatgttacatcacaaaaaaagattctgaattcaaatactattgagaagacttataaaaattaaaaggtttctggaccacaaatatcttaaagaatttagctatttactctgttatattcattttaaagtgagaatgtatagtacaccagattgatcaaacaaaccgtccttggaattcttttctttttcatggagcatcccttaatatctctcaggagaccaatgttctgtagaatacatttatgtgaaatgttgaactataacaatgcccaaggcaggtacctaatgagctttccttaaggaaaatgagcaagagtttatgacttttcatggaaattagagtgaaggtaagcagaaggaaattttaaataactcattttaacatggaagaaaaaaatcaaccaaaaaagctgaaaactaaactgctattaaggattcaaaagcatcagattcttgaatagatcaacagcttttgagaaaagttaccttaaacataactcataaaatagctatatctaaaataatatattttcatagttcaggagtaaaaataaaagtgttattacaataagttgaatttgcaaaccactcaaaggatgaaatgtataatcctttagagacagagctttatattaaaatttcagttttacctcattccatgtaactttggtcagaatgaaactcagaacttaaactaatatgttgtaacagcatcacaaaaaaatgatgtcttatgttgtatttttaaactaaaaatagattatgtacattttaattcaatatttataaatcatagacgttggctgagctgttgtcagtatcatacgatgatgttacaagataaatgatattcactgccagcaaacaaaaatcggacctgaacatgggtttctatctgacatatatgtgcctgtcccactgtgtctgtataggtgagttttgtcaataaaataatgagagtgtcgttctgttataatcatgagtctcaatgtatcagcatatttccatcaatccatataatctgtcatttttatatgtatcactttttaaacagtaactgaatttttcaagttgaatgcaacaacaaatgacccaaaaacccaccaaattatataattttccttataatttataacatatccagtttaatcaatacatttaaaaatatttagccaagaatacttttattcacatgctagacagttggcattttcaccataccaagtactcctaagactgcatctgtttcaccaaaaaaggtgggggcaagaatactctaggatttgatgccaaaatatatcagtattttaggcaacattaccctgcttgttgtccttgctgccccaggttttatttttattttgtattgtttgcttctatttttgcaggagacagaatctctttgtgcagatttctgcttccatacctcaccaaagagccctctgagggtttattcacagagatattctttataggacacaaggataaatctggaggagagacactgatttctaatacattcattttgcttctatagagtacctcaacgctcccccattaaatttccatgttgataaataaaaataccagaaatatcatgaggaaaaccaaaccaaataccttactaagaactgtatttgatttaaaaggttgttttatacaataattttaatttataatctgcaatagtgaaaacaagcatggccctccatcttccaacaccgccagtgatttaaaatgcaaattttcttcattttgtcttgtatcagaattgagaagagctaatcgttttatgcatatttgaatgcaattcttgtttccaaaatgatgtcttgagaaaactagaagtttgagcgtataccatgtgtgtttataacactgacaaaatcagtttgctcatttacatgatttacaatatagaagtaaagctggaaaatttttataaacttttctaaatgtaacctattgtatcttaatatcaactgtatcttgggataatgtgttaaccatgaacaaattatgcttgcacaatgattatacaagacaaaaactagagttacggaaatcattggtgttaaagatgttctcttttctctatagtatttaaatatacaacaaaatcatatttattgaaattaggttattccctttaaactaagtttttaaaacagctttcaaaatatgttgaaatgagtactttttttaaggttgagagcaaatattctagataaatgtgtgattgagtcaattaaatcagatttacaatatacttccggggaataattagtcaagttagtatttccctaaattgaatgaatgcttttggataatacctactattataaaatataattacttatgctatcaaatttccaacacatattcctgtttagaaacaacaggacattatccatgttttcttcattagctatacttatttcattcaacttgagttctggaataacatattcttttttataggtttaattttttcatgaagattttaaacctattatgaagaaagtaaaataaatccccatcagaattttgccaaatttacttcattttttaatattttaagtatttataagttataaatttatccattacattatttcaaagaccagatattgctttacaatgtcttgtacataaatttacctattataacttaaattacaattatgattcttccaaaattcagaagccgtcttactgaaattggaatattatctgaactctttaccatgatctaaaaagacatttcaaaatttggttcccacatatcttagtaacttcgttttacaccatacgccttcttgctctcttcttgcgtctggcttcctttatatttctcaaacaagccaagctcttccattcagggcctttgcacttgttattttctgtgtttggaacagtctaatctcctgaatgctgtatgactgtattttttcataattcaagcctcaacccaaaccatatttctttaaatagacttccctggcccaccacctctaaagtgtctttgcctcttccctggatgctgtctagtacagcccttgtttattttcttcatgataattgcaatctaaattattttatttatttatttacatgtgtgttgtctatttccacgaatgaagtggaaacatcatgggggctgagtcctattgctacctgctgatttgctactgactgcatcattatttggtacataaatatttgttgaataaagaatgaaaaaattaactacacttcctatttgtcctccttaggaagccaaatgaaaattttcttttctcacataattttggctcaaaatggcataattggccaactgccagactaccaaacttctaaagcaatactttccccttttgactaatactaactcaccttcccagctgtgttaccaaagaaccttttcatttggttgactcccatgcgatgtcaacctcaggagcgatgtctcaagttccaaagccagatggccatttccaggaatttaacagatatgctggctcttgtcatggataagtttgaattactagacttatcactggtcttcagtccccagaactttacacttagcaacacttaagcaatattacaatgtatatctctatgagtgtgtacgtcttctataaatgagaactttcttttgcagtaagtttcctagaggaatatggataaatatgtttctttatataaagatgttaatgtgttacctttccttatatatcacattatcttcctaaaaactcaagttcaacacaaaatccaagtgatcaaaatgtttaacccttttatccgcagttataaggttgagcagcaataacattggcaaagcaagtgatgccctgatgacacgtcaataatcttggcttttaaaactgtattatgaagaccgattctgtgtcctaacaactgaataatatttacatatcatttataattttctgtcaatgcacaccatatctaaattcatatctagtcctacttttattatcccttaatcttaggtattttccaatgaaggtaatgttttctggggaaaatatctgcaattgctgagaatagtgaagcattacagtgaatcaccaaggaacggtgggtttgtgtttctaaaaactaaccctcaaatagaaacaactgcattgaaatataatttaatgaaaagtgtccaataaaagttattcataaatataatttaatgtgtgcttaatggtggcaagtgaggcaaacaaaaggagaatactactcattttcattcctgagatcagcatatctttattatagtaaatctctatcaatttctcaccatatttttcagaaaaatgatgattcaggtagaaaataatttcacccacattttagttaatcaatgcacagcagtcccaaggactgtgtgatgataataataataaaataaaatttgaggatccaaattattagataaattcttactatctatatttatcttgaatctgtttttgttggcttgagaaaaaaagaactttctcctctgataagatatgacctcactcctgttagaatggctatcataaaaaagataaaagatgatttctggtaaggatgtgaaaaaaaaggaaactgttgtacattgttggtgtggacgtaagtcagtacaaatattatggaaaacagtatgaagtttcctcataaaattaaaattagaactactgtatgatctagcaatcccactgctgggtatatatcaaaatgaaattaaatcagtatgtcaaagagatatctgaattcccatatttaatgcagtgctattgacaatagccaagatatggaatcaacctaagtgtccatcaacagacaaatagataaagaaaatgtggtatatatacacaatggaatattattaagacactactaaagaatgaaatcctatcatttacaacaacatagatgaacatggaggacattatgttaagcgaaataagtcagtcacagaaagacaaatacaacattctctctctcacatgtagaatcaaaaaaagttaatctcatagaaatagagagtagaatggtgattactagaggctgaggcagtgacagtgggggattgggagatgttggtaaaaggatacaaaattacccttacataggaggaataacttcaagagatctattgtattgtacatgatgactatagtcaatgatgatatactgcattcttgaaaaatgctaaagagagtaaatgttctcatcacaaaactgctaactatatgaggtaatgtatatattaattagctaaatttcataattacacaatgtatatatacttcaaaatatcatgttgtacataataaatacatataatttcatatattaattaaaataaatatttaaataaatttaaaaaaacacataaaaggattgctcacaaaaggaaaaagatagctggcagagtaaaaaacaatgtttacacacagaatagcataacaaactagagtggcaagttgttgaatatgactggaacataaacttgtgatgtatcttccagccttttacttaaaagatagaatctaaatgaccttgtcaaattgtgattaggttttttttttttatcttgtagacaactgtaggatcaacgaattgttactgaagcttaacttcacaaaaaggcatattgtgaaagatcattacaaatcatttattgaatgcatgtataaattttctcaaaattaagccattcacaaacacattcatcctatctttcaagatatatcccctgcacccactctaggttattggttcattatatgcattcatttctcagttattttacttctctggcaattttactatttactattaaatgtttactattcatttctcagttattttacttctctggcaataaatctcttccatccctattgatattcttaccctattacaccaacatgccatgtttactgagctattctcaggtcttctctaattctccataaagtttatattttgcctgttaaaaaaaatctgcagctctgaagagtttggttgtatcatgaagttacatgcaataaagtcattgtaagattaataacaaattatctttattctagagatctgtctcagcgtaatctgtgggaggagaagagtaatttcaaatataaatgaaacaagcttggccatgaagttacaattgtcttaccttcgttataggtatgcggaacttaatcatattatactctctacttttgcatatatttgaaattgtccatagtttttgaagagtaattttcacaaaatgtatgttatttcacaatttagatgattttgaaatagatatgccatttttctattataatgagttgcttacatatttgtcttctcagtcgtattacttaactacttcctttttgaggataaagccagtattctattatttctaaatatttttaaaaaaacatttataaggtagctacttaataaactttaagtggaatattgggaatatcagtatgttttatacctttaatttttggtcatatatatttgtaaattacaaatagtaaatattaaatacatatgcaactgtgcagtacctgtacatatggcaggttctaagttgcctctgacaattccctgaatgacaacagaggtacaattattatacatttttgcttgttctctcaactttatattttatccaaattaagtttattcttattcatctttttattatttgcttttgcactgctcagatggcaattgccttggaactcggtgacagtgtttataatcttaatgtgagtcaataacagtggaaggttatcacaataaatcatagtgggatgcaggcaacgaatcacagatcaattacatctaagaattacagactgtgtctttaagcagggaagaatagtgtcagccactcaatttggaaagggaaataaacacactcagattcctaagagatctacaaacgcactaaacaactgtgaaataggctctgtgaagaatggttgagtgaatagtggtttttagcttgtaaagcaaaaagccaacaaggaacttaagacttttcacatatatgaacaggtattgctcatatgggagtatttcaatgagaacaatattatagcaagtagaatttaaaaaaaagattttagacttacatgagtattaggaaaatgctagtgatagcctacagttccacactagttaaaaaaaattaagttgaggtcaagattatttaatccattgattaactgttcactcaggatttgtgactctgcaaggccaggtgcaatttttatcttatattttaaatatttgggaggtcaattttttatatcagaaaacaagctagttccccaaggtattttgtaatttaaaaattgtatgaagtaccataacaatattattttgaaaaagttcatttcacatttgcacaaagtccatagttagtatcctttgttatcttattattcttaatggttaccatattaggttggtaaacttagttggccccaggtaattagatgattgaagctacaggggataaatatgagttttaatccattaatattttgggctttgatttctacatacataagatgagaagcggattggaggatcttaacttactcttctgctaaatttctagtgtttcctgagttttttatgtcctgattttgatgcaaatgaagcaggcatgcagccagtagggggagtcctgatcttatcccccaaattatacaacctcatataagttggcacacaactgtaagtaatctgattgctttattttataccattccaaaagcatagaaaagacacatttaggccgggcgcggtggctcacgcctgtaatcccagcactttgggaggccgaggcgggtggatcatgaggtcaggagatcgagaccatcctggctaacaaggtgaaaccccgtctctaactaaaaatacaaaaaattagccgggcgtggtggcgggcgcctgtagtcccagctactcgggaggctgaggcaggagaacggcgtgaacccgggaagcggagcttgcagtgagccgagattgcgccactgcagtccgcagtccggcctgggcgacagagcgagactccgtctcaaaaaaaaaaaaaaagaaagaaaagacacatttatacacagtttttaaaaagtaaaaaatttagaaatgtattatgctgtaaaatatatctatctaatggtataaaataatactgtttaaaattagcgttttcatttaatcttcaacgggattagctgctagtaccaacgccactctgaagcagaatccaattctctaatctgtaaacaacagtaaaggaaaaaattttggctaaaattagacacacacagatggtattcctatattctgtgctttcatatgtaacacctgcttcaatctgtactcaaaaccactcaggaaaaaataaaatctctgcatttatttactcgaaaaaataatttttctattgacttatttaaaaataaaataattggtgatgttatatttgattttatggacacacacacacaaagccttttttattttgatccctgttttactccactggtactacacaggctcgctcacaatatttttccattttaatttcatttatgtattaaaaattgcttaaatacgtatatgtatataaatgcacacagcccaacactttcagcttacattatatgtgtatatatatttatataaatacacatatatacatttacatatgaaataaagatgtttattaattaactttactggtattttgaaattttgtctacctttttgggttaataattttccttcaatgttactaacatgaaaaatgggaaaggaccttagaatttgtcacttttgagtcattaaaagatacaaaaacctagggtatttatcacatatttaaagcatcacatgaagttgctaaaagagctgaaactatgcctaggtcacctgactcacagactaattgatatgcactatgatatattgttccctgtaatctatactactcctttggggagagttgtccatattctttatatctcaatttcagtaaatgtatatgaaagaactacatgacatctcacttctgtgaagccacaatgggagttggtgaattaacatttaactgaatatctctctaaaattcaggtccaattaaatatttttctattaggaggaatatctccaaatttctctctctctctccacatatatctagctatataatatctagatatgggtgcatttaactcaatatcatatctatccatatttacattataatatacttatgtaaagtaaataatgcagagaacaatcatatatatacacactttggcatatgagtatagacacagaaacacatgtatttgaaaaacattacagtctgataattagattatgaaagatattaagaaaaatatacatggcaatgttaagatttaaaataaaaattttaaacctatatgaagaatacattggcatatattccttgcatgtttttgaaatattattttaacgaatgagacaagtttgaattcttattcagaccacagcactcttacccccagcttccttaaattttttctagagataagaaggttggtgctaggaaatactgaaaaatacagaagttcaaatttgtattcctcatctgtcaccctactttcacatacactaatatttaataaatgtgaataaacacattaaaagaaggcatatcagacaagtgaaatctagtgaaatacacatttttggagtaagacattttcacattgtttttcaaatccaacatcgatattacttataatattttgagctcagctgtggaggaattgagggcatttgaaagcattcctaatataactcagcaacagttgtcgctttaattatctaactctccttttgatcttactacttattcaattattctttgtgtacactgccatatgcaccttgttgttaaaaagtaaaaaaaaaaaaaaaaaaaaaaaaaaaaaccaataaaatgaacaccataataccatgaggatctagcatgagtgtaagattaatgctgcctatacctttatccgtggccaagcacttatcattgtaagtgtttgtttttacagttggaagacagcgttctacaagatggcatataaaacaactttttatttgaaagttgtgaccatcactttacccagtataacaaaagagtagaattttatgttatatacagaagtttaccaaaatttctctatggcttttcctcacctacaaaatcaatctcaagataatggtgaaaaacgatgtcattctaagaatggagcatcactgaataatgggacaacataacaggtattctgcctaaggaaatcctcatttgctccccaaatcattgctaatgtagctcacaaaatacagagttgttacaccagaaaagagacttaataacatataatgatgtccatattgctatcagtcagttaacaaacagataccgaatatctactttgtgctaatgtctgccaagagcatatgtctaataagtaaaattcgctttgagtttagactataatttagaagttatttctcccctttccactgaaacgagtaggcaaagttcagaggcagccagtagaaaacacttcaagatggattcaaagccaaagactatttaatacacacacacacacacacacacacacacacacgtgtcatgccgaggaaaataagaaactatcaatactttacgaacagcattgaaatatggaaccctccttaggaatgaagctaagagggaccgttgaaaaatgattattccccagaacaatttgctaattgctgaagagtcagcaattagtattagcgggatttgattttttaaaattctgccaacataaaatcggagtagcttatgtaagactaaaatatgagagaaatgaccgacataaaaattagaagaacagagaaatgaagtaagagcaagccaggataatttggaactagaataatggtttttataattacttaaagaaaacttaaaataagtatcagaagtcttatacaattaattttgtgtatgatattttaattttttaccaaaattttagtcaaaaatggtgctgtgttcttttaatgtcatactggagccctgtctaagacgctcactcaaggttgatttaattatctatatgaatgtaacttttattttgtcaattggcaaattcttatttaagatgaactcaagctcattgttttaatgagatgactcaatgtctttcatgaatctggacatttataaatttgttcatttgaacatagaagataaaatttaattacttttaaaggcaggatatatatatttaaaaagtaggttcctgaagtagacaaatacttccaaatagcctttgaggcataaaagttatttgattgatgtacaaatttctaataattattttttctttaatatgaaatgttaaaacatctttaataatttggtatgtttcttatatgagggtatttaaaagtaaatacatgttcaagaactgtttgtttagtaattcatattttgattcaaataataataacaaaaaatatattttgtagaaaatttgtcatttcattcaaaaactgggaggtgaggggttggaatgtacaagacacttaagagtaggtggcaaattctgtcttctgtcttttctgtattatttatgcgtttgttgtccaaaataaactaatatataaaaaaattgatatccaattttttttaatcctcatcaaaagaaagtttaccactctctctttccagacctggccaggcaggaggcgccatcatgggagttgacacccgccacaaggaccgaaaggttcggcgcaaggagcctaagagccaggatatctacctgaggctgtctgtcggtcaagctgtacaggtttccagcaaaggaaccaactccacattcaaccgggttgtgctgaagaggttgtttatgagtcgcaacaaccggccacctctgcccctttcccggatgatctggaagatgaagcttcctggccgggaaaacaaaacagccgtggttgtgggggccataacggatgacgtgcgggttcaggaggtgcccaaactaaaggtgtgtgcgctgcgcatgaccagccgggcccgcagccacatcttctagggagtggggtggggtgggggtggggcggagcggagcggggcgcggggcaagagcctcacttttcgccagctggcgctggactcccccaagggctgcggcgtcgtccggctctccggtcctccaaagggccgaggggtgta
